United States Patent 8,067,671 (METHODS FOR GENETIC CONTROL OF PLANT PEST INFESTATION AND COMPOSITIONS THEREOF) - sequence listing, part 27

SEQ ID NO: 39851 - DNA, 1248 bp, Heterodera glycines
agaagatgtaaacagtgaaagtgaattgttttttatgcttttttgttattttcgatgatttttttgtttaaattcaaattaaataaataattaattctttaatttaaaaattaattaattaattaattttaaaataaaacttttattcataaaaaataattacaaaagtttttcatttaattaaaacattgaaatctcttatgttaaaatcattctctaatctattttttatatagaaattgcaagcttagcacatcaatgttcaaaaaaaatccctttagtttattcgtttgcagtatttgccaaaatttggatatataaatatattatatattttttggttttatttatgctttcattaaaattattattttaattaacttttcttttataatatattcattaatcaaaaattatatattttatttattactttttaatttattttctttaatacaaattcataatttatctcttgtcttgattgtggcggttttcaatttttcttccaatgttgatatttaacgaataatataaaaatttggtttatatttttctaattacaacgacgaacgttttgatatttagtaagaaagaactaaaattataattttattacaaagaatgagtatttttgagcatacatatgagtaagtaatttaatataacaattttattgaaattttttagattaatttaaaattcaaattccatagaaaatttgttgaaaattagcttctttatttttcatttttgcttattaaatatcatctattgatcactagtttcatggggaaaatatttttaaaaaattatttgcactttttcatttttttccattttaggtcttcttttaaatgtgtttaagaattttggcattttaaaatttttatttacctttattaattctactttaatattataataatatttattagttgttaaggttcagctagaataaaataataagaatttgctcaaaaaacgaattcttttagccgatttcaatatccaaaagatttatttaaccgtctataaaaataaattaatttaatgtttacattagataattaatttaattttaataaatttctcttatgttaaaatcattgttatttttatgtttttttttattaattttgttctttcatcataagtttgtatggaatttgtttcaatagattcaaaatgacaaaaaaaaatttaaatttttattcaagagctaaaacctaaatatttattgccaaa

SEQ ID NO: 39852 - DNA, 756 bp, Heterodera glycines
tttgaaaattcataatccacttctaaatgaatcaattaaattgcaaaaagcattaaaaatagagaaaaaaactggagcattttatacttttttagaattttctatcttcaaaatgaagaagttattacataaattttggaaaaattggttttttgagaaaaaaaattaatagcactgttctgaaaaggttttttgaaaaacacgaaattcttcctctataagcttctgtttattctatatttttataagacttttgaaaaaaagtacaaaaataaactgattttggaattcgggatcatagatggaagcaaatggttttttgggccttgggcccgcatcctcttgcctgaaaaaatgtattttagggaattgtgggatcactatccgagagctatgtttttacataatgacggcatcgatggaaaattctataccacagatgacacctttgttgagcacggatgagcattcggatgtgcactttttggtggggacgaacatgaaaaagaggcgagttaaatctgcgatccgtggcataatgcactaaatttaatataaattttttttttcgaaaattgggctattttttcaaaaattctttcaaaattctaatttttcccgccgggactgatcaataaactaagatttttctctacggcgcctatcggcaccgccggacagggacggatcccggagggggggtgcgcggggtacgccaaccaccaagccctccctcactttaattttctttaaaaa

SEQ ID NO: 39853 - DNA, 785 bp, Heterodera glycines
aaaatttcgatttttattcgagttcgggttagggatcagtaattagtcaaaatacatgtcagattcgtgattagcgacctttaaaaccccggataaaaaattatcatggttttttatcttaaaaaaattttgcaaaacaaaagggtccccccttttgtttcaaaaagggccacttttacagtagcgccaaaatttctttaaaaagttgtaactaaaatgaccatcctcagtttctttggccataggtatatatcttttttcttatttatcaaagcctacattcttggtatcaatttcaaagtaatggcatagttaaatgaccgaacaataagaaacgaaagattgccatttatggggacacgcgtaaacaaacaaacatcgtttggacgcgtaaataaactgaatgcagtagagctgggagaatcagagcatttcgttttaatggattttagggcccttacgggtgaattcaacaatcctacatacagcctgaagaccaccgacaaagaaaaagttatggcaattgaatttaccgcttacttaccgtataaatttaaaaattcaaaattttaaatatgtatgaagcattggcataatgtttatcttacgatatttcatttcgaaacggcctcgaggcttttacaatgccaatttaatgacgaatgaaaaaacaagaagcataaagctaacaaagggaaaggtgttaatcttggcaatgtagtaaaaacataaaaatttgtatgacatattcgatggtctctaaaggtttggtaaatttaccactc

SEQ ID NO: 39854 - DNA, 212 bp, Heterodera glycines
ggcctgcaggtcccgtaatccgtaattacggcgatttgttcggaaacccgtaatccgtaaatacgtccagcactgtagcgaacccgaattttcaaattttcccgcctatacccctacccctgaacccccggatttcctcccaattccccgtgtcacgccccccccccccgccctaatctttttccaataatttacaaaattcctccaccaca

SEQ ID NO: 39855 - DNA, 1122 bp, Heterodera glycines
  misc_feature (62)..(62): n is a, c, g, or t
ttttaaatttatctctatgcagaaaaatgctctctttttgcgagaattttgttccatacaantgttccagcgtggcagagggcgcggagagcaatggccatctattctacagggaattttaaatttattctctatgccagaaaaatggctatctcttttttgcgagaaattttgtaccatacaaatgttcccagcatgggcagagggggcggagagcaatggccattctattctacagggaatttttaaatttattctctatgccagaaaaatggctatctcttttttgcgagaaattttgtaccatacaaatgttcccagcgtgggcagaggggcgcggagagcaatggccattctattctacagggaatttttaaatttattctctatgccagaaaaaggctatctcttttttgcgagaaattttgtaccatacaaatgttcccagcatgggcagaggggcgcggagagcaatggctattctattctacagggaatttttaaatttattctctatgccagaaaaatggctatcacttttttgcgagaaattttgccatacaaatgtcccagcatgggcagaggggcgcggagagcaatggccattctattctacagggaatttttaaatttattctctatgccagaaaaatggctctcttttttgcgagaaattttgtaccatacaaatgttcccagcatgggcagaggggcgcggagagcaatggccattctattctacagggaatttttaaatttattctctatgccagaaaaatggctatctcttttttgcgagaaatttttcccagccatgggcagaggggcgcggagagcaatgtccattctattctacagggaatttttaaatttattctctatgccagaaaaatggctatctcttttttgcgagaaattttgtaccatacaaatgttcccagcatgggcagaggggcgcggagagcaatggctattctattctacagggaatttttaaatttattctctatgccagaaaaatggctatctcttttttgcgagaaattttgtaccatacaaatgttcccagcatgggcagaggggggcggagagcaatggccattctattctacagggaatttt

SEQ ID NO: 39856 - DNA, 806 bp, Heterodera glycines
ctttgtggccaataactctgaccccctactaccctcgttcgctgcgcatgcagtggcctcattaatgaatgattgttgaggtagggtaaagctaggtactcattaactaaaataagtttaactaaatcaattttgggctaattaatcattaaagcccttttgctatacaatctgagaaaacgaaaaatattaatggcgtgtatttttttgtttttatttctatttcaattctaactaaatttgcttttaaacccaattttccatagtggcccctactgttttgactcccgtaaaatattttacaaatttattttaaaaacgccaaaaggcacatcatttttttcgatcttactaaaagcatcaccatccatcagcaaaaggcgcagcggcgagcgtagcgcacacgttgcgagcggcgcggccgcgtcactacaaccagatagtcgacgcggacggcctggcatccaaggcatttggggcgcacatcgtgcccctcgacctgaaaacataattaaatttaatttattcaaaaaaaaaaaagagttttgcgtacccaaagcctttggctgtcctcatctccccgcactattcctgtccacgggtcgatgctgtcctcgacctgccgcgcagcctggtcccgcgctgcgtccacatagcgctgccaccagccgttctcgcagcatgtgtcacagattgtgacacagccgcagctgttgccgcggactgtcactgcacagtccactccatgacttcccatgcacaaaaggcactgatcggagaaatttatttctccgatcagtgccccc

SEQ ID NO: 39857 - DNA, 1162 bp, Heterodera glycines
ctgaatgattgagagaaagctcacataaaggaattccataacacttaagtggtcgccgttagctcaatattagcagttgcacagcgcttgaaataggcgccgaattacgattttttcatttgctaaaatgtaaatcattatgctttttttaaaattgtgttaagcaagttttgaatttaattttattaaattcaattcataaggttgagtcgctgttttccaccaccacaaccactacaacctccacaaccacaaccacgacgaccacaaccacctcgaccacaactcccacaaccacaactaccacgactgcaacgccagctcctgtttatcccaccgctgtaccttatcaaattgatcataatataaataataatgaaatcaattaatgtaattaattttatgctaatttttaatttgtagcttctttgtaccttaagatgaatgacactaaattaattagcactgatatatttaagtttcaacctggctggcgagagtcttccacgcccggaaaaatgcaatcatctaaggtatccatgtattttgaattaattaaaaagaattatgctataatttatattaatggagtattgcacctttccgagatgagaaaaaatttggggtttcagcagaaattaaaaatctctctaaacccacccccccttcctcgggataataagatcgataacagtgagtaataaagtctcagattctgtttctggtaattggttttttcatattttacgtgagttactccaaaaagggctcagaaagtaaagttcggtattcctcataccatcgtatataaaaaatatcgaattttcataaagaattgttgagaggacgacgggggaaaatgatttattattcattgtgagattagcagtcattttcgttcaggaatttcaactagtcaaggtcaatcttttgcacgagtcaaaatagaagaacatttgggaaacaatcggtcatttttcataagcaaaaattttatcaacatttagaattttaataatgttaagaaagcattgtgactcattcattcacaaggtgacgttcctctcctgcaagaagggctcatttcccttcacaaaacatttgcacggaaaacacccgggcgcatccgccgattccatcactctcatcgtcttccaaaagc

SEQ ID NO: 39858 - DNA, 1104 bp, Heterodera glycines
gcattttgggataattaattaatcaatttatgagacaattaggaaagaaatggggggataaaatgacaagccatccacagaagctgggcaaacttcacatcagcacttgcattgagcgagaggcacgaacgactgatcattatcctgcacaaggcggaggatctgcctaaatggggcataatcggggcatcaggtgataataaaagccttgctaatgagagagagtaattatcaaattaatttccttcgtcagatgttcaaattggcattcgaatgcagcagggcaatggcacggaggcactgaaatgttcgcgagtgctgaagaacacaacgtcggcggtgtacaaagaagcggtgatgtttgtgatcagcaccaaagagacggacattgcccagaccaaaatcaccatctcagtccacgacctttccaggtgaaaggggggagggcaagtgccaaagtcggaaatgcttcaggtcggtgacgggcaatgacacaatcggcgcagtgtttcttggccaattagccatcgacaagtcagaggtcggcttattcactatttaactatttaaatgatttcgatgtttttttttgttattttagcaagaccaatggaggaacacaatggaccattggggcaaggaggtcaaaggggtgcacctgctgaagaacgcacagggacaagcgacacccgaagtgcacgtggtggacgtacgggaggaggacgaacagggcatggactgaactggcacgggaggaggacgaacagggcatggactgaactggcacgggaggagaacgaacagggcatggactgaactggcacgggaggaggacgaacagggcatggactgaactggcacgggaggaggacgaacagggcatggactgaactggcacgggaggaggacgaacagggcatggactgaactggcacgggaggaggacgaacagggcatggactgaactggcaccgggaggaggacgaacagggcatggactgaactggcacgggaggagaacgaacagggcatggactgaactggcacgggaggaggacgaaccagggcatggactgaacttggcacgggaggaggaacaaacag

SEQ ID NO: 39859 - DNA, 1268 bp, Heterodera glycines
aaagccctttttaatgggtttattccactttgtccctttttttctgttttttgcttctctgcttgaacaaaatcttcacgctgtttgtaaagttgtgggtggtgatttttgagatgacaagcaagcactgttgtactgagagaagcatttaatgtctttgagtaggaacatccatcggctttacatttagcagttgatttgccttgacgctcaaaataataccaccaattaccaggatttaagtttgacatttttaaattgctaaagaaataagaatttaaagaaatgaacatattttctttaaataaaaaatagaaaaatttgttttttataaaaataatcttacaagaaatcgtctcgaaaaaataatccaaaagtcaaattacggatcaaaattacggaaaaatcccaaaaatccgtaacccgtaatccgtaatccgtaactcccaaaaccccgtaatttccgtaatccgcaatccgtaattgcgtgcagccctggtcggaaatcataacaatgatggttcgttactaagaaaaaattatttacaatagaagcaaattcagcgtatccaattgagaaaaataaacggattttatgccagttattttgacaatggttcgataaaatataagaattaatcagtttttatgtcgtaaataattttcttgtttgaaaatttatccaatttttcttataatcatccatttaaatcctccaaaatctctcctccaaactgtttcttccattttgaaatggtccttctatcaatttgcaatattttagcagtttctttgtcactcatttttgggttttcactttttattttccaatattttttcattttttccattttttctttctccgttattttacagctaatgccaaattgtttcttccatctcttaattgttccataaccaactccaattttcttacaaatttcttcataattttggtgccattcttttaatgaatattttcttttttgcttatattcatttgtcatttcaataaatttctgaacaatttcaagtttttgttcatcagtttttgatttatagcatttaattttttgaagaccaaattctttattccattgttggatatatgtgcgatttgtccccaatttcttcgctattttcgtgtttattttactccattcttttcttggatattttcttcctttttcctttattttctcttttattttataatatttttcaattaaagacttttattctcttcatttcgttgttttccttctttt

SEQ ID NO: 39860 - DNA, 854 bp, Heterodera glycines
gtgctgctttacctttttcgaagggtttcttctttaattcaaaatttattcatttttttgaccattttactctttccttttttattacatcaccctttcaattcaattttaattattgtagttcaattgcaccttttcttcagccttttctctgattttcacacattcatttcttttttagcttctctcaaggcttattttctgcagttccattaaaatttgattcactcgaatttgcatttttcatttacgtagtaaaaccaattttggcattaaaaacggttcaacatttaacctgttagcatcacataagacaaacaacaacaaaaacacacatacggctttatgccttcaaattcagataatgcattttttggcactaagcctttggcacatagtcattttaagcacacagcgttacctgccattttcgcttgacactaggagcacacagcttcgactagtccatggcttacgctcatttcacccattaattgatctcttctgggagcacacagcttcgaccagtctcgtggcacacagccacaacggcactcagcccagctaggagcacacagctgcgactagcttttatcttttcatgctcaaaacctttgcacttatcctttcgaaaacagccaaaatcacaaaattaacatattatcacattaaaacacaccgcattgatcaatcaatgatcacaaaatatgccatatggtttttgtattaccgtactcagccaaattagccacagaaaatttgccaaatttctttcgcaagacaatgcatttttgtttggctcatttgcgtttgactgaaaaatagcaatttcccattgctttagtctctttttt

SEQ ID NO: 39861 - DNA, 823 bp, Heterodera glycines
  misc_feature (777)..(777): n is a, c, g, or t
tcctctccttcttctcctcctcttcctccactgcttctctatgtgccttttttccttttctcctcttccccatggtctctaatcgtctctttcccatcctgttctctccactggtcccgttgtctctcgtccctccacttttccaccccaacactttcgtgcaaatttccctcttgttgaaatgtttttgttgtcgttctcgaggaaaattgtgctgcagttgaaagctgattgtgagcatgccaatcggcgtcgtagttaagctcatctgaagaaaagaaaataattttgataaattttgatcaaattatcatttttaatgattcgatcgattttgagatttctttgtattgattgatcaattattcgtttttgatcagtttttcaaaagtgccaacacacaaatgcatttgttgtaatttgtctgcagacgaatccaatggcaatcagaattgttccctgcgcaggtgcaggagccgagtccggtccaactgatgccctcaaatgactgccagcagtcgttcctgacaatttttaaatttatttttattttaatgccttaaatttaaaataatcgacatgattttgatacattattttatgttgtccccccctacgcccacttattggccattttgcattgattctgcgcatcgaccgcacaattgcgtcggaacaatgtccacagctcgcggcacgacacgtgccgaaggcacaactcattcaacgcccattggcacgacaccgccgtggacaatcgccgagaaaaacccgcgngttccaaatctgtatttatggtcgaatgtatgttgaaagtcatatg

SEQ ID NO: 39862 - DNA, 1236 bp, Heterodera glycines
tttatttaatatatttttactttgcttaattttgtcaatgcatcggacgtaaacgcattggtgtccagcaacagggcattcataaaggtccaattggtcttcagagtcaaatttgcctttgggattgaactggacgaaacatttcaatgctaaagagtttcagaaaattcttaatgttatatttttattttttaccaaaggatgtgtacaaaaatccaactgacaaaaaaaagatcgataatcccagcatttaattattaatttatatttattttttttattttccttaattttacttttacacataaatatttttcaacaaaaatactaaaaaataaatgagaagaaaataaaaataaatgttaatggtttttgaattttacgaatgatttatccgataaaacgggctgagaatggacataaataataaataaatggttgttgttgattcatcactttgctaaaaaacaaaccattagcacaaaaaataacaaattctcctttctatcgattaaattaaaaaataaaatactttatttaacgccgaattttccaaaatgaaaaaataaattataaatgataagaaaattaaacgagtggttcctcgagagtcttgggcagagatttgactcgagatttcacgcctgttacgacataacaattggacaaaacaaacatttctatcggaccagaagtttaggctataaaatatgcctctgcgttgttagtgctgctcgagaccgaatgcgtctatgtgcaaaatcggatttaaaactgtgcaagtccaaggcagggacggtccagggggagagtacgcgggataattaccgcccccccccaacacactccacagcgccggatttttttaagggtaaaatactatttttttgctaaaatatctgattctcaagcaaaaaaaaaaatgggtcgatatcggcggtgccacctcaatgccaaaatcctgggaccgtccgtgagtctacggtctcgagatctctcggctttaagtcagaccaggttaacaaaaaccaacacttttactacatccttaaaaattgtgttttaaactaaaaagtaattttggattcaaaaatttattataatttccgagaacataattgatttgtttgttgtaagagaatgcttgctgtgtctgcgaactttcaacttttttgttgttgttataaaaaggtcgggaaattcccgttctaaaggtctaaccgcactggtttttgc

SEQ ID NO: 39863 - DNA, 1096 bp, Heterodera glycines
aaagcccaggaaacttctttttatgacattaaaatttttgaaaattttttttcgaaaaaggtggggggacaaagcacagtataccaaaaaaaacatttccgctatctagtgatacacagacaaaggttctacttcagttctggtcggttttatgcgtcccatgaatgaccatcctttaggccacaatgcaaaagagcaaatattggcataaaaaaaagaaattacaatgagaaaacacgaaattcaacttttttcgtgtataatttttcttttctctttagctaaaaataaagttatacaaaagttttcatttgataccaagcatataggtattgcccaaaaagaaaaatgtgatggcctaagaaactgatgacattcatgggacgcataaaaaatagagccctcttcttactcggtaaatgtcaacattcctataactagtatcaaacgaaagcttagtctcgggaacttcaaacggaagaaaagagcaaatagtgttctctgtccagcattcagttgtaaaacttaaattaagcttatgatttgaggcaatggtagaggacatttgtcccgaaattttttaccaagtaaaaacaatgaaaaattcgtatatccgagacaatcacagataatgaccatcactttgttttcgaagaaatctttttgtaaacccgacttttcaacaaatccatcaaattgcggtagtatgaataaacaaaattttctattttcatgtttcatccattactattgtatttgccttgccctgtcaaacaaaaaggccaaacctccaggggccgctccccccggacgttgcggacgatcgacggcagaccgttggccaaaacgtggcggtgggtttcggtccttacgcgcttcacgcgaacgattgcgcacgactttgctgtgaatggcacacgagacacaatagtgcaatttgtgatagagtttcggcagtgcgtattctaaagacaattgtaaggtcaacccaacggggaagctttttatgtgctctcaataacatttttttggtaatctcaaatttaaatcccattccaaaaatctacgaatgcgtcggaaataaacaaaaaccata

SEQ ID NO: 39864 - DNA, 1294 bp, Heterodera glycines
atttcaccgattaatgcatgcgttttgcgttttccacgtttatgtagacgttcatttgaagcgcgaggaggaggagcattaactgcaacaggaaaagaccagcaaaaaggagacgaaaaaggccaagaaaaaggagttggaggaggacgtcattgaggacgagtgagtggggggaggggcattggaatttttcaaaattcacttttatgttcgagtctgcaataatattatttttttgttgttgtaatggtttgtgatcataaaagtgaattatgaaaaattccaattttcgattttttgttcgacatcgagtccgggttcgaaatcagcttaaatgaatgccatattcgtgatcagttcagtgaccccaaaaaccctaagaaacatgtttcacggcttttaaaacaaaaaaattttctgcccaaaaaggggggaggggaaccatctaaactattaccgacattgcaactggcaaatgccatgcccagcagagggtcaccgtttcttatattctattcaattcgttgacaatttaccaaatgctcattgtcactggtggaccttttttgtaaaatatacaaaatctattgggttccaattcccttcttctttttttacagatacgacgactacgatgagcaacttcacagatattgaggacgtttccttttgttcgactgactgactgatttgagattccgactgattcattgatcgattgatgtttggtctgatcattttatttgctgttgcctttggtttctcaattcgtttcatacaaaaaagaaaagtaaattaattcgaaattgaatgatcaaaatcaaaaaatgttgtcggattcatcccttctgtcctaaccacttaccttctcaccaatcactcattttgttcgtttcaaatttcctcgctttttgagaattgtttttccgatcagattatatttcgataaattatctgttggagatttaattaataattttggtttatctcacagaaatcttttccgacaattggtgagatttttcttccaaaatccgtcaaattaatgccaatgtttgtaaaaaataaaaatttatttaaacaatgttttatgtaatatcgtagtcataataatactaaatttgaaatggacccgtgaagaattgagcttgggaaataaacaatatcatcaaaagggaaacaaatgcaaaacgatgggcaaaaaaagggaaaatggacaccaaaaaagggaggaaattgaaaggcaatggtcggagcaccccgaaaaaaatcactttttggtgcccgattttca

SEQ ID NO: 39865 - DNA, 1022 bp, Heterodera glycines
  misc_feature (56)..(56): n is a, c, g, or t
  misc_feature (62)..(62): n is a, c, g, or t
  misc_feature (66)..(67): n is a, c, g, or t
aaaaaaagaacatatacttaattgttaaggaaatctctttgatttaggcaaaaatnattggncggnncctcagaaggagccttttcaaaaaaggttcaaggaatgtatttgttgaacggtcacaacttttggatattaacccaaaaaattcggggtcgctcatcacgaattctgacactaattttgacccattcctaacccaaatccgagaaaaagtccaaaaattaaacttgagaatttacttttttttcaaattgagaaagtgattcggaaaaaattgctagttgacaaacaaaaaattgtaagaaagggaagggtcacctctttaaattttaataaaattaaatatttttcgggtgccctgacttttacgggccattttccaactcgagtcacaaatgtcggggacacgtttttagttgatcctaaacagcaaaaatgccaacaaagatccttttcactattttactataaaacaaatttaggcacaggcacacaatttttttttttgtatttgatttttatgcctctattctcgcagattcgtccagcacaacgtccgcaacgccgagcattgcgtccagcggtgtgcacagcagcggggcgtgctgctccgacgagggcgtgcaggtggacatgccgacgacgccagcggtggtagcgaccagtgcggcaacaaacgcgtcacactcgcacacgcaacagcggcgacaacgccacggcggcgaggcggagggcgacgcggtggtggccgtcaccaccgccgccgcggcatgtgcgcccgcgagcgttgtcgcggcggcagcagcagccgcgccggccgcggacgcgtcggtgttggccgagctgcgcctgggcatgctcaagcatcggatgctggagcagcggtgctcgcccgccaaagcgtacgtaaactgagagatagggagagaaagcaattgttatgggttagcgaaaaaaaaaatggggacattttttggtcgtttaggctagggcaggccagggatttgagacgtcctttt

SEQ ID NO: 39866 - DNA, 309 bp, Heterodera glycines
tcatcatcaaccaaaatggcatctcgcatcatcaaaacatagacaatttgcccgaactggtccaaaaccaaaacaaaataatttactataaatgagaaatgtcgcatttgtacaatttgaagttttgttacgaaaacaatcatcaacattttggaccatgtcaagaaaaaaggaagggaaaagtgtggaaatgacagagaaaagaaagaaagagaaaagcagtgctccatcagacactggaatcaaaacaacaaaataaacaactcggcatctcgtcgtcgtttgctctcgcccaattttatctcatca

SEQ ID NO: 39867 - DNA, 415 bp, Heterodera glycines
gcacgaaaaattgccaaatatgcacaaaaacttgaaaattaggggtgcaaaataatttaaaaaattttattcctcataaattttatcggttgtttttgtaattgataatcaaaaaatttctcaaggttttcggaagtgaagctcactgttgacccactcgcgcatcatccattcagagttggatttaattttaggcataatcaaaatttttcctaagggattttcaaatcggaaaatatatacaaaaaatggcaaaatatgcaaaaaatcagaaaatatgtacaaaaaatggcaaaatatgcaaacaaaagtcccgatttttatacgcaaacacaaaaaagaaagtgtttttcctactatttagagcatggagaagccaggaaaaaatgcatttgcatgttttttgcagccctga

SEQ ID NO: 39868 - DNA, 1245 bp, Heterodera glycines
  misc_feature (58)..(58): n is a, c, g, or t
cagatcagttctgatcaaaaagaatttttaccaaaaactttcaggggattgccatggngggtgtacccaaaattagtgcaataaaaccgtaaaaaaatggaaaaataaaagtttggtttagaattttaagctctattttatctgggttttgaattctgtaattgaactgagaaaaaaaattttgaaaattttttcagaattttcgactttttccaaaaaaggttgggtaaaacataaacagaatatttcggggtatttttgttaaaattcttcataattttatcattattttatattttaatagggctttctacgtttattttgaacggatttacaaaatttttaatgaaattttttaatttggccaacaaaagaattaggacccgaactcggtttttcaagttccgttcccgggcacctaacggacccggaagaagctattttagtatcagttttttatgctcttttcaattaaaaaaagagtttttttaaatatgcaaataaaaaaatttattaacaaataatattaattaattttagtaaaaacactgacccaaaattgtaaatctacagggaatttgatttttattgtagactgttgtttttaattttcaatcatctaatatgtaacctcatgtaaatataaacttttggtaaaaataataatatttaaattagcattttatttatattgcctctacaaaatgcttaaatgaacacttcatttatgcatatttaagcataggttggacaattcaatataattatttttaaaatttttaatgacttaataaattattttataataaaattaactataaaaacgaaaaaattgaaataaggcctaatattttgaattttacctttttagcaatgtagactaatttgtaagttataaaataaaataaaaattttttagaaatgaagttatgttctaaatttaaaaatgattaatttagagaaactaatttataacatgaagtaaggaagaaggaaaaaatatagcattatgaaaatatacaaacacaaaagcattccatgacaaaatgggataattttttcatatataaatatgaagaggatttaattgttttcgcccacgtccatatattaagcaaatcaattgtgattgtgtacatatgggagaatacataacaaggaataaagggtgcaatttataataattcaaatcaatttcttttgaggagagcaatattggctaaagaaaatatttttttcttttaa

SEQ ID NO: 39869 - DNA, 1164 bp, Heterodera glycines
tttttttgcttattttttttcttccccccccccccccccctcgtcaaagaagaaccacgtggttttctcagttttattatgcattattctttttaaagcataaaatggcagacgatgacaatgctttacacataaattttactcttaaatacttttttaatttatttttctttatttgggtcacttaattaccgcttttctccccccccccccgaaaattattcgttgattgacgattaaaaatatcaaatttattgatttcaatgacgatggtgtttcaattttctgttcatcaatgttcaatgatgaatgcatttttgatcaaaatttaaattcattttatgccctttactcagcgattaaatttaacattttctaaaactctgattttaaatattgaaaaatgataaatttttcgacgaattgttcaccaaaatttgttctttttttgccaatttgtttaatttgcatctctcaaattggtataaaaaggaaatattttgaacaattttcatcatttgttcacggatgaccttttgcttttttcattcctcctcatcttccccattttcttatcgcatcccttttaattttgtccttttcttcaagaaaacattttccttgctttaatgaaaatgcactaatcgaaatttaaaaaaaaagattttgagtgaattttcgaagtgaatcttatcgcttcgcccccaaaatttggtttataaaattcttgaatttattttcctaatttgtaagcaaacaacaaaaacaaaaattcttctaaaaaattttgggggctttaaaaaatttctaaaaaataaaaaatttatttgcaagttaagcgacaacgaagcaaggcatgttggtcaaagacgcacaagtgaagccggacatttcgaagccgcgctgggaccagtcgacgttcagtggtcgcgcacggcacttcttcaccgtggtcaacccactgaaccttttggcatcgaacaaccaattggaaaacagtcgcaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtggccaaaaaggcattaaaaacag

SEQ ID NO: 39870 - DNA, 898 bp, Heterodera glycines
gtccattgtataaaaatactttccaagtttatcaaaatttcgaaagaaattctcatttaaaaaaagaaaagttcgcaaaaaaatggcgaaaatatttattaaaaatgccaaaataaccgacgaaaacttaaatttttcgtatttttggggttgtaattttttaaaatttccaaaaagtcgatctttaagggggttcgctttttttgcaaatgaaaatttgaattaataaataaaatacaaaaaaattaaattgaattaattttatgaataaaaattgaaattacaaaatttggcttcaaaattgaaagcacatctcaaaatttgaaattttatttaagatttagagaatatagacaaaattatcaaaattttaataaattaatttcggcggaccttaagcagaatttttaaaatttaattacacacaaaattttttttaaatatatttcaatccaaatggaagaggaaacttcagtacaatttgtcgtaattttattcgttaaaattaaaattttgcctttgatttgcaggataattgcaccaaattggtcaattttcgtgttcattatctcttattgagttggatttcaatgataaattccataataattagaatttatacacagttcaaaataataaaaaaaataaaataatttcttcattaaaatgagtataatttatatttacaaaataaagtcataaaaataaattgatttctttggattttcttgatatttaatttcttggcccatctttcaattgcccaataattcacctcaaatatttgtttaatttttgctctaaattctttccattcttttcgtgaatgtttttacaattttgtataaattcattttttattttaaaatatttttcaacaatttctcttttttgctca

SEQ ID NO: 39871 - DNA, 327 bp, Heterodera glycines
caacaacaaaaaataaggctcgacagatgttaccataacacttaaggctgtttgttgccccaatgtcaacgaaccccacctcacccaaaaaaaaaattttttttttttttttgccattttgtggtcaaatctttcaaacaataataaaataatctgggtgtagtgatgccattatgcactgccgggaaaattttttggtttaatgaggaagatgttttaaattttcgaaaagatttgcccattttttcttgaaaaaaaaaattttttttttggagggggggtggggggcgttgacattggggcagaaaacagggttaggtgatctgg

SEQ ID NO: 39872 - DNA, 1349 bp, Heterodera glycines
  misc_feature (52)..(52): n is a, c, g, or t
  misc_feature (1330)..(1330): n is a, c, g, or t
aaatttgaaaaacattttcccaacaaatgtggatacaaactagggtcggacnccgcccccgtcacccccgcccccgccgggggcgggacaggttttttggcctcacccccgtccccgcccccgtgactctgacccccgccatcccccgcccccgtgaaaagccacccccgcccacggggtccgaaccctaatacaaaccacattagtaccgaataagttttatcatttaatgcatttttgaatccaatcaaactgaaaaacagacaaaattgaaaccggcaattatgaagaatggggttatattttattgaccaggtatacatataaagcacatagtgaataatacatacacacacaagaatggtagatacattgtataatacatacacatacagtaatgggggatacggggccaatcatcaacaatatacaggtgccttcatccgccggtcgtccaaaagttgagtgtgctcacagcgctgccatctgcatcatcgcaaattcgccacgacgcatctccgtccttctcatccgatcccgcacttttgcagcatagaacttggtcaccgttttctgagccttctggttcgcatctttggccatgacgtcaggcaggcacagtcggacagaaaactccatgtcgcgaagcgtgatggttttgcgccggtcgttgtgggccattcgcgtcgcctccgttgcaatgcggtccaaggcgtcgatgacgaagctagaaaatggttaaacgaatgaatattattgttgagctttcagcagagcaacccacgagttcatgatgttcaacgcacgcattgagatttccttgcccggatgaacttccttcagcacacgtcgaacgtacagctgaaataaggggacaattacaaaattatcatggcattttgctttcgttgtaaactgcaccttgtacgactgctttcgcggctccttctttcttcgtcggcgtgccatttttgtgcgatgttgctgagaatggcgctgttgttgaacgtgagcaaaactgtcggtttctgtaaaatgaaaaaaagtcaaacattgcaacaaaaaaaaaacacatgcctcagaaattacgagtgaacagttggtggtgttggcaaaagtgaatgtgaatgaagcaggttgcttttatatacactttaggcgcgcagttaaaatccaaaaatcgcatccctactaataaatgaaaaattttctcaaaaatttgtctccaaaatttattaattttcttggcaaattttgattttaaaaaataatataactacgatttggcataagtttgttcacttaggaagtttgtcattttacacccctnaaatttgatgtttatttgt

SEQ ID NO: 39873 - DNA, 421 bp, Heterodera glycines
tgtccgaaagcgggggggggggcatttggcgcattgttgttgttgctgaacatcggacggaccaaccaataaaatggggcttaaacatgacgacagcccggggaattccgggacattcattcatattttgaatgatccaagcagaatagttgtttaactttatatgcacatattgtgtaaagtccaaacttttttttccatggaaaaggtaaaggttaaaaggaaaaagtcgttggaagtgcaaaaaagcaaagggacggacggacggagaatgaatcggcgggggggggaggacatagtcataagaaaaggtcaagtaagtgccttttagagggacggacggaatgggcggaggagagggcaaattggctgagttgagagggaggggggggggagggagtgtgaatgatgaaaggagggg

SEQ ID NO: 39874 - DNA, 795 bp, Heterodera glycines
ttgtacctcttctaatctctgttgtacctcttccaatcacagttgtacctcttctgatctctggtgtacctcttctaatcactgttgtacctcttctaatcactgttgtatctcttctaatcactgttttacctttcttaatctctgttgtacctcttctaatcactgttgtacctcttctaatcactgttttacctttcttaatctctgttgtacctctttttatcactattgtacctcttctgatctctggtgtacctcttctaatcactgttgtacctcttctaatcactgttgtatctcttctaatcactgttttacctcttttaattacttttgtacctctactaatcactgttgtaactcttctgatcaattttgtacctcttctaatcatttttgtaactcttctaatcaccattgtacctcttctcatcactgttgtaccttttctaatcattgttgtacctcttctaatcactgttgtagctcttctaatcactgttgtagctcttctagggcgcgaaacgcccgtctgagcccaacaaaatttaaaaagggaaacgaagcgccctttacctctatttgatcaatcccaaattgcttcggatccaacaattactccacaacccataaatatcgggcgcgaagcgcccgtccgactcaacacaatttaaaaaacggccgcgaagcagccgaaaagaacaacaaaaattagaaacgggcgcgaagcgcccgttcgaggacgcgaagggcgcgaagtcgatgttgactaaaaactcataataatttttt

SEQ ID NO: 39875 - DNA, 1212 bp, Heterodera glycines
aatgagttaactccaggagccccaaacaacatccacatctataacacccattccgatcaaaactattatacacccgacccttttaaacggtctttttaggtacgtaaaggaaaacaaagatttatttaaaattacggcggctggaaaggtccaatcgaacatgaatttgccgattgaaaacagtaattatagagatgttttgttgtatctcgcagggaagaaagatgaaacgccgcgcggtgcaaaatttctcaaagatcggttactgtaggatccaacagtaaaagacatggttgataaatcaaaggtcatgtggggacgtggaaggaaaagggcaataaaatctataaaaacacccggcatagtgcgagagaagaaacccttcaaaccactaatatgggccagactgtagagaaaattttatcaaaaatttattttaatttaaaatctccggcaagttttgctggaattcaaaaaattttaaatgaggccaaaaagattgacccgaaaattacgaccgatgacgttaataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattttcaaagggatacctc

SEQ ID NO: 39876 - DNA, 1144 bp, Heterodera glycines
aaaaaaaaattctggcggcgagattgccaaaaaacaaggcgcggcgagttgggcccgcggcgagatggccaaaaaacaaggcgcggcgagttgggcccgcggcgagatggccaaaaaacaaggcgcggcgagttgggcccgcggtgagatggccgcggcgaagtgaccccgaccagggttgttccgggtcgagaaaaatatcgggtcgggtttcgggtcgggtcggccgaaaaatcatcgatcgggtcgggtttcgggtcgagaaaccgggtttcgggtatcgggtttcgggtcaattgacaaatttttaatttgtttaaaaatcaaatggcactacaatatttgcagcgaattacgccatttataggacgatggaaataaaaccaaatggaatcaggtttttcagccatctgctttgcttaaattcaagaaattcatacaaaatatctttagaaaaaggataataattagagttgagcggtaatcggtaattgtaaaaaaaccggtaccaactttttccaccggtaccggtaaaaaccggtaattttccaacgtaaaaatttttggacaaaatttttcaaatacaaaatttttattcagttttcgcgcgagtacctgttttagcattagaattgttcagaagtatatgtatattgagggtgaccaagtttttttttcaaattcaggataaataacactaaaattcagatgtagacctcaaaattcagattattgcaaaacaagggatcagcggccaatttttcaattttgcgaaggggtctccggccatgtaaattaatgtaaatcaatgaccttttttgctttcaacaccgctttttacgcggcacgttttttccaagacttttgggggacaaggagggccggcggtgccgataggcgccggcgggaaaaattttgtattttttaatgcgatttgttaacagaatttgtaaaaaaagaccaattgattaatttttggatttttaggatgcttaaaatgaaagaaaaaaagttggaatatttttttttaattaaaatttcaatttaaataatggtaaagaaaatatgaagaatattctatcctagtggggaattgaacccaagcgagaaataataaaatcagaagggttagtcagcatttggg

SEQ ID NO: 39877 - DNA, 946 bp, Heterodera glycines
  misc_feature (67)..(67): n is a, c, g, or t
  misc_feature (85)..(85): n is a, c, g, or t
  misc_feature (914)..(914): n is a, c, g, or t
atgcagtgtaaaattttttcggcttctcgcgcaaagttttttctggactgtttctgacagattgtgnagatatttttctagatgnttgttcatatctcaattcattatttatcgcttttaaattgaatggaaatgaattgtcagtaacaaaaaaaatattttgtgaacatttataacaaaaattttttaagcattttctaaagaggctttttgacttcaatcataattatattgtcaattgtttgaaacgcatctgttgcagttggaagaggccgatggaaaatttttcggcttttcgcgaaaaagttttcccagaaaatggcgtgggacaaataaaaattgtacttttattatgagcaatatatatttcctatcaatttcaggtttgctttagacgtttgccaatgaaaaaatggagttttgtgaatgcaaattttaatggattttctttcgacgtgtcataagcgggttgtttcgggacaaatgcaaaccaatttgatgctattcgaatgagctaggcgcgctctaccctttcaaatgtatcaacaaagggtctaccgccactccctggcgagatatggccagtcaaagcagagtgggtctaataaaacaagaatttttaaaattttcggcatttgcccttatttcgagcctgctctacgtgtgcttcttttgccaatatggccctgctatagaaatcttgtaatggttcacgactaagtgatgaaatatttttagcccatttcttttctatccaagcatgcgaattgtttattgcattttatgcattttatagccttctggaaaaagatagtcagtaaaaataaagcttgttttaggaatatttgagtatatttacaacaacaatttttgggcaatttctaaagatgaaggaaaataatttttttatcaantattttatattaagttatgtttttggacctgc

SEQ ID NO: 39878 - DNA, 588 bp, Heterodera glycines
aatataacagttcgacgctgattaaaaccaatgttttaaatatatttaaaaaataataaaacatatttaaaaatatataatcaaatatctttggcaattcactgactaactcataagaaatataaaagaaaaattcacctgaactgatgctaccgtgcaggcggaaagaaaatgatagcataaaaatattgctacttaatttttttaatgaatttactgaaaattttacaaaaaattcttaataaatgggtaaatatattaatcgtggttaaacatttaatttttcaaattaaaaaatttataaattttattacgagtcatataacataataaaaaagtatacctaaaatcaatgtgaaagtcaatagctttattaagacaattcttttaaattgtctatatttaagtacaccattaatatgcctatattattgtcaataaaatatttgtgttaaaacatagtcacaagaataaaattaaaccatgctctttttacgtgagattaaaaacttaataacaaaaaccaaaagatgaaaaaataattaacaccgatttaattaaaatgaaagccaatctaatctttggtaa

SEQ ID NO: 39879 - DNA, 876 bp, Heterodera glycines
aattccttttggcataaattacacagattttgtctaaagaattaccaaatttagagatttttggctaaaattttttaagaaaaaataggtttttggagggccggcggtgcctataggccgcctggcagattttgaaatttaagctcgatttctaacagatgtttacaaaaaaaaaaaattacgataaatttttgtttttttaatatattaaattatcatgatttactcaagcaaaattggaactcagatttgtaacatattttcttgtggcacatttttccaaaaaaaaaaaaaaacttggtgaatgtgcgagcgtagaggtccggcggtgccgataggcgccgccgggaaaattttttgaaaactgatggatctgttaatagattttgtccaaaaaatgataggtttttgcaatttttagagaaatttcgcgattttatatccatatttttggatgccctaatgataacctagatggtgatgcatagaaatatgtgagtgatcgggtcccgcgcaggattttttgggattcaaactgtaatcccgatttttcggaaatcgtggaattttgtttggagctgttgtattattaccgctcaccgggtacagtctcaggatatacgacataggggatagtacccagccccccggcgacgaacgttttttttttaaactaatttttacgacgaaaaattccttgagaaagaaaaggtccgacaaaaaaatattgccaataaaaaccataaatcgcccaatcaaaacaattcaaatgaccttaaatggaccaagcggatagcgatttatcataaggaaacgttcaatcagcggaatttcaacgcaattggtcagatgcttagcgcatttggacaacaacat

SEQ ID NO: 39880 - DNA, 926 bp, Heterodera glycines
gaatagcttccctatagcctgtactttaattcgtgccttcccacctttgctccccataattgtttgagtaccccaaacgctctcttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccgtcggggagtagcttccctatagcctgtactttaattctgcgttggatttttgctccccataattgtttgagtaccccatacggacactcgaaaaaatcgatttttttt

SEQ ID NO: 39881 - DNA, 170 bp, Heterodera glycines
ataaagcatgcgatggctgcaggggcgatggcatattcaattaaaattgccgtgcctgtgagatagccgccaaatggaccaaatgcggtacgcgcaaagctatagccacctcccgcagtgggcagcatggtggccatttcagacatagacaggcacatacataagtacat

SEQ ID NO: 39882 - DNA, 766 bp, Heterodera glycines
gagagggagatgcaagagagaggggagagagagagagagagagagagaggagagagagagaggagagagagagagagaggagagaaaatgggggggggagggagggaggcagtcacaccaaaaggtatgataaaacaaattttccaagaaaaaattcgatatatttagtcttttattagagtctccgtctttatagacttttacctaaagagacaagattactaaattctaatgagctcgccaaacttcttgattgtttctgtacactctttttttacaaaaggaacaaataaaagatttttcttgaaaaaatcaaattgtcaaaaagaaacaacaacaaaaacatgagatgaggaacggaagaagtgggcaccggcggtcagttgacttccatttgcaattcgccctcctccgtcttttgctctccgtcttcgaccacctccaatttctcgtcgtcctcgcccatggcaactggcgccctaaaatgccattgtttaccatggcattcattcccatcattcccaggatgttttcacccccccccccccccacttgccttatcaaatgcactttcttgcgcgccttctccaccattgccctcttcaccgcttgttttcccggcttcagagtgctttttatgtgctctccgtaccgacggtgtcgaatgctgtgaatttcctttattgcctcaactgaaatttttgggaaaaaattattacaaagaaacgtgaactttttaagtgacaaatttctattttgcaaaaat

SEQ ID NO: 39883 - DNA, 1219 bp, Heterodera glycines
  misc_feature (53)..(53): n is a, c, g, or t
  misc_feature (160)..(160): n is a, c, g, or t
gaaagtgttcagtggatggtgtatttccaaatgaaatttgtggaggggaccanaccccctggtttttaggttgagttctaatccgtgccattccaattaattttagttttttatttatgtctttagacaaattaaagtcaaaaaatacaaaaaaattgtntagtttctacacttgaaaataactaattttgaaattatgatttaaatttattccgcagttaggaaaatttgttttgtaatataacccagggatggtctgtctacccacctacaaaatttcattgaaaatccaccatcaccttaacactctcatttgttaatgaaaattaaaatttagtttgccaatatggtaaaagaaacttgttaatttacatcactaatcaaagaagtttataattaaaaaaattatttttctttttactttttttgcttttatttcatttctgcacattggacatattcggtgtttctcaaacctatcaatgcataattatgagctcattactttattatcaacacaaaccatttaaagatgcagctttcatgaaacacatgcttaatcaatgcttatttaattattcaattttaatttcaattctttactggctttgtctgttgccgctcattcttatgtatcatgacgaacttttcttcttcatcaaattcatttaaacaaacggcgcattcgtccgcattttccaattcatttttgctcacatattcaaactcaaacagttccattaccattttgtatgttaaggcgtactttgttatttgcctttggaagtcaaccgccattttcacatcgacaattcgttgctaaaatattttagagttttatagaattttcgtgatttaagttaattattttaatacaaaatgttcacatacgcctgggattatcggggaatatccgatgaaatcggcgcccctttcctcgtcgctttgttcgtttcctcgctgtccggatccctctgcaaataaaatggcaaaatttgttcggtttgacattttccaaagataaaattccctcttttctgaatgtggccaaaatggtccaatttttgcagattgattgtgtaaaacttttcaaagattgggtagcgcaaaatgaggtctctgaaacggacgaaggaaagattatcatttgcaccatctgatgaggaaaaaaccaaaaatttatatattgtaaatttcatttaaattcttttcttttacc

SEQ ID NO: 39884 - DNA, 851 bp, Heterodera glycines
aaaaattaatttaatattctttgcgtttttttgtaccctttatgaaaattgtgcattttacaaaagcttttttacgataaaatgaggtaaatgaacacgaggagctaaaataataaatgcatcgattttttcgtattttcaaataaaacttacgaaaaaattttttgattaaatgtaattagaaaaaaaaacctctcaccataaatttccgaaaatttggccactcctttcccaggtccgttgtcagaaaaaagattaggaggaaaaccaagacagaccttttttgctctccgcgctaaaaattttttctatttttttttttgaaattttccgtcaaagaaaaaacttaaattttccattttcgagcaaattttggggtgcgcgtggtaattctctcccccaccccttggctacgagcctgtcccccccccccctcccacaaaaataaaatatttcgtttcaaataaatttaaatcaatcacattttctttcgtttctttgagcagccacttgatttcaattcattttcatcacaaggaattgatgaaaagcatctattaaatattaattacttatttaataataattaattatttattatttaataaaattgcttactttgtttgtgggtcatcttcactttgtgggttattatcttaataaataaattaatattttaatatacgagaaaggcatcttctttttttgattttgaaagccaaacggttaatggtttataatgccttaaatttaaacagtaaactaaaaatcccgcagaaaaccttttatatttttccgttttttatttccaaattattgatatttgctgctttttttcttttttactttgc

SEQ ID NO: 39885 - DNA, 1243 bp, Heterodera glycines
  misc_feature (34)..(34): n is a, c, g, or t
atatattttttaaatgaattaaaatgtgctacantttgcaaaattaaattaattttattaagatttaatttaaagttagtctaatttctattaaatttaatccaagtattacattttttaattttaataaaattaatagaatttatattgcgctagaataataacttttctatagtcttctttaaacattgtttttgattatccttttctgtgtcttctcataataaatatttatttaattttttttttgaataaaatactttaaattaatttcacttttttagatttattttacaatactttcttatcttttatataaatcaatttcttttttattttccaaacatttttcgtaatgtaatgattctaattctttatcaatcagaaaaataaaatttttaattactgttttattaaaatgtattttaaataatattttttacgtttaattttttttaatttacgtgttaactaagttttttatttattttctcttgtcgtcgtatagctcttcctttctcgcggtttccgctttcttgaattgttttaattactgtttatatagaattaaaattaattattttttaaatttattgcaaaatttatatttatatttatatttaataaaatttgtaattagaataaattaatttattaattggataataattactattattgatattttataaattgttctctttctcttcattttccttgtgctgtttacataataaattagattaattaattacagaaaatagtttattaaatgtcccaatgttctcctttttgtttaagttttagttattttatttaatgaaatatataattatttttgatttttaagtaattattttatccgtttacttgcaattactacgtgatattttttagttcaaaataatgtttaattaattcttgtttttgttcgtatgtatctgttttattttttttaaataaaattgaattcataataattatttgatataataatgataattttaatatattaccaaataattttcggtttattcaataaattgtgcaattttttaaataattaattaaattttaatttttgtcaatgttaattcaatgttgtaaaatttttaatatattttatcatgagatgatacagttgcagttaaacacgagagcatcagctgagttaaagcgattttgttatttattctttttgttttttataatttcgttgtcatttacatatttttgttatgtt

SEQ ID NO: 39886 - DNA, 1277 bp, Heterodera glycines
aaaaatgaaaatttgaaatcatgttcccactcccttctcccaggggtatattttgtaagtctttttccccaataaacttttaaaccccattttcgcaccgtgaatgttatttttattgaattctgaaccgttttgagtagattagactagaaaaaattgaaaattttgaaatcatgtttcccactcccttctcgcaggggtattattttgtaaagtcttttttccccaataaacttgtcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtcttttttttccccaataaacttttcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaactttttaaaccccatttttcgcaccgtgaatgttatttttattgaattctgaaccgtttttgagtagattagactagaaaaaattgaaaattttgaaatcatgtttcccactcccttctcccagggggattattttgtaaagtcttttttcccccaataaacttgtcaaaccccatttttcgcaccgtgaatgttatttttattgaattctgaaccgttttgagtagattagactagaaaaaattaaaaattttgaaatcatgtttcccactcccttctcccaggggtattattttgtaaagtctttttttccaaaaaaaattttcaaacccctttttccgcaccgggaatggtattttttattgaaattttgaaacccttttgaataaaaaaaactaaaaaaaa

SEQ ID NO: 39887 - DNA, 910 bp, Heterodera glycines
  misc_feature (907)..(907): n is a, c, g, or t
cgacagatcttatcgatcgccagctgtttttgtttttcccacgctttttgctagtgatagtccaattaagttttttcctctgtgccccgccctcacattttcggcctataaaaagggcacccttttcattaaatgctcacttccacatttccattcattcatttctgctgctgcttaataaatatatatttgtgaaaggagtccgggggatttggtcgggacggttttcccctcccccttctgctgctcagcgtctgcgtcgtcgtccgcccagcgtcggtcttccccgcaggagtctctcactcctgcgggccttcgcttccaccggctcgtccgtcccttcccccacatttgggaaggcacggccgagaaagggaaagggggaagcaaccagctgactttgcctttggcaaagtcggctctcgcctccctcgctccccacaaaagtttttgtcgcctccttggctgcgacaaaaagcaatgaattaaaaaatattagataaaagcaattaattataataattagaaaaggcaattaattatgataataattagataaaggcaatgaattaaaaaataattagataaaagcaattaattataataattagacattataataatatgataaaggtaattaattataataattagataaaggcattaattataataattagtcttgattaagaaaataagaaaaaaattaaatcaaaattaatttagctacaccaagtagagcgaacttgaaaagatctcagtcaacggctgttcgaccagaaccgtgtaatttttaaaacatttaaaatttaattatctccacggagacctctgatttttcaataatttttcacaaatttatttaaatttaagcaattttcttaacaaattgcaataagaatctcanaaa

SEQ ID NO: 39888 - DNA, 1237 bp, Heterodera glycines
  misc_feature (6)..(6): n is a, c, g, or t
ttattntgttgcaaaaatgtacttttaaacaaattaaatcatatagtttttaattggctgatctatttatattatagaatacattttttattataaaaaacttattttttcatcgttttatatagcacatttctaaatttttatgctaatgaatatattttagatgttaatcaaatttgcattttttaaaatcaaatgagaatcaactaaattttagtagtgttaaattttaaatatattattttacctaaaacaaaaattttttgatgaataatcattgttttgttaacttatttattaattgtcattccaatatcaagtgacaaataattattattaggttttttcttctatttttaaataaactaattatttgtttatttgggtcttttacaattaccaattgtcaaattcttcatgttcgtggaaaagtatcattttcaggaaatgatctcgcgacatgcgaaatttcatttcaaatataatgatttaaaaatattttattgttaatatacaaatatactgctctttgggtttgcctaaattgagtttaaattatttaggtttagttagcttattaattttgttgtttctgttgataatattattatttttgttatgaatttgtttaaattttcagtcccaattttatttttcccatagtttaattgattttagtattatcagtattctgtttaattaactttttggaattttgtcacatttaaatatttgttttttgatttaattcattaatttatttatcatttctcttctgttatttgcctcactgtttagcttattatatttggattatttaagtattatttatttatttaataattttatatcatttttcacctcctataccctaattctcgtagttcgttttcatttcgcttacagagtgatgaaagttataacaccaattttaaaatattttttgaaaatatgaaaagctaaaattttataaaaatccggttattagaagcggacccggtttaaagatcaggaggacccacctagaaataaccgctccatgttttgtctaaatgcctgaacccgtgcgatcctcgttttcagtgccttcgacttcaaattaaaattttggaaagttaaaaattattaattccgactttgatttattggcgtgtgctttaaattgttttatcaattataatgtaatttattataggtgtttttgatttttattattttttaaaatcttgatatgact

SEQ ID NO: 39889 - DNA, 894 bp, Heterodera glycines
tcgcaattgtttcacctcctccaatggatgcacaacctgttgagttaccaccagccctaacaaattgggttaaatgaacaataaaatgttttataattgaataaaatacttttcaatgccatgggacaatacaaaataatgctattataagggagtctaattaaacatcaaataacaaaaaatatactttagcttaaaatgaagcttttatgattttgttttctatccatatttttccgtttaattggtccatattcaagtgtaggagcctcaaaatgtaaatgccaaaaatctcagtgtcgggcgttcaaatgtcaaatcttcaaataccaacccatatcctctatccatactgtacccgttgcttgcgagacgtgcatccggcttgttgttctccggacatccaccctctccatccttacggcaatttttgcacccttgcggacagtccctggcatacagtttatcgcaacagtagtagcagctgcacgacacatctatgtcacaatagtccacggagtgatccttgtgtttgagatcaaacgcgcagaccacacagttattgccgaaaatgttgcaatttcctggatgcactggcagcatacaactaaaaaaaattaaccagttttcgttgaaaatttttcttttcctgggggtcgcggcttattggggaccgcccactttggcgcctgccattttgggccaaacattaaagcataaataaatggcctctgctggtgtaattttagaacgcttaatagtctttattacgggcccttttgtagaaccgggctctcgcaaagtgtcagtggaaatgcgtcagtgataaagtatttttagaactatagtattttgtgtatgttgtactgtaatataaaaatttaaaattgtcta

SEQ ID NO: 39890 - DNA, 717 bp, Heterodera glycines
cccgggcccggtccaaaattttagccggacgcccgccgggcgcgggctttttttaaaatttgtgggattttgattaataaaattaaaaaattgttttagcgaaaatacaaatttaaaaaaattcgaaattgcatatataaatttgaaaatcagttttcctacaagtgtctaaaaaagttccttacaaagggtatttccgaatgaaacttggtgcgtgtttttaatgccaattctaaatttttacacaaaaacaatttaacgctccaatggtgccaatcccaatttctttctcagtgcgttattctcctcaatttctctttcggtgtctttcgcggcacttcgtcctccccgacggtctaaatccaattggcaatttgtccttagggttgatttgataccatccgtggaaagtgatcggcgtctccgttctctcgatttgctccgacttcggccacggctgcgcgagcgacttcggcgccgagaaacgatctgtcatttagttacaattagtcgtcccaaaaaaaggctctcgattctcacatttggccgtgctttccgcgtctcctgctcatcttcggagtcggtggaaagacgctctaagtcttcgtccaaggcggaagcgtacaactcgagttggtccttttcttcgagtgcttgccgtttcttaaaattgtgattatgcaaaattgctttattttattttatttcgtgaaaatt

SEQ ID NO: 39891 - DNA, 1662 bp, Heterodera glycines
aaacattaagaataaataaaactgtaatgagcttcgttcattaggtttgaatttctgcaaattccaaagttttaaatctaaaatattcattttattaaaataaaatatgctttaattacaatttgctgaggttttttgtcgctgaaaaaaatgatcgcataaaaaattttttggaagaattttggccataaattgggaccaaatcagcgacacgatgaaagttttgagcatttaagcgaagaccaacaagccaataacagcaaaaagcagatttgctaaaaacatttgtgttaatagtattaaaaaattaaaaggggaatgaatttttgatcacttctacaactaaaagataaattggcatttttttaataaattcatcggcgcctaatagctaggcatctgcgaaccataattttaaaaggtttttctcatttctttcttaaaatttgagattttttgagattaaccacgacaaaaagcacaaaactaatataaatttacaaaatttaaaattaagaaattttacactaattatgtatttcccaaagattaaaattacctaaatattttgcagcgtactttttcctccaattcggcatttaattggtaatggtccaatttgtcggcaacattttccctttttgcccattcaaataatttatttcgaattttactccgttgaaatgcacaattttcagtgaaattgtcgaactgagaagtcagacccacaatgaccgcgaagtttttaaacttttcttcaattttaacctcattaaaaagtgtttgccagtttttctgatgttcggacagaattttattacctaaaatcttttaatttttaaaattagtaaaaaaaaatttctaaaccaagtgccaattcttcgacaattgtcttaagcgtgaatttgttcacgttgaatgttgtgttttgttcgggaaagtttggcgtaattattgtcattggattttgcccaatcaatgggggccaacggaaaacaattttattctttgtgattggagttaattcattaagcataatcggaacacgggcccaatccctaaattaggcaattttaatttaatattccaaattttaattttaatttattaccattttgagtaaatcgagaaaaattggtgcaataaatatgacaaaggcgcatttggaaagagcagacaaattttggatgccataattgaaaaagaaatgccattaaaataaccaaaaatgcccgaataaatgaggcgagctgaaaaaatatatatatcaaatttcgcataaaaattattattttttataaaattattatttaaattgaactaataattttagtagtatttaaccgactttttgcccaaactttgacgattttcaataaattcacaaatgcatttttgtccggcaaaattgagagttgaaaatgtgccgattgataacctaaattttgaattttcatttaaaattattattttttgttcacccgccaacgaataaatgccagattcgtatttaatttcctcaatgattttttcccgtgataaatcaccgccgtcattttgttccaaatatttttctggcactggcacaaaagacagatcaatttcgaaactttcaagctcaattctaagcagctgaatccttcccgaaatgccaattgactt

SEQ ID NO: 39892 - DNA, 620 bp, Heterodera glycines
cgaaacttttttgaactcatttcattcataattaagaaacataaaactttaaaattgtatactcaaactgatagattggagatcctagtacataggtggaaaagcatataatggctctagtacatgtgtgtgtgattgaaaatttttcaaaaaaagaacatcaaacccaaatattcgcgttaaataaatcagatttttaacaatttatgaaaaaatcggtaaaataattgttagcggttctctcaggtcctttatcccactttctcccacaatccgttccttctggcatcacaaacgactttgaccaaaaatgctaaattcgaaaattcgaaaatttggacttttttgattttttattcaaattttggtccgtggttcagaaattagaacaatgttcttatagaattatacttttacaaaaagctacagaactttattttaaaatatttgtatcaatgacgcattttccggtcacgatcacatttgcaccttgcaaatgtgctttttttcttttaaatataaaaatttattttttctattcccaaaattttttaaattttgtttttaattatgtcaaaatggcagtcaaaagttttcaaaatcataaaaaattatattat

SEQ ID NO: 39893 - DNA, 172 bp, Heterodera glycines
gctatttccgaaacttcagcccgagcatacttattttgtcttgatcaaattgagtttgtgggccgcctcttaggataaggcaatttaggccctgattgggggtgctgttgcccaagccttggagaccagacagacatctggggcacagaagtagtggcagttgttttaggga

SEQ ID NO: 39894 - DNA, 776 bp, Heterodera glycines
aaacaatctttcgatatagggtacgcaaacaaaaaaaaatctaatccaaaaaatgtctatctcttttttctcatcttttcaccgcaaacttggtaccatcagttgccttctctagtaagaccctatcaaacattcttgcgatattggaaacccaaacaaaaaaaattctcgcccaaaaaatagctatctcttaagtgtcatgttttttcggcaaacgtggtaacaacagttgagttctcttgtgtggccctatcaacacaatcttacgatagggggggggggggaaggatgccaaaacggcacttcgtttgctgtgccgtcgtagtcggctgcttttgcagtgatttggtggtggtggttcggctcctcttgtgtcgttttgcccctccacaagtgtttacaaagggaagggaccaaaaagaggaagcaaaagcagcagcagaggaagagggggacgagagggaggttaagcgggacgaagggatgaacccctccctcccgcaccgacggcacggcgcccttctcgcgggacccgtctctctccccccccccccctctcattggcacccgcttgaagggggaaaaagcatgaggaagttggaggagaagcaaagtgccaacaaggaaaggaagtaagaggaaattggaaggagcagaaaaagaggatgaaaaaggaggaaaagcaacagtgacacaatgaaaggggaggagaagaaggtgatgccaaaggggaaatatgtaaaaagtgaatttggaggtgccacagggttttatgt

SEQ ID NO: 39895 - DNA, 1047 bp, Heterodera glycines
  misc_feature (1013)..(1013): n is a, c, g, or t
ttgtataccatctcaaaattcaatgatggaagtgtctcttctcggcactttaactttttcacttctttttaatagcaagttgaggagatgtttggccaacattttggcgccctgttcggcgcctccgatctgagcccatccgctgctgaggacaaacaacaggcggtgccgtcctccggcgctgagctagcgccggctggcgcagagaacggcacggcgccggaggcgccaaaaacgccgagcttctgcactctgttggtttgagatggcgagagagaaaaagaaagaaaagcgaaagggcagacagagaaaccaaaggacaaagaaatcaataaaatcgatcaaacaatcgatgaattaatcgataatcaaccctattttaccgtaatcatgcacatttttcaacacgacaaatccatcaccatcatttgacataattcatttattcattcaaatttgcatcttgttctttttgaataataaaaaaaagctttcaaattttttaattgaaatttgcaaaataggtcttgaaaaccataaaaaactccttttcgtcaattaattataattagaattctaaatttttgtattcctttctcattcacttagcaactgacaattggggttgggggctcccattccaatttgattgcttacacggaagtagtggtcgcattgagaaagcctaaaaatagctggtaacttttcggggttcgctgatcagtgatcacgaatccggcatccacacatttcgacccattatgaaccaacactgcacccgaattcgaacaaaacgtggatgaagcgatttgccaattcgtactgcctcggttcgtacgttcatcatgtgttataaaatatatgaaccccattggcatagtgggcggcggatgatccggcaattgaaattataaaacaattcgtacaaatgtttcaaaaaatgtcgttaaggttgaacaaagttatggccaaaagtacacaaggaaccaaattttcaaatatttttggccaanaattttttcgaaactaacgaacttttttgaaatt

SEQ ID NO: 39896 - DNA, 1273 bp, Heterodera glycines
agtgaaataatggaatgaatagtgattaggatgtacaaaattgaatgaatgaatcacatttttgttcctcatctgccgctgactgacatttgtacacatacatacgcgaaattcaatagatttgctcgatttaaagcgatcaaaagatcgaaattgaaaaaatatccaaatctttttagaattttcattttttcatacaattttttctaagtctaatcctattcaattgagtgagcttaatactacttttttataagtttttctcacttttttagtttttttctttcgtaaatccgttaatcataaaattaattatcatttgactttttcatactcctttttgtcatattcttgaaccgcatgtcactcactataaacaaaaaagtcattaaatttgtttcgtaattgcctttttgccaattaggcaaacagttttctcttcatttgtacgcacgcaattctctccctctctttcctaatccaaatgagtgagcatgaaattttgtcaaaatgggatttccaagtcccaaattgggcacagagtaaaggttagtcaacacgaaaactcttcatccattaaagaattttatttttcattctctcatttttaaacggactcattaattggatttattttaatttatttccatcaatgacttttcatatttttgcctttctccttaatttccatttttttaacttatttattttcaccgtcgcccatgctttttacaatatataattgtcatgtatttgcgctaattgcttcaaattgtcctccacgttacagcgtaaaagtgtctataccacaccctaattgccttaatcaccactaatattaccttttgtatacatatcatattaactaatacacaccgatcgtcacacgcattacctaccgtacatcgccgcctttacagtttgacacacacattcattgttttgcgtcatattattgtgtactgtagtcgccgctcacacgctttgcgcgaaatgtgctgtggtgtgccgttgtgatgtatcgaaaccctttacaaaacagcagcagcttcagcgggggcaacacagaaaacagaacagcagcagcactgaacacggcgattggtccaggaaattgtatgtggtcgtgtccaatcattgcccaatcatccaaccctaattaatggttcactcatgccggggggaaaatgaaattatttattttttcaattaacattttttctttttttccgaatttgtccataccaccaaaacaaacgggggaaattttttt

SEQ ID NO: 39897 - DNA, 779 bp, Heterodera glycines
ggggcgaaggcccaccacgaggccgcgaagaggccgagtgagtaccttcggtgcaggaaaattattaaggaagagagttcattatttatttgttttttgcaaaattaattcttaaatatttttcagaaagggttctgaaacgcaccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaaatttttaaaaatttttaattcctttttaaacaggccaaaaagtttaggcttaacttttt

SEQ ID NO: 39898 - DNA, 1078 bp, Heterodera glycines
  misc_feature (36)..(36): n is a, c, g, or t
  misc_feature (40)..(40): n is a, c, g, or t
  misc_feature (58)..(58): n is a, c, g, or t
ggagaagagccggacgagtccaagctgtacatccancagnccggcaggtgtgaccatntggtgttggttcaaatggtggtccatcgacggacgatggtggtgggagaccatcgaagagcacgatttggtggatgacgactgcgaggatgaggaggaggacaccgtggccagaaacgggggcaactccatgctgcacgagggtaccggtggtggtaattgcaaagcgtgatggcactttcacaatgaatgcgttggatcgatgtgctttcgctgttaatgtccccgggggataaatggcgcccacggcgatgacacgcacaacgtcggctgttcgtagagcgaaatgcgccgccgacagcagctgtcttcgctcggccttatcgtaatccgcgccgcgcagtcagagggccttcccccccccccccgctttgattgcccgagggccaaatgcttaaagaccttttggtggctcaggcaccatacgctcgcgcacaacgcaaccgccgttttggaattagcgacaacaaacggaagggttggcatgggaaccaaagtcttaacggaaatggcagaccgcagcaagcaaatttaattggtgaaaaagtttaattggaaggtcgatttagggtgaggaaattgttgaagcaaatggcaaattgagtgtcaaataaaaagcatttgttttttcattaattaaacctaattggtgcaattgcccttttaaccctttcccttgaattgccccccccttctcccactctttcccacctgctgctgttgttgttgttgttgttgttgttgttgatagtaaacgttctgttgtcccccatattccgcgctgttccgctggtgtccccctgcattgttgtgctgctcgaattcgccatttgtcactgccgccgctgcgtaagcgttctgctgctgtctgaacaacgacggattattctgctgcagctgatggtgaggctcaaagttcgacgggtgcggcgccggtggcaattccaaccagcaccaatcgggcgaaaggtccgccgctgtggaagcggacgaaaacgggcacggcggactgtcgccgcca

SEQ ID NO: 39899 - DNA, 1561 bp, Heterodera glycines
tttttagtccatttattttctgtaatcattcatatattttgtcacttaatttctgtatacctatataaattgtgagctaaatgaaacggtgccatgacgttcttcaaaaaaccatcaaatgaaaatttttttgatataactttgctcaaaagtttttattaatttcattcgatagccttaattgttttctattatcctgcaaaatttctaaaaagttttgttaagtttcaagaatgttatgaccaaaaatgttcaaaaaaaacatcgtttttttagttactcagttcataacttttttggaacttaatcaacttttttgaaatattgaaggataatagaaagcacttgggctatctatcgaatgatatcaagattataaaaatttgattcatttgaggtgaagttatgattaattttctgtccaaaattttccatttgattgttttttgactaacgtcccagcaccaatgaaacagacaaaaaattattcatctacatatatactcgaaaaaagttaaatctcgtttttttctcattgtaattttattgttgatgtcagtaattgctcttttttgtatttatgaattcccggactttaagcattcgtttgataccaaaaatataggtgttgaccaagaatggataaatcataaacaaaataaatacatttttcaaattgttttttgcctattagaaatgactgaatgattaattggatggcaaaaattgcagacatccggtcgtcctaaaattgccaaaaatgacaatttttgcctagaaaaaaaggtaaaagtgaaaagtacaaattctaattttctagcctttttttaaattacgtacaataaataaaccaatgttcatagtataaaaaaaatgctcattaaaatcgttcagccaagcatttacagcaaccaaatttttcgaaatctgtcctttaacgctaactttcaattagttggcatgcttgtgagagagagagtacgcggcgctacttaaaaagtgccatataaaaatatttttttttattacattttttctttttccgattttttattgctgcacaaaatgcttggccttctaaaatagtttaaatatcttttttaattcttaattttttgctttttgttaaccttttttccgttcaattgtcccaaaatgccaatttttgtagtctttttttggttttccacgattgggtctttgcttgactcaacacgtctcgtccaactccatcacatcattgagaccgaaaagcattaaactatttcaaaggtgccaaaataagattaaagaatgtgtaaataaaaaaataatactttttttgacgcgacacttgcttttcaacaaaattacggagtgactaagcacctgaataaattttaatttccataaaagctttggtttcaaaattaatggctgattccaacaacatttcggtaaattatagggaaaataattttcttaatttgggttttcagttttatttgtcattcaaagatgtaaatcccaactggccgctgatcagctggtcgtttgtcatggaagcatcgccgtatttgga

SEQ ID NO: 39900 - DNA, 559 bp, Heterodera glycines
  misc_feature (5)..(5): n is a, c, g, or t
tcccncataattggtttgagtaccccaaacggacactttcttcctggatttatttttgttttcggggcagtccccccgaccctatgcgcccagatttatggggagaccgaatctttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtcccccccgaaccgatgcgcccagatttatggggagaccgaatccttcgggagtagcttccctatagccctgtacttaatttctgcgtggaatttttgctcccccataattgtttgagtaaccccaaacggacacttgaaaaaatccatttttttggtt

SEQ ID NO: 39901 - DNA, 428 bp, Heterodera glycines
cacttaagtgtcacacgcgagcggccccgattactttcgagtcacacgcgagcggtccactcactcgtcggtcgcgcgcgtgcggcccgatcacgtttgggtcgcccgcgtgcgacccaatcactttagtgtcacacgcgggcgctccaatcactaatcggtcgcccgcgtgcgggcgatcacttgtgggggtcacacgccacgcgtgcgacccaatcactgaactctcacgcgagcggtccgatcacatttgggtcgtacgcgtgcggtcccgtcaattttgtgtcgcccgcgtgcgacccaaacattttagtgtcacgcgcgtgcggcccgatcactttcgagtcacacgcaagcggcccgatcacttttgtgtcgcccgcgtgcgacccaatcactttagagtcacacgcgagcggtccgatcac

SEQ ID NO: 39902 - DNA, 1160 bp, Heterodera glycines
tggcactatctgatgacagccgcgggttgatgctcgagtgtcacaacaattaccgctctcagctggccaaaggcactgcggcaaatttgaccggcacaatgccggctggcagtaatttgatccaacaaaaatatgtgacggagggcattgagacggtggcacagaattgggcaaacggatgctcaatggcacattcggactcatcacagcgcaatgggatgggcgagaatttgtacatgacgagttcgtcgtcaatttcggaaggtaaaagcaatggaaaacgtgtttgataattagggatgatatttttaggcaaaagcctattttttcctgagctccccgtggcctgaaacgcacgaaaaacatgtttttttgggctgttgttaagctacttttcgacttattaatgccttttttctaggcttttatttttatagccttaaaagcctaaaaatttttgaaaatacctatttttgcctattttggcgttttgtccaaaatttgttaacaaacatgcaataaaaatgaaaaatgcaccactaagaaacgacctgaaaattttataaatacaccattaagtaattaaaattttttcaaaaattcatcttcaaaataatttatttattttttgagaatttttgattttaagaattatttagctaaatactgttttccctaatttttttacttttttgtaattttgtcattttaaacccctaaatttgagactatttagagcctattttccattttttggagactatttttagggtttttagagcctaaaggctacctattttagtgttttccggaaaaatttggacttcagaaaatctggttcgggtgtgtttgcaaatcgtttatcaaatggggtttgctggatcaacaagattaagcttagagtctcagttatttttgtttgtctttgagtacagcctttactcgggaatgaatttgatcaaatggatttctggataccgaattgataaaaaaaaacaatttctcatgatcaacactgttttgtagctgatgcgctgaaacaagcttgcgacatgtggtgggcggagctaaagcaatacggcatccaggaaagccttgtgctggacagggaacagttcaacaagggcatcggacattggagccaggcaaaatgaatgaat

SEQ ID NO: 39903 - DNA, 1208 bp, Heterodera glycines
cattttctaatctctttacatccataagataaatttaaaaatgcacattacaatgactaatttattcgtgctaatcttcctgatatagaataagatccttttttacgctcttttttagagaagagacccatataggagaagatggatatgctttatatatacgtcttaacaatggtgattttgaatttgtaataggacatctcttaacaaatcaaaatgtcgcaccttataatccatatttattaatgtgattccaatcactcatcaatgtagaattttgttcagaaatgaacgctgttaaatatattttcaaatatatctataatggatatgatgcagtcaacagttgaatgtgtaaaagaggagccgaatggtgaaaaaattatgttaaaatacgatgaagttacccaatatcttgaggcgcgttatttgagacctgtcgaacatgttatcatttgtttaaatttgagatatagggtaaatctcattcatatcagatacgattataggtacatttagattattgaacagtccatttatattgatcaatattccgaacagtgataatcacaacgcaattacgctaaaaatgatcagactatgatttatactttgatgagatagggttggggtcaaaattggacacctcaaaaatgattgatttctaccgtatttcaagggaaaatgattaaaaacagatattttttaagatgatcaagttcgaagagtacttgcaagtataagtgtgctaggtcagctgcgtttaatcgttcatgccgaagcactcgcataggtaaaagttcgttttggcgtggattcggtggaatgatcgacaatttattggtgaaaaccatcagattgataggccgcaacttcgtcgttgaaaggattagagaaagaaagaagaaaaaggcaggcacaaaaaacttttacacttgtccgtatgcacgtggctgattttctgtctcagtcgaaagctttcctaacctttgtgggacgattgttaaattttaccccctaattagagtcattccattcatctcaccattctggatatattttttatcacttttgttattgtcatttatgatagtcactttgaatataattgttttcatagataggttcaaaggtaagattacctgactattttcataattattttgaagattattgtcaatcaaaaagagtaaaaaaatgtttctttc

SEQ ID NO: 39904 - DNA, 1221 bp, Heterodera glycines
tagaattctgtttcctgtaagccatattcaaaaaagcattaactcataaacaactagaatgtgctaactgttggagaaatttattttttgttttcttatcttttgaatttaataatttagtttgacttctccatatattaatggcttattcaaaaactatttatgagttctatattttagaaatggagttaccggcaacaacgttctatcaaaatttttgaaaaatcatattcttgataaaaaaaacatagacaatatcttgattttcaacataagagctcgtagtcgtgatcaacgccctttttacctaaaaagcagaaaaaaaatttttttttctgcggtaaaccaattccgaagaattaccattaaattcaattaactcacacgaaaagtgcccacttctggcattgggtcaaacgttagcccacattgccctagacagtttttcagttgttttttcgtatacgccgagtcaccaatataaaaaattaatgaaaataaaagaaaataaaacattttctgaaacatggttaaatgaagctgtaattctaaatttaacaacattattttccctaatcattagggctgggatttttatgttttaacatattttttttgcggcttagttatggcgagagaagcccaaaaatagcattttctccgaacaatttttgatttagagcgacttataaaaacacatattttggcgttttcgcacataaaaacatatcgcacatatttcggggtttggcacatattttgcacatattttgtcattttgaaaaaaatatctaagaaaaacacaaaaaattcaaaaatgcacccctaaaaatcaactttcttgccatttttataggctctttcaaaattttctttatttatttcgtgtaccgaaaatcgaattcttcattaattcgttactggatatcgaagtttcttgctggaacttactcaactgatggaaaaattatctttaaaaacaatttatcaaaaaaggactaattttacccccaaatgttttttatttgcaattgtgcgggcgaaaatgataaagaatgagttttttggaatttttatgcaaaaataccattgatttttccaattttgagcacatattttggcatttttttggcttatagcacatatttcagcattttttagcacatattttattacatatttcaggatttttagcacataaaaatcccagccctaataatt

SEQ ID NO: 39905 - DNA, 729 bp, Heterodera glycines
aaataattaattaaataaaactaaaaataaaatggttgaaatgataattatttaaattaaaatagtcgaaatgaaaaattaattaaaataaagtggtcaaaatattaattaatttaacaattaaatggcggaatcattaatttatttaaaatggtcggaatgattaactaatttaaatataacagaaggaaattaattaatttaaaaataaaaataaaatcgttgaaagaattaaaaagtcagtcccaaatccttaaaaatattcagtaaaaatatttgtttcgtttcatggaacggaaatgggtattgaatagagtgccacgggaccgggaatttttgccaaaaccgggaccgggacttgccgggacctgagaagccgggaccgggacctcgatttttttcgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttaaacaattaatcatttttggactaaatcatcgaatattaatagaaattcagatttgattttcacatcacttttttcggagcctaccgggaccgggacctcggatgaccgggaattcccggcccggtcccggtcc

SEQ ID NO: 39906 - DNA, 1331 bp, Heterodera glycines
  misc_feature (1260)..(1263): n is a, c, g, or t
  misc_feature (1266)..(1266): n is a, c, g, or t
  misc_feature (1269)..(1271): n is a, c, g, or t
  misc_feature (1273)..(1273): n is a, c, g, or t
  misc_feature (1282)..(1282): n is a, c, g, or t
  misc_feature (1284)..(1284): n is a, c, g, or t
aatttttagcatttaccattaaaataaaaataatcgcaattgaaacttttttctttatttatatgaaaaagccattggccacattctgtaaggaccaattggggttgatgccactgaaactatgtcggcaattttaaaggcttattgaagcattcaacaatttctataggaaagagtttttctattctattagaaaaatgccctcctaaagtcgaaaaaagttgaatatttggcttttggaccaattatatgtaaaatggacgaatatttttaaaaacattttgatcaaaattgaggccaaattttctgtttttgttaacccataacactgctagattcaaagtctcaatcgcaaaaacaatgaacaatgaaggcctaagcttctccctgttaaaaaatggggacaaatttttagcatttaccattaaaataataatcggaaatgaaacttttttctttatttatatgaaaaagccattggccacattctgtaaggaccaattggggttgatgccactgaaactatgtcggcaattttaaaggcttattgaagcattcaacaatttctataggaaagagtttttctattctattagaaaaatgccctcctaaagtcgaaaaaagttgaatatttggcttttggaccaattatatgtaaaatggacgaatatttttaaaaacatttagatcaaaattgaggccaaattttctgtttttgttaacccataacactgctagattcaaagtctcaatcgcaaaaacaatgaacaatgaaggcctaagcttctccctgttaaaaaatggggacaaatttttagcatttaccattaaaataaaaataatcggaaatgaaacttttttctttatttatatgaaaaagccattgaccacattctgtaaggaccaaattgcggttgatgccactgaaactatgtcggcacttttacaccttaattgaaacattcaacaatttatatagcaaaaagttattctattctattataaaaataccctcctaaaatccaaaaaactaaatactcccctttagacccaattatacctaaaatccctgcatattttgaccacactcagatcaaaaaagaaaccaaattttctctctttcttaacccatacctctctcaccttcaaattctcaatcccacaaacaataaacatataggggaacacctattcctggttaacgatagtattcaagtcgatagtattttcctctaaccttctcgactcctttaaaggaannnnctntcnnnancaaaaacanantctctccatttgcaagaaaaatccagaaaaataaaaaagaataataa

SEQ ID NO: 39907 - DNA, 1092 bp, Heterodera glycines
atttttaaattttttatagatttttaaatgtttgcattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacagtcaaaagagtttaggcttaacttttttttcagaaacttatcagaa

SEQ ID NO: 39908 - DNA, 1035 bp, Heterodera glycines
  misc_feature (20)..(20): n is a, c, g, or t
  misc_feature (1005)..(1005): n is a, c, g, or t
cttgaaacgaaaagcgactntaagccgttgttccgcggccagcattgacgcgtaggcacagtacatctccggggtgaccatgctggacacctcctctctgttggggaggcgatagtcttcccgtaacacctgaccggtggaaattcaaatgtttgcagttagccctcttttcgtttatgtatatttttgcattttgattttcagggatccaaattagtcctgtcattcattcacaatactttttaaatgtgccggtcgataaatcatccccccctaaacccacccaatattcgtgcccttccatgcgtctcagttcggcacattgcttcaagttcttgcggatcagcccctcttgcccggggtacatctgcttcatctcatccattcgaatgcgttttggcaaatcgtcactttgccaaaaaagacggaaaatgtaactcttaaaatgccgtttttgttttttgaaacagtgctaatgtaattttgcataccatcataaagtctttgttaaaatctttcgcccgcttcgaatttggcgtcggaacttcgtaaagcggcatttgctgtccgaccacaaaaagtaccgggaattgtctgatgaacagcctaaaaaccctttttccgattgctctttctccttcctcccacccgtatttgttccgtatcaacagaaagtccgtgcccatcgggtggtgttggaagattgttgctctgtacatgttgttctcgatggcctgcagcgattcgtttggcgacaaattgccaagaaaaggcgaagtgtgggagaaagcggtctcgccaaattcgaactcacgcttttcctcctctttggtcaatttctgaggggaaaagcaaagttaagaagatgaaaacagtttttttttgataaaaatatcccacttttttgtagtaattcctaatttttgatgccatcccagtttggttgagcagcggtggaaattcctcgatgtattccatggcgaccaaagtgccgtctcgaccggntcaattgtgcagttcccgcattacaaacag

SEQ ID NO: 39909 - DNA, 902 bp, Heterodera glycines
atgaagtccaacatttaaaaaaattgacaattattccctttaatttaaactctttcttcatgattaacttattctcacattgcattcattagtaacagaaaaattcatattattcggttgtggttttaatttgttgaaatatatatttttattctaatttgagacaatgaatatcgggactgaacaaataatttgataaaaattgtgaatttttcaaatttggtcgaagagacattttggcgatttgtgctgtttttaggtggccattctgaaaatgaaaatccaaaagcgatgcttttttagattgcttgtaaaccgaaacttaaaaaatcaaaatttataataaattaatttttttaaatgtaatataaaattaaccttctttgttttttgtttgaagaaagcaaaggttataacaaaaaatttaattcaaaaattaattcaatcaaaagatttttaaacaaatttcaaattcaagctttaaaaagatcagaaactgactgcttacaattagactttaatatttcagttcggaattgaataattggcttcgggacttggtgatggacttggatcgagatttcctgactgaaagtcccattatgaagggattcccggtcgccggtgctctccaaaacatgagcgggggggggggggggggggtcccaggaaaatctcaccgaggcccgatttcgaactcctatattcaaaaaaatatttacctaaaaattagaattgtaattaaaattgtataaaaattcatgtttgcctacataatttattgttttcttgttttaaaacaaattaaaaaataacatttttcaaatgaaagcatatcatttcattggttattaagctgctgtggtgtttagaactgtgaggccacgtctattgggtgccca

SEQ ID NO: 39910 - DNA, 992 bp, Heterodera glycines
cctcctcttaaaaaatgcgtgaaattttttagcattcaccattaaaataaaaatgaccggaaatgaaatttttttctttagttaaatgaaaaaacgtgggccaaatcggaatttgtcggaacgaaagaaggatcaatgtcagaagtgatcagaaattttgatgaagtcgtgctgtcatcaaaagtgaagtggctaatcgtaatggccggcaaagattcgattttggcaggagaatcgattgacagcataatggagaaagtcaaaaggctccgacaattatgctcaaaatttggccacctgaagattttttggctcttgccgccgttcatttttgccaaaaagaatgagtcggaagagttttgcgcgagaatgagagctttcttcagaaagaagagtgaaattgagctgatttcggtcaatgaagaaggacgaagtctgttggaggtgttcagatttggcaaaagttataataacgagcacgtgaatcagaacggatggatgacggaaaaaggaatgaaagtgatgaaagcatggctgacgtcgctggttccgggattcccaggcgatcgggagcttggaattcgaacggtgaagtcaaaagtggttgtgccggacgttgagcagggcagtggtccagtagaccctccccaaattcgctacaagggcccggtgaaaaatgtgggaggaggcccaggtgacccttccccatctccgttcgactccttttctgacgatggtccaacccattcagttcggtcggtgaacgtgcggaattttggcggagaatttagccaatttgggcgggctggtacagcataccgctcggctcatcgtggtggaccgtcgtcgtcgcattatcacccgtaccagcgcgcgcgcggcgggcccgtctaccactcgactccatctcgtcgccgttccgattttgtgccgagacgttgaagcttagaacccccagacgagccccccacttttttgacagccgaatctca

SEQ ID NO: 39911 - DNA, 1418 bp, Heterodera glycines
aggaaaatataggagagattcattattttgtttgcaaaatatcataaattttttgaacgtgtctgaacacacaaacttatttcaggttagtttaggcatcagatgctttccttcaaaaagggagtgaataaaaatctaaaaattttattgcttttaacgagcgaaactttaggcttacttttttttataaactgatcagaagcgaccagatttgcgagggcatcaaaaagcaggaaaagcctgtagatgctactccagtaattctgattaaaattttattaatttttaaagttcctttttatttttagcaaaattattcataaattttttccaactgttgaacgcaccaatttatttcaagttattttaggcactcagagctttccttcaaaaagggagtgaataaaaatctaaaaattttattgcttttaaatatgcgaaaatttaggcttactttttttttataaactgatcagaagcgaccagatttgcgagagcatcaaaaagcaaggaaaagcctgctagatgctaactccagtaattctgaattaaaattttattaatttttaagcttcactattttatttttagcaaaatcaattcataaatattttttcagaaactgctctgaaacgcccaaatgttaatttaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatgacctgccaggcca

SEQ ID NO: 39912 - DNA, 945 bp, Heterodera glycines
catactggtctgtccactgaatgacctcttcccccaaaattggcactttattggctaattaagcaatgagaaacaaccgatgggaaagcgaagcgaaaaaggcgggggggggggggggggggaaatggacactcactcatcccattcatttatatccatccgacggacaaagtgaagaatggggagaggaggtgaaagtgaattaattaatgtgctgggaaggcaaacaacgaaaagggacgaaagaatgagcggaaggatagggacaaattgggggaaaaggggtggcattggggagagagatatgggggggggggaaaggggtggcattggggggagagatatggggaggaaaggtgggaattggactggaagagatatggggaagacgggctgccggtgatcgaatggaatcggcgtgttgcgctcgaaaaggaaatgaaccgagacccgaacgcaatgcgattcatcagcatcacttacgacgcctccagcaactttctcatcttcccaactccgctcggcatcaccgtaaaccgtcgcggaattgccaattattttggcacattctaattttggcaggtgtacaatttggtcagcgaccaagtggcaaggcgtataggggcgggagagaatctgcgctttgttggcgttgcgttgtgtcgcgctgttcccggcgtaacggtgccattcatttccttttgaccatttaaaatagatttttctaatggaattgcacaggaaaaactgcaaggtgcagctgcaagtgtgaaggttgaggcggcggacaatccgaaccttcgcatcaacgaagccgacccaatgctggtgcttatttatttgcgcaacccaccaacgaatacattctctaaattaaacatttttcaggtgacttgtgcgcatccgaagtttttactgtcacaaattcaataaaatgcaaaaatg

SEQ ID NO: 39913 - DNA, 953 bp, Heterodera glycines
atgagccaacacggattaattcctggctagatttcattttatctgccaatgaaaaaattattactgattgtactgttaaaggaggcatattttcatcggatcatttaacacaatttttcacattaattactcctaaaacaaaaccgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaacaaagaaagatttgactcctaattcccacaacatttattagcatctatcaaagaaaaggctaaattattcaggcaagctaaaactgacccatccaaaaaagcactatacgatagcatttctttacatataaaaatacaaacaaataaataccatagccaaattgagaaaaaggctatttcaaagggaagaaattcaatttataaatatatacaaaaattcaatgtcaatccctttgaaatacctaatctaatttatgaaaataaatgctatcataatagtgctgagaaatctgaattatttgccacattatttgccaattcatttaataatagtgaaaccgacccaagctatccatgcttgggtaatattatagaaattgatcaatgctttatatcggatataaattttaacatcatcgagacccaaaatcttctgaaaaaacttccgaataaaaatggcacttctcccgataatattagctataaaattttaaaaatttgccattcttctctgtcaactgttattactgacttgtttatgatctcattagacattggttcacttccagacatctggaaagaatcaattatttttccgctttttaaaagagtgacaaaaatagtcc

SEQ ID NO: 39914 - DNA, 932 bp, Heterodera glycines
cgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaactctaccaaaaacgtgtttagaccgcagtaactcggctcagagtgaagattaagggacgcaaaagagacgatttaaaagcgattcgaaaattctatcgactaatataataacgatgcagtcgcggcgttgacaactgagatggaaccaaaagttccataatatctttccataaggctggaaaggcagaatttgaatggccagtctatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactg

SEQ ID NO: 39915 - DNA, 1028 bp, Heterodera glycines
  misc_feature (10)..(11): n is a, c, g, or t
aggtcccaannacggacacttgaaaaaatcgatttttttgttttaggggcagtccccccgaaccgatgcgcccagatttatggggagaccgaatccttcgggaatagcttccctatagcctgtactttaattctgcgttggatttttgctccccataattgcttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgcttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgatccttcgggagtagcttcctatagcctgtactttaatctgcgttggattttgctcccactaattgtttcgagaacccccaaaagacacttgaaaaaaatcgattttttttgttttc

SEQ ID NO: 39916 - DNA, 1257 bp, Heterodera glycines
agatcggctacggttcggaccctatacgggtttttgcgggtccgtagtccgtatttttttgggccgatacggacttatactgagtaagggttttacgggtttttagtccgtaagtccgtatggtgcctagtccgtagtcctggtcgggtccgtacaattcctaatacggacgactacggactattttttaaacgcacttactattgaatattaatttgatttttgcgcattatatttcgccaaatttttgaaaataaatttgaaataaaatttttcacattcttaatttctaatgttaatggaacagatttttatgtaaaaaaacagctaacttaataaaaaaatacccacaatagctacccataaaaatatgaatttagcaaagatgtgttcaaatatttggaaaattgggctgtttaacaaattatctgacgggaaagcggaatgtattgagtgcaaaactaaacaactacaaaaaatcgcaattgaagccagaaacagcggaaatgttaatctttttgaataaagcactcccaaatataaattacaaatattaatttttcattagctcgcaattttatttttttctggtcaaaactgttgttaaatgttcgtaataaaatttataacaaatcttaatttgattacagtaaaaaagcatgtttttcttgataaaaaatatttaaaaaaaaccctgatccgtatgcgggtccgtatttttcctgggtacggacttatactgagtaagggttttacgggtttttagtccgtaagtccgtagtccgtatgggtgcctagtccgcagtcctggtccgggtccgcattttcgtaaaatgccgatctctaattgaaatacagatatttttacgaagatatttttgaaataataataaacaattatgccatatatttatttcgaattttttcaagaccaccaacgaacaaaacttttaaaatgatattggaaattccgaaatttatttgggtaaatcggccactctgaaaccgaatatggccttagatttgggctctgggttctcattgaacctcaacttcatgcatggagttgaacgagtacaatctcaactagcaaaattaggtcatatttaagaccacatgcgcattttactggtctaattatacagaaaagacttcgtttttgttgttgcattacttcatttttgaacataaaaaattccagaaaaaatagtggaaaaatttccattacaccctaaataaaggatacgaaattaatta

SEQ ID NO: 39917 - DNA, 891 bp, Heterodera glycines
ttcttagcgggtgtgtttttcatttttattgcatttttgttaagattttttcgaaaattctaaaaatagaacattaagcacaaaaagtccaaaataggcaaaattaggcattataaaagtcatcatagacaccccaaaccaagcagaaaatgcgtttttcgtgcttatctatgcgtattaagtgcgcagaaattttaggcatttgcctaaaaatcgcagccctagtaattagtagggcccggattatcaacttcgatttttcatgctcagaatcccacaaaatgcttatttcaaaccaaaaattacacaaattgatcatgtacaatcaaaaatataacctttgaacatttttagcatgtttgaataaattttgtaaaaatgaggctttttgacccaaaatgaggcttttttgcatgccaaatgaggcttttgaaaattttaatctggctaccctgatttagagcgacttaatagcacctaaggggggggggcgttagcacctattttgtcctttttccagaaatttcatagcaaaaatgcaataagtacgaaaaatacacccctacgaatcgatcagaaaaaattaaaaaatatatacccctaaaaattggccaaaatttcagaaaatattcccttaagaaatgaaaacccaaaaattcgtctccagaattttttatttattttcttgacaagttggatttgtgcgggcgaaattgataaaaaaaatagtcatttttagaatttttgtgcataaagaaagacactggatttttccaattttaaacacctattttggcattttaagcgtttttagcacctattttgcacttttttgacacatattttagtacctatttcagtatttttagcccctaataatccggtctttac

SEQ ID NO: 39918 - DNA, 981 bp, Heterodera glycines
tactgcgttctaaacacgttttggtagaattgcggccagaatttaaaaatacagtttgctatggattcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggattcgcatcacccgcttcaacgggtgctcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctattgcttcgcatcacccgcttcaacgggtgctcagtctagggaggacaggtcattcaaattctgcctttccagccttatgga

SEQ ID NO: 39919 - DNA, 958 bp, Heterodera glycines
attagggtcgtcgctattattccgaaaatgtggttccttttagtgtgagtgttgagcagaaaaagagatagacgttttttcaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatttgagtggtgagcagaaaaagagatagacgttttttcaaaattttcagagccaaactcgcccagaaagaaaatccagaaaaattagggtcgtcgctactattccgaaaatgtgggtggaagtcatgtgagtggtgagcagaaaagagatagacgttttttcaaattttcagagccaaactcgcccaaaaagaaatccagaaaaatagggccgtcgctactattcccaaaaatgtggtgggaggtcatttggaggtggagcagaaaaaaaaataaagttttttcaaaattt

SEQ ID NO: 39920 - DNA, 876 bp, Heterodera glycines
cgccgataggcgccgccgggaaaaatttttaatttttaatccgatttgttaacagattttgtccaaaaatgaccaaattttgccacaatcttatattttcttcgtaaaatagtgatattctgacatagaatttcaaaattatcttgctttttatataaaaatacttatttttaaataatattaaaaataaaaaacaatcgcttattaaataaatttttttaaattggtccaaaattgccgcggagtcccaaattccggggactaggtcgttttggcgccgacgttttggcgccagcctcagtttttttattataacttttttctttgtcgaccaaatctaataatcttggtatcattcgaaagatcctcacatgctctattagccttacaaaaaaaaacaaaaaaaaatttagcctgtaaaagttattaagaaaaaacttcaaaaatttcgacttttttgcaatttcatgttataaattttttggtaattgtctaatcgcgaagtaatagcttagaaatagcttctaaacatgttaagctttcgaatgataccaagattattggatttgtttaacaactaaaaaagttatagtccgaaaacttgagctggcgccaaaacgatacggacccgaagcatccaccgtggacgaagccctgggagaacagagcgcagcggagacgagccaagcagagcaatacccaggccgtgatgcgtctaaatgacacgacgacgtcctgtgacacccacccgtcccttgcttcgatcattcccgtcccttccgattgctgtgttttgtctgttccaatgcttcctaaatgttccccttgtgaacagtgatccttccttatgtgatctgaacatataccgtattatct

SEQ ID NO: 39921 - DNA, 1163 bp, Heterodera glycines
cccccccccccaacttagcttcacccaaaatttccaaaaaaattttcactaaaatttcgaaaaaatacacaatttgttgatgaaaatctgctaaagatggctgaaaatcgcaaaatttgtcattttttggacaaaattcgttaacaaatcggattataaattgcaaaaaggggaggtaccccttattatggggttttcgggctcgctgatcacacgaatatgacatccatttcgaccgatttcggacccgaactcgaacaaaaagtcgagaattcaaatttttcaaaattctcattgaccttaaattgattaaaacagggtaaatttagaacgaatgattgtgtatatattagtcgggtgaactatgttatactttaagaaaaggctggccattttgggtgcgcgcccaaaatctcgccgccaaaatttttaaaagtttcaattttaccaatttttcaagaaaaaatcaaaaaaattttatgagtaaatttcaatgaaaatgcattttatttttttcaaaatagctagaaaattttttataaaagaatttttaagtttgaaaatttttctcgaaaatttggcggctaaatttcagccggcgaatttttgtcctgttccggcaatccctccccccccccccggagaaattagtactgtcaaaataattctattaaaagtgcattgtaattaaattaattatttattttcagccaaatctgctgacaagcttgctcttcaactggatgaaaagatggaattttgaaggaaaaaaaatgttttttaaatttttgttgtttattgttaaataaaaaatttacttggcactaagggtgggaaagagtggactaaaaagacgagaattttgacgagaggggtcaatggcaactatacaaaggcttacagtgcaactcgtacaaaagacggctctaatgcactttatgagtccaatcgacttttatgagtccaatcaattgacaatcccgggtttttatacaataactttgttcatgttcgaacaaaccctatctttttggtatcattcgaatgcacaaagtctaacgaagctaaaatatataaaatcgcagcgttcaggcaattaccaaaaaagatttgattaattaagtaattgctgattattttcgtttgtaacttcttggaatgtt

SEQ ID NO: 39922 - DNA, 1373 bp, Heterodera glycines
acttacgccgatgactttgtctgtcctcacttttctttttttacattttttcacttttcagtgcagcggagtgttgaaaacggaatggcgaaacgaagaccttctcgtcgatttctgcgaggaatttatgaatgcgaaatttctgaacaaaaaggcgcacatttcggaactgttcacgctggccatcgctctgttgccgctgattaatccgtggaacaacgaactgagccatcgtttggtcggaaacctctacgagcagaccggtgagcatgtacagcaccgtacaaaaatcttacgtctttctatggtttaatttcggaagttaactttcactaacaatttgactcatttatccaaaggatgtcgcgtcttctacccgaacaaagagaaatacgtggtggagccgcccacttattttgtgaaaggcgcttctgtggccggtctgctccaatcgggcaaatatttgatggttgttgtgctgttccttctataaaaacccgtgttgtcctctttagggtctcactatgcttcaagtcactttccatttgccgcccaattccgcgccctccgttcagcagcaaatgctcgatgattggcaacagaatctgctcgtccacaccaccattttcaacccgtcgcccaatgacccgctatctcagtaccgagtcactttgcgttccttcgagttttgtgtcaacggcgtttacgccgttcggtcggcgttgctcggctttaagaagtccgtgagcacgccctgctacgacttcatgaagctggccaagcacatcatcccggtcttcagattccgctcatttgctaattattgttagtttatagtacactgtcttctgcgatgccaaactgttctacccgctgtactcagtcgacgacaaaaacctgaactggagcagcgacgaattcttcgagcgcttctacggctgtccgtacacactgatcaatcagccggtgccgttggcaaaagccgttgcatacgatgaaaacggtttttgcgtcatttccttacaaaaaattaaaaaattttgttcagcaaattcagtgagcgttttgacgaaccaaatgcagcgaaagttcgatttgagcgaagggaatgacagcgagttggagcagcagtcgtccgatttggaactgaccgccaacacgaccacctcgttggagtcgtcctccgcttcctctgctgccgctgcgccgctccctccgccgttcagtcagtccgacttccaccaccatttcgtccaccaattccctccgcctgtccattccatcacgacggacatcaacctcaacgcgactccgcagcaacagcaaccccaatttacttcttccatacggggacacgaacaacaacaacaact

SEQ ID NO: 39923 - DNA, 1580 bp, Heterodera glycines
acttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagtagtcgtcgtcggtgtagaagccggtcatctgttgggctcgtcttgacgcacggaccaagggagtttagcgtatggccaagtcatggggtgttcaaacacctcaggccctacatacatcagggttggatggcatcagatctcgctcccaaacatcgcccggcatataatcccataccataaccgataccctgcggctgttcgatcagactgccggaaaccggatcgatcatcggcatcataagatcggcgggcgcttcgtccggaccatccatgccccggcgcttcagatcgcgcagcgagagcgagcggacgccgcaggagcaataccagtcgttcggcggaaagtgcttttcccaccatggatcatcatgacgataaatcctgccatgcaaagcctcatgggatggccgggggattttcggcttgcgggtttcgccgtgccggtactcccagaacggccgcagcttgagcacgtccgggtcgcgcatctgtttgaggcggcccgccatataggccgtgcgcatgttggtttcgaaaatgacgcgggtgcgccatccgtaatcgcccttgtacgtccagccgtatttcgagacgatccggtcgaagtcgttgcggaagtcttgaagcgtgccgcccttttccatgatatcggctatcgccgtctg

SEQ ID NO: 39924 - DNA, 1053 bp, Heterodera glycines
  misc_feature (948)..(949): n is a, c, g, or t
tgttctgccgcttggttgtaggactgcttcgcctctttgttggcggctgaaatgaaaaaatggcgaattatttgttagctacatcaaaacaaattccctactcgttctgtcctcgcccagcgcaatttcggaaatgtagcggctgtagtcgcccttcatcttgaggtagaacaccttggcctccaggttggtcgtcgcatttggaatcagagttgagtcgaggaactcctgaaaagcgatggtatttggattgatatcaaaaatgaaggcatgaaacggaccaaaactccacggcaattgacaagcagctcagattccaactcctcgcgataggacttgaacccctgaaaatgaaaagataaaacactaaaaaaaatgtgttgcgcaccagccgttgcccctcagtatccgaatagaagcgttgttcgatggcgcagagggcacgccacggctgacgaaatcgcacctttgaaagccacccacagcaactgtcttttgttataagacaattcggagcaaatgctgaccaactgaaaaggaaggaaaagcattagaagctgctgaatgtatccaaaatcaaattgtcacctttttcactgcgtcgaccatgtcgttgaagcgttccaatttttcataagcatagatttaatttaatttatcgagcaaaccaaaggcacatgagtgctcttatatggtgccaaaaaagaaaacaacaaataaatttgatcaaaataaaaatacaaaatgaataccgtactaaaaatgaataaaaataattcaatcaaatgttaaaaattcacaggtgataaaaatatagtgtaaatatggcaacatggaaaatcctactcagaactcattgcttttagtaaacccctgaatcctttgctttattatttgcaccgctaccactggaagattattccagctttttactattctatttgaaannatattttgagttttgcccgtgtggcgggcgcttacccgtaaaagtaaaggcctcctgggcctttctgagaaaagaaactttcccagcatcgaggctggtgaacc

SEQ ID NO: 39925 - DNA, 1511 bp, Heterodera glycines
  misc_feature (11)..(11): n is a, c, g, or t
  misc_feature (67)..(67): n is a, c, g, or t
gaaaggtccanccatatacaattcatggaggaggtgccaaaaagaaaaatgtttaataatacaattntaaaagcattaattcatttataatagaaatttatttaattaaaatttttcattataattaaattggaaatgaattaaaaacaaaacagagtcagtcaattaaatttattggagggttgggtcaaaatttataaaaatgtaaacataatcatcatatttaactcgtttttcaataaattctgattcactgaatcattttccggtcacgcccggaaacgggcacatgacaaaacagggggacggttgtttttcaaaaccgcttttttgcagtgtgctttttccaaaaaacttttggagtattggggggggggggcaggtggtgccaataggcgctgccggtaaaattttttataatttttattgcgatttgccaacatatttttccaaaaaatgaccaattttagcgattttgatttgtcaaaaattgctatttttgaaaaaaaaaattcatagaaattccctatataaaatgccaatcacggatcaaaatcacgaaaaattgaaaaaaaaaaactaataaaacgggggaaaacaatcgggggatcgcccccgcacccctgactggaactgaactcaaaaattggaaaagcttttccaattgccagttgattttttgaattttatttttaataattatttttttttcatttttaaaattaatttatttttcaaaattgtcaatattttgtacttttttaaatgcttctttcacagaatttggcatggtcctccattcactcgctgttcggcttcatcgcttttctgttgaccattttccaaccaatttcggcactcttccggtgccatcccgattcgtcctcccgtgtgctgttcaatgttttacacgcattcaccggatacattggatggctttgtgcatgtaataaaattttatatatttaatttaatttttaaattaaattagttttattaaataatctaatctttgaaattgtagtgacaatttaatattggtaaataaaatttaattttttatttgtccgtattaacagaataattacataaaaattccaaaatataattggattttagagaatccataaaaataagaaggaaaaaactaatattcgcttaattatcagcaagtgaaaaacggtttttttcatactttttagagtttcctaggagttcaggaaaaaatcctttactttatttttaattatattttttgggcaattaaattattatgaatttttcttcgtatttatgccatattttccaataattattttccagtaattgccatttgcattgcctgcgtacattttggtctgttcgccaatacaagcgcatcaacagtgctgatcattgtgttccttgtactgcttgggattgttgcactgataatgcaaattgttgcctttcggaagggccttcaacagcagcaagaaccagacggaaccggggggagggggggggggggg

SEQ ID NO: 39926 - DNA, 988 bp, Heterodera glycines
taattcctttttaaacaggccaaaaagtttactccccgctttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccacacggacacttgaaaaaatcgatttatttttgttttcggggcagtccccccgaaccgatgcgcccacatatatggggagaccgaatccttccggaatagcttccctatagcctgtactttaattctgcgttggatttttgctccccataatgtgtgtgagtaccccaaacggacacttgaaaaaatcgatttt

SEQ ID NO: 39927 - DNA, 946 bp, Heterodera glycines
aaataataaagagtttttacgagcacaaaaagaaagaattcattgagagatttgaataatttaaaagtttatatggccaaggcaaacagaaagaatttgctaaggaattgggtatttctgaatttacatttataaaatggaaaagcgaattggtgccaaattattataaaagtaagggaattttgatacataaaaatggtttttttattttagaattgaataaatattccaatgaggacaaattaaaaaactgaaacaatatttcgaaatcaaagaaaaaagcccaaaaattagcgacaaaaaaattgccaaaaatttgggaattgcgaatcaaactctgatcacctggaaaaaaacaaatttgcttagatgttgaatttgtgatttttgaagtgtaatttattatttggatttttcattttaatattttgtctgtcttttttattttttattttcccattaattttcatttcgaatcttctgatatttttttatgaaatgcgaaataagtgaacttattttgtccgatttataatcagcgctacatcaattttcgactttattgcattagtttcactctgtgcaatgataaagtacccattttgatggtcgaaaccgaaaatttcacgagactcgagaccgagacagaaaacttcgagaccgagtccccaaaaatcggagactttttcaataaattttcttattttcttaaatcgattaaaactttctatacattaaaaacttttttcttgagactttcctaacatattcttagacgtgagcatcatattccaatgagaacaaattgagaaatatttcaaaatcaaagaaaataatccaaaaattagtgacaaaataattgctgagaaattgggaatttaattttcaactctgcaaaaatggaaaaaggcttcattttcgaattgaatgatttgtaaagtgttta

SEQ ID NO: 39928 - DNA, 158 bp, Heterodera glycines
tctgagatgatccatcgaaaaccgaaaaatgggagggagaggaaaaggggagaaatgggataaaagaatgaatgaggatcaaatgcggaagtgtcagagaactaattatcggcagcggtaaagcgcacattattctgtcgggaagaggggagcgagaa

SEQ ID NO: 39929 - DNA, 1289 bp, Heterodera glycines
  misc_feature (1231)..(1231): n is a, c, g, or t
atttttatttctctatttagaattgttgttattgttgttgacgaattccttaatatttatttaataaaattaatattaacaaatttggatttgatagaactaaataattatttcttttttagtttggacgattaacaaatctttattttctataaatattggcactaaaaaaatttttcgattggatattgccttaatcacaggtttattgaaatattttattatttttgtttttattaaattttaaatagttgagattattgccgaccaattccttttcctatagcaaatttcctcgataattttaaaaattttatatttacaaatctgcatttattacacatatgccgttctatatttcacttttatgtttttttttctctttcaaataacacataaattgattaataattttttttctcgctgggatcaaaaataaaatttcattaaaattattattttttatttttgtgaaatttctttccttgagttgatttgaaaaataccatattctttattttgaatataataattcttttttatttattctttatttgttttctttaatttcttttctatctttacacttttttttattattctcaatcaattttttcagccttaattctaaaattagcgcactaattttctcgaattttttatggtcaaaaaggaagacatttaataaaaatgatgttttttctgaatcgtttagatttgttaaatccgaaatggccttaagctgacataatatctgagcttgtactactgcttaaactgcatgcaagaagttagagctgtacaattcactgagaatcagactccgccctcaaataattcattttaggtattaaaattttttcattatgtttttatatctcaatgttttcttaatttactcttttttttattttggtttccatttaataattttaaattttatttatattttttaataataatcatttatttttatcaattattaatcaaatttcattctcccaaaattacatactttcagttataaatttaaaatttgttaattcattgtttaaatagtttaatttacatcttattaatcggatagtttaaaatagcatgttcattaattaattgtgtctttttgaattcattatttatttacataaattagtgcacaaaaataatttcatatttttaagcatcattcatgtccaaaatttattttgttcccatgatagtgttttctcanattattgttcgttaaaataaatttaattataattgcgttctttatgactattttaaag

SEQ ID NO: 39930 - DNA, 329 bp, Heterodera glycines
aaaatttgcgtcctcttcccattcccttccctcgcctcaattcccgtgattgtttgcgcatccccaattctcttccgcagccgcaattctgctgaaatcactctccccctgcctccctcccctcaataagctctgtcggtcccttcccttccccctgtctctcgctcgccgcaatccgtcgaatgattggtgcgaatggtggccccggggggcggcgtacgttcatccgccattattggagggctttcatctgacaaagtaataatatttggaatgaatgggggtggctatcaattgaaattcggaaatgttggtgattaattagtgcg

SEQ ID NO: 39931 - DNA, 1130 bp, Heterodera glycines
attaattgaatctctgactataattaacctatgaaattttgtaaagcgtaaaaatggaaaaaagggctaatatgtaatactttttaagtaattaaatgattgaaaaataatacctgcctgagtgtatacaatttcataaacaaatcagttttaaaattataaatatgggtgaaattcgttcttatattaaaataaattatggaagattatttgcattatttatgtaaaattttaaaactatgaaataaatgaaaatatttttaattttgtcgtttggaaaaaatggaaaattcagtgttaaaacatcaaaacttctttgcaatttgtgttgatcgtaagtaaaatttaaaaaaaggaaagatagaaggataatcaaaaaatattttaatatttcaaattttccattttactctcgaaaggattttctgctagatattaaaaatttgttaatattcaaagtttttcattataattttctgacgataatttgtcatcgtcagacagaaagaagatattttgcaattttttataattatttcgtatgctttccctactgttttgcgtattttcgatggaaaccaaattatatgaatcaataatgtaatttaacatttataaaagataaagtttttatgcatcacttttcccacttttaattcaacatcgcctttcaaaatgatcatcttcacttgtgttcctcctcgagcagttcagacaaagtgcgttttcctcccaacattcctttttgttcctcagcaattcgttgatcagacgatgccatcacgtgggccatcgttgactttccacaagtatcataggcttttggcatgtccgctgaatatgtctgaacttggttcgggtctatcccgagcaattccagcaaagtgtgttttcctcccgacgttcctttttgttcatcagcgattaggtgatcagaagatgtcatttcggggacggtcgctgactttacatgagaatcatcggcttttggcatgtccactgaatatggaacttcgttttgctcttgctcctcgagcagttgcgacaaagtgcgtttttcctccccacattcctttctgttccccaccgatcagctcaatagattccatttcggcagtgatcactgattt

SEQ ID NO: 39932 - DNA, 952 bp, Heterodera glycines
ctataaaataatattaaaataattatttaacagtaaaaaaataaacaaaaaaaaataaaataaaatttttaattagaatcgttgtaaaaaattgtaaaaattgaaagttatatttgaaaaaattatttattataaatttttactaaaaaataaatgataacaaaaaataaagacaataataaaaaagacatattttaacacgaataaaacaattaaaaataaacaaacgctttcaaatttcaatattttttgtttaatattataattgtattatatatataactaatttttaaagaaatttttagaagaataaataattgaaaaaattgcatctcaattgttcaaagtaatctttttaaaattttaaacatttaaaaataattagcagtgcaaaaaaaagtcaaatgaaaaaatcaatcctgggtataatagcaatttaatttaaaatttggatcttgtgactcctttcctctgtttaataaaaatacaattaaataatatttaaaagaaataattggaaaattactgcattacaaaaacgtttttttttgtgaattgtttatttttgttttctaatcaattttattgtttatttctgttaattctttatttaatttatttttttaaataataaaatttcactaaataaaattcctcgttcttcttctgacttttttttctggttgtcctcgtaaatttttgggtttaaatataacataaatgcatttcaatacaaactaacaaattttcatgaaaattaacttatattataaattttgaaaaaggtaatttaaaattttgaatttattgatctgtttattaaataattttctgtatttaaaattacattaaaaatcaaataaattataaatttatcatagtaaattccccttaaatatattaatctaacaacaaaatcgtaataataaatttttaacttaaataataaata

SEQ ID NO: 39933 - DNA, 338 bp, Heterodera glycines
cgaagcgcccgtcttgaggccgcgaagcggccgaatgttctcaacaaaattaaaaaacgggcgcgaagcgcccgtcctgaggccgcgaagcggccgaatgttctcaacaaaattaaaaaacgggcgcaaagcgcccgtcctgaggccgcgaagcggccgaatgtccccaacaaaattaaaaaacgggcgcgaagcgcccgtcctgaggccgcgaagcggccgaatgttccccacaaaaacgggcgcgaagcgcacgtcctgaggccgcgaagcggccgaatgtcccccaaaaaattaaaaaaggggcgacgaatcgcccgacctgatgtcgcgaagcg

SEQ ID NO: 39934 - DNA, 746 bp, Heterodera glycines
ccgccgatgtcgatgccgaaccaaggcatggcttaatttggtcaagttatttcgaattgaatggacagcgaaattggcacccaatcttacgacagtcgaggaaagtggaaatggaaaaagcccttcggcggccctgttgaaagcggtcaaaaagtgactcaatgtcctccagagaaatcattacagaaaggaggaaaggtaagtgaatggaaaaagattattttgatatgcaatctgaaggtggaggatggaactgagtgacagacagattgaattgattctttggaatgtttcgctcacatttttagttatgcgagaattttaaactttggattttaaatttggaaagttttgggtaatttttatgcattcgtccattttatgacggcaattaactaacaacattgttgttaattaagacataaaaacacttttttgggagtgggctgatcatttgcgatttgatgagaagacggctgagaaacgaatgaaatgaaaggaaaggaaatgtttgactgtggagccatcgcattgagaagaaatggacggaccatttgggaaacgaacagccaaacggggaaaagacagaagcgaaacggatgaaattcacattttgaacttgtgaagaaatggaaagtgggaaaagggagagaagaacattacaaaaagaaaagtcggacggaaaagcgaaaggaatgcaattcacatgaacggactgataagagcaatctgaggaaggaaatccg

SEQ ID NO: 39935 - DNA, 1463 bp, Heterodera glycines
  misc_feature (20)..(20): n is a, c, g, or t
  misc_feature (79)..(79): n is a, c, g, or t
tgtgtcgtttcgtccgttgnagtcaccgattaatttgaccacattttggccgattgcgagttgagcacttcgctcctcncaatcagtcgaatattgtcgactcggccttcatctgtaaatgcaacaagtgccacaactgttatcactgtccatttcccacgtcaattagcctcattaattgattgattgattaattaattaattaattgcccacctgggatgcgtgcggtgcaactccactcgccttggtccgagaacacttccactgatccgacatcgatgaaaatttgcagtgaagttggcctggctttcctctcaatgtatctgtgttgtgttccgtttttccttaattttccattttaattaattgccaaattcattcgattctcttggccacttaccatcccaaaatcatttccaatccgtccttcgatgccaccaatgaaattttgccctcctcgcctttgtccgtctgttgcatttctagcactatcgaaccgtaaatttgcagtcgccaatagtaaatttcgaagaaaatttctacggcaccgtttttcggcaattgcgtaattttaaatgttcggaagtcgtccatgttcaattctttttccttaaaaattgttttaattgccaattaaatcgtttttaaggaccctcagttggacgacggatgggtggggaggggtcaaaagaaagtttctgctcggggccaatttgagcactcgcggcaaagtgagcgccgtagggaaattttggacgccgttataatcggcccaattcccaagccatccgacgagcaaagactcgccactgattgagtcgcgaaatcccttaaatggtgtacaatataagatagaagattccgttgggtttgcctggtaagcgtaagaacccgtggcgaagtccaacatttgttcaaataacggcgtgaactttctcccgttaaaattcccgacaattactgggtttaagaattgtctaaattcgaaatcacattccaatggtctgtttccaattcttgttcatccactcaccttccgtcctcgtccacgctgttcgacattgagtagacaaatgcccacaatgtctgcaatgagagcgggtcgcccaaagggattagcccactgcactcgcacacggcattatgccatcggttgtccttgtggagaatgccctaaacggtcgagcaattaatccgttgacaaatgaccgtccatcattttgtccattgccttaaattcccatccttcgggccccccattggccgctgtttcattctgtcggaaaagcagcacgacgccccccgtcccattggtgaaacggctcgaagttgtcatgaacagagccccgtcaggaccgacgaacacattcggatcacgaaagtcctcagtgataacggctgctaattcagaggggcgacgagcgaattgcgtcgcggggagggcccatcggacggtaaaaat

SEQ ID NO: 39936 - DNA, 956 bp, Heterodera glycines
aaaaaaattcatgtccggctcataagcagaaagcaaacgttgccgatgaacacataaacaatgaacatgatcagcagcggaattgtttgtgatcgttcatacggttgctgactctcatcatcattggcattttcttcgtcattttctgggggttggccctttaattaaaatttttgacatattttttttaattattaatttcaccgtttttgaatttccgtccgcagatgcttcacccttctccgctttgtccaacaatgcttcttcaaatggattattgtcagtgcctggggttgtggcatttgatttcttaattggactattagagtaatgaggatgaaataattgtgctttaataagcgcaattatttgcttaagctgttcaatgctaatccggaataattagagttacaggattgattatgctaattattgtcaattagtatttttttaattgacaaaaaatatatattaaataacataaacatttaattaagcacaataatttgcttatgctattcaaagctaatccttcctgtaatttaattattaataaaattttatttatacaaaattctacaaatatttttacattcccacgaaaggcttgtaaacgttccataaagctcggattgttgttgtttgggtccaaaatgcaattgttttgtgcattgatgagtgaaatgaagctgtatttttttggctgggcacgaaaatcgcgccaaaaaagttgaatttctctgaataaaatgaaatagaaaattaatttaaatataaaaattactaaaatattttttgattatttttcaaattacttttttgcactccgacaagttctttcccaaccatccaaaatttctgacaaaaatttgccaaggtcagcattgcgagcagtgtaaatggaattcctaggaaacataaataattgtcatttgatttataatatgtagcaaaat

SEQ ID NO: 39937 - DNA, 752 bp, Heterodera glycines
tgatcgaaagcaaatcaaagggaaaagtttgtctaaataattccgtattgaacccctaaaatcacttttccctgtgcattccttcgtcccttttcagtgtaacaaatgcctgaagcgcttctcccactccggctcttactcgcagcacatgaaccatcgctacggtaccgtttccccgttttagacctccacagtaataattgactacgatacctcccccccccccccccgttaagcgtactgtaagccattcatgcagcagagacaaagggccgaggagagaacgccgtcaaaggatgaaaacacagagtgaagcaaagaaagaacagcaagcacagtgcaaaaagagcgggagaaattaaaaacgtcgcaaatccctcaaaagccaatcgaataaataacctctccgtcccttcaatgatctttagtatttaatttggtcgctttccctttttgcaaaaccttattaaccactttgacccactaaatgtgacttttggtgctatgcattcataaattaacataaccaccgaattcgaaatgccattttgtgtaaataaaatgtcgcaatttgattgggttttcttttttgggtagtactggagaatctgggctccaccccaaaatttttttttctgttatgaaaagttcaaccctggggttttcggggcttctgatcacgaatctgatatcagatttgcaaaaatcatagattttatcattgattttgaaaatcatagattttcgaaatt

SEQ ID NO: 39938 - DNA, 911 bp, Heterodera glycines
  misc_feature (13)..(13): n is a, c, g, or t
  misc_feature (28)..(29): n is a, c, g, or t
cgattaaaaacanttttttagatgactnnttttttgagaaacatatgaaatgaaatttataaaaattatacactgcctgattatttaagtaaccattatccgtcgctattaaattaatcaattggcatattaaaattggataattaatattgataggcttttgcttacgtctatgggaggaaatgtacataaattataataatattcacaaattttgatgacgtaaatgctgcagtttatgcgcaatacaaaattatgatgcaaataaaaaatctatgacaatgtttggcattaatgttgcatattataacaaaaacattgagaaaatagctgacgaaatttttcaaaaaaaatgaaagaatctttaaattcgttttgagagtctcgactttgagaaaagtttcgagtttttcaaaactcagtctattgagtcttggattttgaaaaaaaaaattgcttgaaaaaaaatatttttttaaaattcagggaggaaattccccaataaaatttgtcgggaatggctggagaaatttaaaaatgtcggccgaaaaaaaagatatagaattttttctaattaataaaaaaaaatctcagaaactctattttttccccaaaattgtccgtaaatatcccaatgtgtcacaaagataatactttagaattgattaataaagagaactctttgccaaattcaagaaaagtcttttttggcgaaaatttctttaaaaataaaaactctatcgacgtgccgacccgtctttcttcaagcaaatcttgaaaaaatcatcccaacaaaaactgttaataccagggttaccctttgtccttatttgtaagattgtctttatattttgagggtccaaatcttacaaattttgaatgtcctttatttgtaagaattgtccttattt

SEQ ID NO: 39939 - DNA, 857 bp, Heterodera glycines
tgccaattcaatggattttccattgcccgaccgtccgctgcccaacaaaattcgctttgaatgccttcagattcagtagttcaaatttaagcattgattaactcataaaagcattcccgtttcagctatatcgatcacttcgtgatcacatttctccgtgccaataaacaaatttgggacaaaattaagaccaatttgcgcttgaatgtgagtcacaacaacgagcgctttgtccagcatgcaatttggaatgctttggtccgtgaaattctgcccatttttgcgccaaacattcggcacttgtgccttcactattctgatcatcttcgcgatttgctccgtgtttcgccgacaattctctctgatctcaaaattaatgaaattaattatggttggcttaagtccgatgattttgaagagccaaatgcaattgctatggaagtgttgaacgaatggttgcacactctgaacaccgatggccaaccgaagcgattgttttgctgtgtcgatgtgtcaagaaccatggaatgggtcaacaatttcaaggaggtgtgtggcagagatggcattccgaggccccaaaaatttttgggaatcgaaattccgggggcccaaaactttttcggaaatcggaattgagacccaaaaaagtcggaaatcataaattttttttaaatataaaaattttaacaaatattttaataggctaaattttaatattcttaatcaagtaaaaggtgtttttttgatttgtttgaaaaaattattcaatgattttcatcaaaatattttttatgtccggtggtgccaataggcgcagtagttaaaaattttgtaattttatatgcggtttcttt

SEQ ID NO: 39940 - DNA, 1573 bp, Heterodera glycines
  misc_feature (1470)..(1470): n is a, c, g, or t
  misc_feature (1542)..(1542): n is a, c, g, or t
aagcctaagcctaggcctagcctaagccatgtacgagttgcgtttgaaaattctcgtaaagctgagttgtctatgagccgaattgtcccatcagctgaaaattctcctaggtttaaatgcttacaaaaaatttttagcttaaaacttttgtgatttaggcattatttcaccaattggtgcaacacttttgattatacgatgtcactgaaaattggattcatcggagcggggaaaatggcgcaagcattgggtaagcgaaacgaaacaaatttaaagcgaaaattaaaaaaacaaaaaatttttttttgtttgtttagcgcgagggctcatcaattcgggtatgaattcggcaaattggacaagaaaaaaaatctcgaacttttgtcaatttaggacgctatccggcagagcaattgatggcgagttgtccaaaggtacggcaaaaaccgaacaataaaacaacaaaatgttttgttttgttcagacggaagttgcaacgattgagcaattcaaagtgagcaaaaaaaagcgagggctttgaattttcaaaaaaaaaatttatttttatttttttcagaaaatgggcgtcaaaatgacggatgacaacacacaaagtttgtggatcatcgcttttttcaccaatttatcaccaaaaaacacacacagttgcgcgtgagaatgaagtcatcattttgtcggtcaaaccgatgcaaatcggcaaagtgacgcccgaaattgcgccccatgtcaaacagagtcatttgctcatttcacttgccttaggcaagcgattaccgtaaaagggattcgctccaacaaatttaattttttcagggattaggctcctctccatcgaacaagttcacacattttgtacatttttttgatggtcgaactaataacaaattcacagtttttgccatcaaattcgcgagttgtccgcgcgatgccgagtaattaatttacttaattgtcacactaattgcacccctaattgccacagatactcccgccgttgtcggcgccggtgtcaccgcttataccatgggtatcaattgcacaataaattattcaccccccccccccattttcgtcgctttaattttgcataatttaggctcggcgtgccaagatggtcaattattaattacaataattgggaattgccaatgaaattttaggcgactcaaatttggtccacaatttgttctccaccgttgggcattcttttgaggcatgcatccctttttgaaaattgacgatcgatcaaaaaattggcattttgacagacgcccgaaattcaaatggacgcaatcggcgcattaagcggctgtgggccctcttatgtgagcatcaaaaaattttgaatctttattcgtatatttttccccataggtcttttcgatcatcgagggattggcggacggaggtgtcaaaatggtgcaaatttgaaaaaaaaatttaatttanaattggcgttaaatgcgtcgccaaaaatgaaatgtcaaatttgccagggcctttcgcgtgaattgtccatanaatgggcgccatgactcttttacgagctgca

SEQ ID NO: 39941 - DNA, 1114 bp, Heterodera glycines
  misc_feature (43)..(44): n is a, c, g, or t
acaagaagtgagactgtctttgtcgtttgtttttatttaattnncattctcaattaggcggaacgactgagggaggaaaagaaatcactcgaattatacgtgtcaaaactgaaagagcagatgaccttcggcaacaccgccccaaggaaatattcaatatcgcccgagtttgaacaaataaagttcgagaagagagtggcggagacgcgcgtgggacagctgaacgaactgctcgacaacgcgcgcgaattggccgaggcgttcaaaagggagctgcagcaaaggaaggaggaaatggcacacaaagaccaacgtctgcagaatcttccaaaactcgagtactttccacggcagtgatgccacgagagcgctacccgttttaaaatacattcgaaaatacgccgactttaacaaaattgtcgggaattcgggccctcccttccgaatcttgaacccaataggcaattaattattcaggcgtcaactcgacgaacttcgacagactttggaacgcgaacggaagtcgcattcattgttggaagaatctttcttaaatttgcagcgagagaagagtcatttgcaagacgaattggtggagacgcttcacagacacgggcagaagcacgaagcgatgctcgccgcaatggccgaagtgccaaatttatttatttttctcatttttattttcgtttttgtttagtcatcgcagcgtgaatcggaattgaacgcgaccgtacgacagttgcaaaacgaagtgctgcagttccgaaaacattcccatggcgccatgggactcgcgccggtgggctccgcgacgaactccttgtcaagtgcgttgtccacgtcttcgctgctctccagctcaaccattgcacttcacaacatttccatcggggaatcgagcatcgaattggaggaactttcccgggaagagctcatcagacgatgcaacgaactcaccgaacggtgcaaaagggaaatacgttctaagaacaaggagaagcagctcaaggaagaggtggttgcaattggacagtccgcaaaaatcagatttataaaattcattggggaagaagggaatgacttaattcggctttcacaacgagttcgacca

SEQ ID NO: 39942 - DNA, 779 bp, Heterodera glycines
gtcgttttcttcgcctaaattccgtttatgtgtctatgattttctagaaattccttggtggaaaatttttggattttttggggcatagaatcccaattttgcataattatttcggattaatgcaatgcttatcatcattatccccccgtcaaggtgcctgtaccgctggctcaaatacaacaccaactgtcccgtgtgccgcttcaatttcatgcgcgcaattccccctgaagaaccggcggaggaacagcaacaatgagaagaaatgacgatctgatcagatccatcattgaaatctgtactatcataatgttgtgtattatgtatatgtctgtgtgttgtgtgtgtactcagtataaagatgatgatactcggaaaacccgaatttttttttgtcggtttttgctgtagatattatttagaggtcattagtggagtccggcttttcagattgttgtcaaaattaggttagctttgatcagttcctctctcagtctctctctctctctctctagctaatctggacaggaaaagcggatctatgcaattttttttttgaaaataatgagatttaggtgtatatgtatatctttttaaaattgctgatcatgaagtgcccatttcaaaattttcgaatctggccaatttattcctctttttctctctctatatcttgcaaaattttcacgcctttattcatttttggtcacttttacaaaagtttgattagtttaaacgcatattaccaatacatacaattcccagtgatcggacattga

SEQ ID NO: 39943 - DNA, 443 bp, Heterodera glycines
  misc_feature (92)..(92): n is a, c, g, or t
  misc_feature (106)..(106): n is a, c, g, or t
  misc_feature (111)..(111): n is a, c, g, or t
  misc_feature (116)..(116): n is a, c, g, or t
  misc_feature (138)..(138): n is a, c, g, or t
  misc_feature (143)..(143): n is a, c, g, or t
  misc_feature (174)..(174): n is a, c, g, or t
tgtatttagtattaatcaataaaaaaaattatatcaatttccactggataaaatcaatcaatttatataattaatctaatttttttataatnattgagtttttttnggatngtgtnatgaatttttggtaataataanatagnaagtatatatttatttattaataatgaattnaaaatattattaaaaaattataattttcatttttataaataaattatgaatgacagagaaacttacaaatataatgataatttaaaaagtaaaataaattgttaaaaaattataacaataataataaaataaaatttttacttaaaaaataaattataaaagtatttttactattattcaaaataaaaacagaacttaaactttattaaatagaatcaaatatagaaaaataattttatacataaattaatcacgaatataaatataaa

SEQ ID NO: 39944 - DNA, 952 bp, Heterodera glycines
cgccagccaatgggttccactcgcagtccaccgttcttccacggcgcccttcgaaacctctctttgccgcctttgccctcctcaaaggacgaccgcggggaccaagactcgggaatagcatcggcacggtcaatcgcatcagcggacgcggcacttctcattgaattgcgaaaaaacagctgagaaagaaacggacgaaaaaaattggaggaaaaacgggtcaaaaagaatttgaaagattcactcaaattttattattgttttgccatttgttataataaaagggatgtttagtcatgttaagaagatgagatggcattttgtcattttttgctttttttcaacgcaaaaaatgacgaacggtggggaggaaatgaaatggcattgacacttttgctgaatgccattgccgcaattagcacaaatgacgacacagtctccctcccccccccccatcactttgctcactttgggctaattgccgtcttctttgggcccgtgggaattgcgcagatgccccgattctttctttccattttatttatttattttttgtagagtagagtgggaagtaccggtactggtactgaaaaaaacggtatcgctgagtacctagtaccggttttgaccggtaccgggacgagtaccggtccggctttcccagccaaaaagtaccgggttatcaactgcaaaaattaccggcaccggatttttttacaattaccgatggccgctctacggaacgggccaactccgtctgagccaactttgagtcagtataactcttgaagttattgaccgaatcaaacaatcttgatatcattcgaaagctcttcacaggctctattaacctactaaaaattacagaagatttccaactataaaaaaaagatagaaaaaaaaaactttgaaaatctgccttttttgcgggttttaagtgacaaggtttttt

SEQ ID NO: 39945 - DNA, 910 bp, Heterodera glycines
  misc_feature (894)..(894): n is a, c, g, or t
ttacatattatttaaaagcacttagtgaataaaaatcgtatttcttgaatcattattggccgcttgatataaagcactttgttttattttttttcgccaaagttcaaaacatttttgttcgtgaatcctataatcctccaaagcaaaattagatcgttctatttgtgatttgcgccaaagttcgaagcgagctttttccctttttctaaattcttgtaaatcattttcagattgttcgttttttcttttgcgctactgctctgctcttttcctttctctttctctaaaaaccttttcatctatgttttgtgttttagtaaaaacagattgagttgaagattgcaaatcaaatattgattgagcattatccatttcattgtcagaatcatccaattttataacaacattttctgtctcttgaaattccgaccgctttttaaaagagcttgaacctttttatcagcttttaaagggagcgtataaccctttttatcatcaaaatcatttcgtttttcttcctcatggaagttttgttttttgcgccccattttaataagacaataagaaaatataattaattaatatctaaaattaaaaataattaaatatctgatttataaaaataaattgaattagttaatagctgcaattataatagctaaatatgatttaatgatgtattaaatttaacattatattagaaccactctttaggcaaaaactaaataaccaaataaattaggcatactctttcataatttttttttgtttttcttttattttgctcacatctgtttaattgcaaaatcaactggaaacaaagaaaaagaattcgtttcaataaaaagtcgatatgaaaaaggggcggggcgtacgtatgtatacatccaccanaattagtataatggat

SEQ ID NO: 39946 - DNA, 1150 bp, Heterodera glycines
gcaatttgctgcaaatgcagctcccctcgtccaaattcgagctgttgacccaccagttttgccgtactttgttgtgcataaaattttaagtggttcagttttgttcagggataaaaacattgccaatagtctaagcaataacaaatttacactccttgaacttatttgttagctttatttcaaatgccgataatttttttgtttgaaatgtttaatcctaaacccgtagcgaaatccccaaatatggttttttgtgcgggatcccgcaggagccgcccattgtatttttttattcaaagaacattaagccaagtacctattttttgaatacctatgtatttgccataaataaaatttagtcattaatcggcaacccagcagttcttccctcactagcgtgggaagagtatataagtaagaaattgttagggtttcttccatttgccttattctccaatatcagaatttgcctccctatttggctcttccatttgccttattctccaatatcagaatttgcctccctatttggctcttccattgccttattctccaatatcagcacttgcctccctctgccgatattcgtccaaatgcgcgacacggataagaagaagaagaaggaagtaataatgcattatttaccacagtttaacaaaaaaattttcaaatttcaggaaattattgctgctgggacgaacaatgtagtgagcgaacagcagcaggacggagtccccggcgacgaacactcggactcggacaattccactgaagaacgtgcgcagaatggagtgcccggcgacgaacactcggacaatgccactgaagaacgtgcgcagaatggagtgcccggcgacgaacactcggacaatgccactgaagaacgtgcgcagaatggagtccccggcgacgaacactcggactcggacaattccactgaagaacgtgcgcagaatggagtccccggcgacgaacactcggactcggacaattccactgaagaacgtgcgcagaatggagtgcccggcgacgaacacgcggactcggacaattccactgaagaacgtgcgcagaatggagtgcccggcgacgaacactcggacaatgccactgaagaacgtgcgcagaatggagtgcccggcgacgaaca

SEQ ID NO: 39947 - DNA, 1107 bp, Heterodera glycines
agtcagcaatcgttgcttactttgccagatcggacgggtgcgcatgattccactgttccaagcaccccaccaaaagcaaaacgatataacccaaatataaggaaaaatttttaaaaaaatttttctccatcttcctttttgatactaaagcatcagagtgctaaaattgacttgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctattcccgaaggattcggtctccccataaatctgggcgcatcggttcggggggactgcaccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaataaactgactagataatatttaaaataggttatttctcttcctttcagtatccctgcaaagtttggtgcgcttctaatcagtttctgaaaaaaagttaagcctaacatcggttcagggggactgccccgaaaacccaaaaaaaaatttttttgaataaaaattatttaaatgaactgactagataatatttaaaataggttatttctcttcctttcagtatccatgcaaagtttggtgcgcttctgatcagtttctgaaaaaaaagttaagcctaaactttttggcctgtttaaaaaggaattaaaaatttttaaaaattttattcatctccctttttgataatataagagtcaaagtacgttattcatattggaaataaattttggtgcgtttcagagcagtttgtgtaaaaatacttaagaagtaatttagtaaaaaaacatttaaaaatatataaaaaacataaacatgagaagtcatgggagattatgaggaaataagaataataggccctag

SEQ ID NO: 39948 - DNA, 1292 bp, Heterodera glycines
  misc_feature (1240)..(1240): n is a, c, g, or t
aaagtgccgtcgctcaacgctcttgtattttcaacgattgcaatttcaattggtgaaaatggataaagggaataaggaggggagtaggattagggagtaattaagtctggtataaggaacaattagcggggagttaagggggggcggcacaaggcaattgatttgttgcagtatctccaaatgaccataattgatattaattgccttagttattccttttgcgctgcgagttctgtgattctttttagagggtaaattagtctgaggattggaattggcagaattgtactttcatttgtgtcttcaatgaattaaggaattaattgttttttgttttaaggtatacgttgatctggtttccgcggaatagtcccaataaatctcggggccggagggggggggggggtcggggagcaactctacgtaaaattccaaaacagagatagcagttggggaccgtactttctatattcttacagtacatatctaataaaaaatataaaaaaattacatttttcgaaactcaaatttttgcatgaatagaatttgttaccatgttttggagttttaagttgcttttttcaaaaataataaaggatgttgtggtccagctagtccgaatgcgcctcggggaacttttttttaatttggctcaatttacaaaacattttctccaagaaacacgaaattttcttaagtaattattttttcgtgaatgactgctgttgtcccatgttatgtccctgctggacattgattggccatgcatgacgacattctgcacaacgttggcctagacagtcgtgccgcaattccgacaagttcatgccgtcgcacagctgtcatcatttcacttcatttcggattgtgtgtgcctagtttagtcagaaattaaaccgaaaatgacgaaaaaatattgttaagaaattattttaatttttaaaacatgttattgtttaagcgaacattaatatcattaatcaatttaattaaattaaatcattaattatgtaaataattttgacattttaggcacaaaaactcgcaaaaaagcgcctaaaaaggcagaaaaaatcgtaaagcattaaatcggcacaaaattcactgaataagcattaaaaggcaaataattttttttattaaagcctttttaggtagcaaaaacacaaaaaacccaaaattcattcctttgctgggagggtaacaaagttgtgggtcgataaagaacttataaaaacanaatgctttaaatcaatttaaaacaaaacttaaaacttcactgggtaatcaga

SEQ ID NO: 39949 - DNA, 1145 bp, Heterodera glycines
  misc_feature (114)..(114): n is a, c, g, or t
ttatgcggtctcggtcgtggcattttttggtgtacggttttagtcgtagtatttttgatggtacggtcttagtcgtagtatttttgattgtacggtcttagtcgtagcattttnttggtgtacggtcttagtcgtggcattaaatgccacggcgacgactcgtatcgtgctatggatgagttgggtttggatgagttgggtttacccccttaaaagtgacggtttttgaaatttattgatattataaagggggagtctttttcgagatcttttctgattataattcgtgaaaacttattccccggatattttggggcttcctgttcacgaatttgacatcaattttgagcaattcagaaaccaaacacgaaaaagtcgagcattcagttttcgagttcatacttttttgttcaaattctgattaagggattaggaatttgtcaaaattggtgtcacattcgtatcagaaagcccaaaatctctcgggaacaaattttcattactcgatcaaaccaaaagggtcaccattttggtttttaagaaatttcaaaaatcgcaaccacttttaaagtatagccggcattttttcccggagattccaatttcgaatttgcagtgatcaaactctttttatggcaaaactaggaacccggtaagttccaaattcattttgatggaaaaatgcgcaaaaattcaccgcaatgcgtgacacaaaattgccggtcactcgtttttcctcctcggtgcggccaaacaaaatgttcatcgcttttttgatgcgtgtcggccgattgggcggcataatgaacagtttgttgaacttgccggccgcttcgaccagcgcatttgcttttggcggtgttgccattattatggtcaaatgcaaaaatgtttaggtatatgtgttgcagaatttaaaagggaaatgttaaagcggtaaaataagtcaatcgatatgtgtttgcctctcttacgaataaataggtaaacaaaattgagagaggaggagggaaaaatatgaatgatgaaagggaagagagggaaaggggcaatttgtaaggaatgactctgataattagggcgaggatttcggcaatggtatagattattggtcctcgacaaatttaaaaaaaaaaaaatttgag

SEQ ID NO: 39950 - DNA, 1171 bp, Heterodera glycines
gttggaatttgtcatttcctgcaataaatgttttcacattaatgtttaaaaaatttgatcgggtttaggaacattcaacaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaactgactatttagtcaacagaaaataattaaataataaaattagaacaaaaaatgattttattttataatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatacaattgtgctttttgctctctatcaatttattataaaaaaattcacttcccttcgaaattgaaggcagaatgctcatttgaagctacgcaaatataaattaatatttgctataagaagcgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcaccagggatgggccgaggtttcgcttttcgcatttcgcctttcgcattattcgcattttttggcgtttcgcatttcgcttttcgcatttcgctttttggcgcgaaatgcgacttttacacccctaagaattggattaaattcccataaaatttttcaaaattttacctataaattggctaattttcagtgaaaaactgtttataaatgatcaaaatttccaattttttccccggcggcgcctatcggcaccgccgagcccccaaaactcctattttttcttagaaaatggcccaaggaggcaaaatttggtaatttgatgaaaaactgttctcagcg

SEQ ID NO: 39951 - DNA, 879 bp, Heterodera glycines
  misc_feature (827)..(828): n is a, c, g, or t
  misc_feature (852)..(852): n is a, c, g, or t
cgaagggataacagaaatgaaaaaattagagggatttttttaaaaaattctgaaatccgtcccctctgcatctgttggccttatttttctttagtttggctgctgaaatcagttcatccagctatgagcactacaaatatctgaaggtgcgtttctctttctctattttggcgtttcgtttcaattttatctttcaagtcccttaaaaaggttctctgcgatttgctttgcgcacttggccttcatttggccgaagtttggtcctatgtgatgaaacccccgcccaatttttcgctttatcttgcggcactttccgccttctttcggcacccctcaattgtgaattacctcttcaaatttgctttaaaatccttaattttttagtatattcgggccgaaactgcccaagtgctcgccactttttttggccatgaaaggatatcaaaaaacgccgatttccttgtttctatccctccgctcattcacttcttaccaaaggcgatgaataaggtggtctttcatttggtgtgtacattctctacttttgtttggccatcattttcagtcctgctgcacttccgcttctgtggaccaacccgacctgacggagcagtactcgcaaatggactacgaaaacgaaactgagtgccaacgcgaatacattagtaagaccgatgaatttgcatttgttgtcgaaccataaatacacaagggatgcaggggcgtatctagaaaatttttattttttcgggggggggggccctacctgagacattttttttgtttgctcttcaactgaaggcctttttttttgctatttacccaanntaaaatactttttttcccgctgcntggtaaaaatccactttttcactaaaa

SEQ ID NO: 39952 - DNA, 1011 bp, Heterodera glycines
aattattttctatccatttcaaagatttcatcctaccgatgctttctgaaaaatcctcggttgagatgagagggaatcgaattttgagcagtgccgggccaagcactgatcgacgattctcagcggaacattcggtggcattttgacggcacttttcgtcggcccaacggagtgcctaatgatggaaaacaaacaaatcaattaaaatatcaaaaaattaagttaaaattacagctttccaaatttcaaattcattgctgaccaccaattgatcacggtcgaataattcacatagcaaattctgatcaatttgcaagaattcctctgatccgaacaattggcccgcattttgacaaatgtaacgcaaacattgatgcgaaaaattctaagaatgtgtaatattgttaatagtacttattaaagtgcaataattgcttatattcttgctgattttctgaattaagggctgtaaatttttttaaggaatcaaattttaacatcaaatttcataaaattttaaatttttcccctgtagcgcctacaggctcagccgtatcgacaaaccctaattttctaaattttccaccaccctccccttattttaaaatgaattccatttcaaaaacttgggaactctacttaaattagaagataaagaaatcatcgtctttcccacctccaagtcgaaaagacgcgcctgagcaatggccaagaaaacattggacaaatttgaaattggaattttcagacaccgactgatcagccccgaaatgttgtactttctggctaaaaaatattcgatgattaatgctagtagggattcgaaattcgtcgaaaacagtcaaaaattcttgtttggtgcccttgaaaagccaaagaaatatatttttactgactttttttcaagaaagggggggccctaccatcggcagtattagttttgaacgagaaacaccaaatttgaaaatttaattccgacattttactaattcgggtccataatctaatttt

SEQ ID NO: 39953 - DNA, 1498 bp, Heterodera glycines
  misc_feature (1426)..(1427): n is a, c, g, or t
  misc_feature (1458)..(1459): n is a, c, g, or t
cgctccaatgtccgcgggggggccgaagtcggcgcccataagcacttccaaagcgcggtattggcgcgtttgaatattttcagtgtaatgatggaactgaaaatggtggcggagactgatcagccagcaaataaatgccttttgctcaccgtccaacacgcgtttcccaaatcggcaattttcacgttaatttcgctgtttattggacagaaaacactctcttcgcatgccgaagacggcgacgtttgtccgttacgcattggcacccgcgcactctccgccgccatccgtgccacttctcgcgggtcgagcgcaacgagaacattcggaaatggatggaaagtgagagaaagcaaagggaggaggggagggcacctcaggcttaatgtccgtgtgaataatgcggcatttgcagtgcaaataggcgagaccctgaaaaacagaggagaaaggcatttaaaatgtggaagagaaattgacattttgagcttttggcctttgtttttgtttaaataatttgtttattttttattagttaaataataaattgttatcaacgatttaataaggcagatcatcaatttcatataaatattgtggaataaaggaaataaacgaattttcgccacgcattgactcctttttcaagagttaataagaattactttagtttattagtttaattggatttcccaatacttcggttaaacgaaaaggactaatgcaaaaatgaataaacgtacgaattaatgggagaaaaagtgaatttaaagaatgatcaaattgattatcatactaaaaatttgtttcgtcgcgatcgatcaaaagtcgcgtcaccacggttttgtgaacagtgttttgaattggcggatttttgctaaattttaaacttgataaaattatcgtaaattagattttattttattaaaaatgttctgttgcttgttgaccagtcgagagaatataagtcaatttttatattttttgaattgggacatttccaagcaatcattgtcctaaggaattaaaacaaaactagcttattataaaagtaaaagcatttgcacaaatatttttaaaaatgaataataacaaaatttgccctttatataatcaagtataaatgtattaaaataattaattgatttgcttttattcattgattaatcacattcaaatataattagttaaaaattttctgataactataaacacattattaaataaaatgacaatgaaatagctagcctgtgaatttaaaataaaaatttttattcaattttccttcatttcaattttaatttaataaaaattgaacaacaacaagataacattttaggattattgatagaaaaatatctaacataagtccacaaatttgatgttgaaaattatttttattgggatgatagatgaaaaataatannataagtgcgagaaattttattaattcttttnntttgtatgatcaaaatgaaagctgataaacaaaagcgat

SEQ ID NO: 39954 - DNA, 1313 bp, Heterodera glycines
  misc_feature (43)..(43): n is a, c, g, or t
  misc_feature (1256)..(1256): n is a, c, g, or t
  misc_feature (1260)..(1260): n is a, c, g, or t
  misc_feature (1264)..(1264): n is a, c, g, or t
  misc_feature (1290)..(1291): n is a, c, g, or t
caaagattttcaataaaaaatttcaaatgtttattaaatcatntattttctatagggatcggatttatttaatgattttaactgatattagtactgtgctattactctatttatggagacgcacattttcgctaaaacaatataaaaagtagattaagtttcttttataatttatgtttaaaaattcgtatttgaatttttatgttttttggtctttatcgaaaatgagaaaagaaatttttattcgatatttttgtatatgtatccttgtaaatctatcaaagaataagtaaataatattaattaaatattaatattttgggataaagagataaaattataaagataaaaaaaattacaattaattctcttttaaattgaaaaaacttttatattcatattttaaacaaaagaatgttggaaataaatttacaacaataaatcttcacatgtattttaaaataagtgaatcaaaaaatctctaaacgcaacatcgcaatgttggaaaattttattatcaataatgttcgtctttgtagcatggataagttataaatatgtcagataaatgttatcttattatggacaaaatgaatcagaaaaaaataagtttaaaatctaaaaacattactttataaggcaaactttaaaattatttgtaaaattgaaacaatccaaaacgtaaatagaaatattatttatatttaaaaatatacatttttgtgatcttatatcaaattaaacaaaaaataatttattttatttcgaaaaaaaattttaattcacatttctcaattttgcacatcaaaagtcgattttttgtaaagtcacacctttgccacagatggattgaactgctgacgaatcgcaagcctcgacaagaaaaattggagggatttaaaaaagttaatgagtgaaaataagtttaattagataataaatttacatgcaaaattttagatgaattagaaaaacaattttgtaaattgtttaaaacaataataatagtctattctagattaaatataccaaaatcttattttaaaatgttatcacaatataaatattctgtcgtcaaattcgttatttatcagtttaatttacttatagaaaatattttagaatggaaatgataaaatatttgaaatttcataaataatagaaaaataatttaaagaggtgtaatatttatcatgtcagaataatttaaattcgtaattaaaaaatatgcttttaattaactgtgatatatttanatanatanaataattccgttataataatttcccnnaattttaaatcataaatttttg

SEQ ID NO: 39955 - DNA, 860 bp, Heterodera glycines
ttctgagatgcggttggaattcctattactgttgagcagaaaatgagatatccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattctaaatattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattcgagaacaattagtatcggcgtaattattctgagaatgcggttggaattcctattactgctgagcagagaaagagatagccaattttccaaatttttcccacacaaacgcgcagagacacaaattccagaacaattagtatcggcgtaattattctga

SEQ ID NO: 39956 - DNA, 1125 bp, Heterodera glycines
  misc_feature (968)..(968): n is a, c, g, or t
  misc_feature (1030)..(1031): n is a, c, g, or t
tttggtcaaggattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcagatatattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccnattttgcgggtaaaaatgagaaaaagagatagccattttttgggtcagaattttttttgttnngcgtttcaatatcgtaagaatgttttgatagggccagaacagagaagggcaactgttgggtacccaagtttgcgggtaaaaaaatgagaaaaaa

SEQ ID NO: 39957 - DNA, 114 bp, Heterodera glycines
ccggccttcggccgggagaaaatggttttagcaacgaaactccttgtcaatataacatatatagtaactagcgggtgtgcttacatgattctttagtgcttaaagcgcttcgcg

SEQ ID NO: 39958 - DNA, 1551 bp, Heterodera glycines
  misc_feature (1468)..(1468): n is a, c, g, or t
  misc_feature (1498)..(1498): n is a, c, g, or t
ctcacaatttccctcgtcgtcgtccatcgatgcatttggcattatgtcgccctccgtctgtttacgctgtctctctctcttgcgccattttgctctccgattttggaaccaaacctttgaaattaattggccccattaatttgttgcttttcgtatgtctgtcaccttttttgtttctctgtgctccacctgaacccgcgcttccgtcagatcgatgcgcatcgcaatgtcttcacgcatgtaaatgtccgggtagtgcgtctccgtgaaagtgttctccaactcgcgcatttgtgctgaagtgaacgtcgtgcgaatgcgccgctgttttcgtcgctcgttgggatttatacctcgaagcgtttttcggattattggcaaaaaattatttaattaattatttaccggcggagagtgacgccgagcaaagcaacgaatggtcggccgaagggacagaagccgagccgaaactgagcttaatggaggaggacgacggattgtgctgttgtggcggcaatttgtagggcgaaagtgccgaaccgccgataaaaagcgaactcatcgcagcggaagaggaggaagaagaagggacggaagagttggaggaggacgagggattggagttgttgttgtacgggtggaagggaccattcctggagaaaccgaaacagggaaatacaactaatcagaaagaggaaatgattagggagagattgaggagggatcaaagaaagaggagagagagagagaaggaccaactaatcaaggaaagaggggggaggggctgatctgatcatagagagtatccgatcgaaggggaatataaaacgttttaaagcggaggcacaaaggcaccggcggagttcgacggttcgattctccctccccggtttaccattatggccaacctttattttgatcggcaggtcaaatggcttaaagtagagtgcagcgggaccgggacctaaacacggaaactgagtaccgaggtcccggttttgaccgggactagtcccggttttttcccggttttcccaaccaaaaattcccggtttttcaacccgaaaaggtcccagtcccggttaaactcaaaattcccggtccctctgcactctagcttaaaggcttactgatagaaaagtgtagcaaaatggccaataaaattcgatgccaaaaaagagaaactttggcaatcacatttccatgaatcggcacagttttgttgaccttgagttcgttttggttccgccgctcgttgtcccgccaaagtgtccgtattggtgggcgccgtactgtccgtacatcagtcccggtgccgctgcagacattccgtacagtccgttggacgcaaaacccatgaaaggcgtcagcgaagcggcggcagccgctgccaaagaatgtgaaactgaaaattgagaattcggggtgagatcggagaattgctccgtatgcctctgacttgggcggnggaagtgcaaaatggcacagggatcgctgngataaaccccattctttgagtcttcagattttagcatttttttcattatcgga

SEQ ID NO: 39959 - DNA, 1092 bp, Heterodera glycines
tgaccggaaatggagcagtagaaaattcatgtgaatctgtattttttatggaccattagaaactttattaaaaaattgacaaacataggtttttactatttctgtccttttgttatacaatactattctacagcaccttattgcactaatattgctgaccgtctttccaatgacgcattttctacttactgcatctttccactgacgcattttccggcagcaataaaaatgtaattttcattcgcctaaaatagcataaaaaaaaaaaaaatctaattgactatgaaaaattcaaatattttccaccaatccttgtgggtcataaaaactaaattggctctcctaaaagagccaatttatgtgacaaatgccttttttttctgtgacctggttagattgtgttttgctgccattaatcgctttcaaatccttacacattcaaacacatttttcttcaagcaaaaactgattcccagctgcctaatgtatcaccccattagagaaaaaccccgtcattttctttctccctaaaaatttgaaattttggaatgggacaaaaatgggaattgaaaaatttcattgggccaatcactcggcaataattcctcgagaccatttgcttgttagaggtaatcgaaaaatgagttggatactcgagattgtactcccgagacggacggagtgactcagttcaaatgaatcgagcattcgcgagaaaagcattgccaattttacgcattcagttgggccactaagttcgcgttggagactcgaggtcgtactctttgctctaccgacgaattaggagatttcaggaatgacttgaccgcaaaattcgtggatttaattagtatagtgaaaagaaaggaaattggcaaaaaataaatttgatgtaaaaaaaataaatttttagggatgtaaaagtctccagagactcggtacgagacgaccccaaaagacgcgagaattttctcgagccaaaaccggaattcttgaaatgcccaaaggaaataaaaattcactatcattgggtgggaagaggtggaaacgagcatctgtgtgttgggcttacaattaattctccaatttgct

SEQ ID NO: 39960 - DNA, 960 bp, Heterodera glycines
tttttgtagaatttctcattgtacgaattgccattttttacgagttgccattgactcaatttcttgtccattgtaggtgccaaattcattagtaggacttatggtttaggtgtttgcctattttttttctgagctccaggtggcccgaaacgcacaaaatttgattttaaaaataatgtaagtcaatactgattttggcttaattttgtttcatttttctaaaaattttgtcattttacacccctaaactaatgtttttagtgcctaattttgggtttttttagatcctaaagccgacctattttggcagttcttagagcctaaaattgcatcactaatgacaaattcattagactgtccggtcatatcacttttcgtctcacaactccatttaagaagaccaacattctcattccctgtcatttggaaatgatatttggggtttgtttctgaattcatgcacaaatccgtgtaaacactccaacgaaaaaatatatatttaattagcaggtcaaaacagaaattcatttcccaatttaattagatcgatcacttctcaggaattcattcacttctgctgatcacttgggccaagcattgcgtcgagaagcctaaaaaaacaaacagaaaatcaaatattcaaattttcgaatgaactgacccgtccccgacatcctcatcattcatttcaatttcaataaggttccactgatcattaatatgccagccaattgcctccgtttcccattttccccatttgtccgtgtcgcgcacaattggacaacggatcagcagaaaacgacggctattgtttgccctttgcaatgccaattgttcatgagtcaattcgttggtcaaattaaacggcataaaagagtcaacggggtcagcaaaagacggcgaaaaccaaatgacaacaatgaaattggcgggggaagaagcattgacaaacgcctaaaa

SEQ ID NO: 39961 - DNA, 1247 bp, Heterodera glycines
attagtttgtatccgtatcccgtatagcccagcgctttctttatccttaaaacatcaatcctaagtgaacactatattcacctaatatgttatggcggttttgtaaaagctttcaccggttactgtatttgtgactgtaaatacttcggcacctacagaagccaccgcaattaccataattagccgataactaacgctttaaccatttcatcttttaaatggtgttgttttcgtttaacctgttaaacgaattaagaagtgcgtgaacggacactgcaccaggacccgtatttgcgcttggtttaccaactccaaacagcccatctgatcgcattgggcattgaggtgtggtggtgataagaaaacaaacaatgttttttgatcaaagacagaattttttggaaagaaattatgacaatttttggtatttgtgagagtcgaaaatgcttcgaggcaatgatttaattatgggctaatgtcccaatcgtaaggtgctcactctgtacttgggatggcgcgacgtgaactttgtttggctgctgttgccgcttttgttttgcgctggcgcaatttggtaaatttgtcgggcacgcttatttgttaggaaaattttgatgggggccaactcatgaatttggcaaaattggaccgaggagaaaagttaagttcaaataatttttcggtttaatttaaagggaccgaatttcggaatatttgtgcgctagcaggagatatcaaaaatgtttatatatttgtttgctaatttcaatttggaatcattcgaaaattacacgtactttaatagacatcccgaactcaaatagcaattaattatcaatggaagccaagattgatcactatttggtgaagaacaaatagaacaaatgatggggctaaatcggtattagttcagttggtaaagtccgtttaagccagaggctccgcttcaaatccgctcgctcaactgtcttttcccaacagttttatcaacccagtaaaatcaggcacagccttcctaatgcagtttcaaccaaatgatttatttttattttatcgaatccctgaaactccaatgatgatggtccgattttcttctcatttgtcaggattgtctctcagcgatggtaccatcagatggacggacgttcggactttaacaaagtgctgagcgctgacaaaatgccagttcgtgcaaaggccgcttcatgttcgttttagagaggcttctcatcaagctgattatgctt

SEQ ID NO: 39962 - DNA, 960 bp, Heterodera glycines
agaagtattatttaaaatcaaaaataattttagtaaattttttacatttcagttcaaaaaaaacaaacaaaaaaatgttccaattttgaaaatgaaatagtgcacaaaaagggagggatggttagacgaaaagagaaattttaggaagggacgcaccccatctgataattccccttttctgttccataagaggccagaggcgactgtgttcgttgacaagtaattgtccaattaaggtacttggactttccacagtaaaatgtggtacaaattttggaactgttcctcctcacggtgggacttaaaaacatggtaaagccaagttcaaaacttcagagaattatttgttctaaattctacaatttaattacttaaagccaaaagattcgaaacagaagcattatttaaaatcaaaaataattttattaaattttttacatttttgtttcaaaaaaacaacaaaaaaatgttatttgcaagttttggtttgaaaatttgcatggaattccagaattgtttcagaaaaactgccaagggtccaatttccgtttttccctcggggtgcctacgctgaggcaaaatgaatataaataagtttagagaatttacgtcgtcgccgaatcgtccagttggacagttcagtccccgaaggcatttggacatttcagtcccgtgtctgtaactcttcagggattggttgccgcaaaaaattctttcggattcttccattacagaccgagagctatcgattggtatatattttgaccatttaggtctccgggccatatcaccgatatttacctaagagattgaaaggggttgtatccgatcatatgatcttcaaaaaattttgaaaaataataaattttcaaacaacaaattattgatcataatgaaccaaaagacagtgttttcttaattttaatactggttaggacaggtatcagggcttgaaaaaaa

SEQ ID NO: 39963 - DNA, 1405 bp, Heterodera glycines
attcgacgaccccaaacaaaaggaaaacttcacttcgctttttccgccaaatttcaccggacattgtgcggacggactttttaaaatgtttccaaagagtgcgcataatatttgagaagcccgaacatgcgaccggtgagaaaaaagcaaatgggaaaagggacgaaaaggtcggacaaatgagtgatttttggccattcctttcaattggcacacatttcttatcaaaaaacccaaagtccaaatgtattcaaatttagcagccaaattgttggtggaacatcattctttcaacgggacaaaaatgaaggcattcttcgccaagaacatcaaattgacaaggaaggcgcaccaagacgaggccggccatttgacgttgccgcctttggagaaacaatttctcatctcaccgcccagctcaccgcccgtcggatgggtaagaaaaattgctatttccaaaatgttagggtcaaatgcgttttctcaaccagaatttagtatcatggcgcctgatgtaaaagaacccagaattattctgttatatggtgaaatgtttgcttttgcgtttttttttgggtcgtccaatttgatgagaacccacattaattcaaaagctgcctaataattttcacaattttttctgggaaaatggtacacaaaagcaagagcatttccaatgccttttctgttgtttcagattcaacacgctgaaatggcacccgtcgtttgcgatttcgatttaatggcgcgcctcgcgtcgctaactgtggacgaaaaattcgaattgttcgaaggcgacgaacaccaacgacgcccgtccattgttatcactccgtgtgaaaaggggggaggcggaggactactcgcaaaggacggaggccaaatggcaaactcagcggacgaatcggaagcagaaaaacagcgacaggccgaattaaggtcgaaagtgccccttccgcacacgccaagaccaccgactttgaaggaagagtgagtgagtcgaagggcagaaccgaatgaattttggagatcgtattgctatttctcacttcgacacaatttttggttcttttaataagcttcttattttgattagagttaagccccgatactcgggggaaattcctcgacagaatttgtcgaggatggcggagaaatttaaacaaaaatgtcggggagtaatactcttcggggtaaattttcaacgaaacattgagtcaggcttaactctattttgaaccgcaaaatatttattcatttttgtttgtgcatcatctaagtcagttctgaaaccgggctgtccaaactttgttagctagtcattgtcggcatgtaatgtgctcaacgacatttataatttttgtatcctttcaatttttaatgattaattgttctaatatgtgca

SEQ ID NO: 39964 - DNA, 654 bp, Heterodera glycines
ttttttttagagaaaatcggcaagtccactggaaagagcacaaaattctctactgatttaacttttgaataacggggctacgacttctacataaaaagctatacttagttgaatatttgaccaccataaaaatgaacaatttttgatctgcgccgtaactttttcaaaaagcatccaaattaaacaattttggtatcttttgatagccctaagtgtcctctatttacctgtaaaattcaaaaaattcggttgtgtttcaaaaaggttgtggctagtattttcataaatttatttggtaaacctttttgaccacaacttctttgaaactcaaaggaattttttgaattttaaaggcaaatagaggaaactttaggctatcaaatggtaccaagattgtttaatttggatgcttctagagaaagttatggtgcatgaaatttatcaaaatataacattgtcgtgtcttttttcgtggtcgtgtaaactgaaatagagccaaaaatatttattgttcttattagcttattattaaattataaatttaaaataattaattaatcattagaataactcttccgtactgaaatgacccgccccctctgatcactactcatttgcctttttgtcacttcgacacagcacctctaagttcaa

SEQ ID NO: 39965 - DNA, 753 bp, Heterodera glycines
gattaaattaattgttgattggataatttaagaaggattttgttttagttttttaaaatatttaattttttagtcactgaaaatattttcccgttttgtgcctggccaattttaaataaaatttctgcccgaccattttccgtaaaaataacaaagaaaaaattttgattaatttttgtataaaaaaaaattcgtctcgtctcgtgtctcgtattttatttccgtctcgtttttctcgtgtctcgtgtctcgtattttattttcctacttgcaacatccctgctgtacatgctggacgagtacggtagacggcttggtgccccgcccttcagagtggatcagatcaaaggaagcgaagccggcggttggtgggacaccaacttttggccattgttcccggaagtctgtgactttataattaacttttggccattgttcccggaagtctgtgactttataattaacttttggacattgttcccggaagtctgtgactttataattaacttttggacattgttcccggaagtgggtgcctttggaattcgaatattttccaactttggcacttttaggcattacgccaatccgaaattcgttggttttggttgcttttccttctccttttgctgttggctctgattctgctcgtccttttctgtgccattcgaatgcaaaacaaaaaacggcgccattctttgggctatcagttgggacaacggacgaaagaaaatggcaaaaaatgagtgaaaa

SEQ ID NO: 39966 - DNA, 999 bp, Heterodera glycines
  misc_feature (13)..(13): n is a, c, g, or t
attgtgcatgtantgtatggggaagtaatcggaaattagctacttttcatcaatttgtcgaattgtttggggagataatgggtgaatttcatcttggattaaaaaattgctagttttttggttctgattctgtgaattggtgcaattttgtaatttcaaaagccaataggacgggagaacctctaaaaggatggccattagctcggtcaggtgattaaagattcatggtttggaatttttgtttgtcaacaaaatccaacattattggtatcattcgatagcctaaggtcaatttggaacaaacttatggccaaaagtacataagaaaaaaggttttcagtcatttttggctataactttttttgagccttaacgaattttagaaattttcaagctaataaaagacacttagggttaccgaatgatatcaacaatattggattttgttgaaaagaaaaaaagttatatctgggactggggccaaaatgagcgagtccgaaaacgtaccttttaaaaaaattcggaactcgaaactgaaaaaaccgacaattccatactgtgttttacggtcccgagctatctgaactttttctcttctttttataatttttgttctttttctctcgctctcttttttctttctctctctttttctttcattctctctttttctttcgctctcattctccctttttctctctctcgctgcgctgcatcttaaccaatcgacacaaaacgacgcggtcccatcgcatcattgtcattttccccagcacatcattggcatttatttctccatcaaatgcccctccctccccctaattccattttcgttttcctcttttgcatataacctcaatttttcttcattgttttaaataattaatttaattttccaataaaagttagaaaagcacataaatattataaaaatgcattcaaaattttcaaaaataatttttgcaattgtaatcaacgaaaaaatttttgctagtgata

SEQ ID NO: 39967 - DNA, 976 bp, Heterodera glycines
  misc_feature (9)..(9): n is a, c, g, or t
atgcaaaancggaaaaacaagtttacatacatattttgccaaatgtacaaaaatatttacaaaaatagcgccaaatttttgcagtttattgcttaagtgattcaagaattaccagaaaggaataagacacaccatcaaaaacatttttagatttatattaagacccggaatttttttttacaaaaaatttaaatgcaaaaaatattttaatgaatgaaaaaaaaattcaaaaaattttctgagagtaaatgctgaatttattctgtgaatatgaccaattcttaattagaaatagattatttacaaaagattgaaatttacttttcttcttttttgtttgcctcaattttccaaaaattttccattttggtattaaatttaaatacaaatatgcaaattttgttgagtcttgcccccccccctgcgcccccttaagtttctttaaaagttttccgcctctcaacgaggggtcgccacatttgtggacaaagaaagcgttatggccctgtccttggccatcaccaaaatgttcgccaacaaatttattcatccaaactaaatattccactatttcaattgtaattgtttttaaattttgaagagcattttatttatggcaaacccattgaattctataattttggcattcaaatgtttacacccttttaagaccaattttcttaattattttgttcaatttttaaaaatttttttatttatgtttattttgccttctgaatgtacttcaatgtttaggatgcaaattttatttattttattaaatttaattaaaaaaaaacattctttaaatttttaattattattttttaattaattttaaaaatataaaaaacattttttaaatttattttttgaaatatttaaaacctcatataagcaagctattttaatctgaaatataaaaataaaaccattttaggatctggcttttttaataataattttaaatgaattt

SEQ ID NO: 39968 - DNA, 978 bp, Heterodera glycines
cgatgaaactttttaaatataagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtattaaaaatttttagattttttattcatctccctttttgatattgaaagcatctgagtgcctaaaataacttgtaaataaaatttgatgcgtttcagagcagtttctgaaaaaatatttatgaattaattttgctaaaaaaataaaatagtgaagctttaaaaattaataaaaaattttaaattcagaattactggagttagcatcatagcagttaaaaattttttgatttttattcatctccctttttgatagtgaaagcatctgagtgcctaaaataacttgcaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgataagtttataaaaaaaagttaagcctaaaatttttcgcatatttaaaaagcaattaaaaatttttagattttttattcatctccctttttgatattgaaagcatctgagtgcctaaaataacttgtaattaaaatttgatgcgtttcagagcagtttctgaaaaaatatttatgaattaattttgctaaaaaaataaaatagtgaagctttaaaaattaataaaaaattttaaattcagaattactggtgttagcatcatagcagtgcttttccttgtctttttgatgctctcgcaaaatctgggtcgcttctgatcag

SEQ ID NO: 39969 - DNA, 878 bp, Heterodera glycines
  misc_feature (98)..(98): n is a, c, g, or t
  misc_feature (116)..(116): n is a, c, g, or t
ctttgaataattttttccgaaaaaacaccaaaaattcttctgggttggacttcgagtaattttttatttcgggtttcttatagggaggagagcgaggnaactgcttttaaaaaggnatttaagccaatttttcaaaatattttttgccccttccccgaaatttcttttttaattttttacacataaaaaatttcatattgttagaaaaatttttttagcgttttcaaagtttaatgatgaattagttttttgaaaaaaattttccaaaaattgctaaaaaaaatcaaaaatttttctattttttacccatttataaattttttaaaaaattttcaatttccttcctttatctactgtttgtttgttttagtgttgtccccctcccgtgttgttgcttctgttgttgctcctcttccgtcctcctccaacttctcttcctcctctattccatgttcgtcatcgtcaccttcatcttcatcatccgttttccatgcacttcgttcactgtcctcctccacctccacctttgacaataataatgtgccgtcactggacgaattgaagtgcaaaaatgcggcacaaattgagcagctcagtgtggcgatcaccaatcactgtgccaacagttttgagcggaacaaagaggttggctggctgggggatagacttaaatacggattcggattacggcattttagacaccacccctattctagcggattatgacggcgaatttttaaaagttctggagtcacaaattagtcactgatcaagaatataacaccaattccgaatctcggactcgaacccaaaaaagttgagaaaataaaaatttgcgaaaattcgttaccacccccttttttaaaaaaatcgatttg

SEQ ID NO: 39970 - DNA, 1015 bp, Heterodera glycines
ctttatgatagcattagtttacacataaaaatacaacttctaaaatttcattctcaacttgaacaaaaggctatttcaatttggaaaaaattcaatttttaaatatatacaaaaatatgatgttaatccctttgaaataccgaatttagtctttgaaaacaaatgctatcataatgaccaagaaaaatgtgaattatttgccaatttatttgtaaattcatttaacaattctgaagttgatccaggctttctaagcttggacaacacttttgttaatcaaagctttatatcagatatagaatttaacatcattgagacccaaaaacttttaagaaaacttccgaataaaaatggaacttctccggataatattagctataaaacattgaaaaattgccatccttcattagcaactgttattactgaccttttcaggatttcattagactctggttctcttccagatatctggaaggaatcaattgtttttccccttttcaaaaaaggggataaatttaattctgaaaattataggcctatttctctaacctgctcactttgcagggttatggagagaattcttagcaaaaatatttacaattatctactaaaaaagaataaaatttcggaatatcaatttggttttgttagaaataggtctacaacaagtcaattaataacagttgtggaagattggtatgatgcaattattaatggaaaaaatgtggactgtatttatattgatttccagaaagcttttgactcagtgccccataacttacttttatacaaattggaaaaaattggtatacggggcaaacttttaatgtggataaaaagctttttgagtaataggacttttcatgttaaaattggggatgctttatcctcaaataaaaaagttgactctggtgtcccccagggctctgtcctgggccctttattatttttggtctatattaacgatcttcctggatgcttgccatcaggagtgaaaataaattatatgctgatg

SEQ ID NO: 39971 - DNA, 1197 bp, Heterodera glycines
ttagtaaaaatgaaattttaaagttttcattttcaatttttttcattttccattacggtggtttagttatcgacagttggttccgttcaaaagattctccgagtgccgatattaaaggcgatttaccaattttcgctttttttaagccctttcgcttttgttgcttttttgggttgcttttgcttctttttttgcaaaaatttaccatttttttatttttcattattttttagcacgccgtggccccgtttcgctggtgctcgacgaaagttgcaccactgcgatggaaacgccaaacaaactcaacgcttccgacatgttcgcctctttcagcgctccttttaatggttgccattgggtttttcaaattacactcatttatcttttttagacacaataaattctacggcacgtaaaatcgaatgcagcgattcgacgcgaagtgttcggccatgcgactcggcaaactttgaggtggaatatttcgtggcgtcggatgcgaggtgaacattttgttgattccaattgcaacactcttttctccccctctctctttctctctcctctctctctttccttttctctctctctctctctctctcacacactccacttttctttcatctcttccccactctctgtcccatttattttctgtaaattcagcgccgtcattgagcacacgcgtcaggtgatctttctggaggacgacgacgtcgcatttgtcgaggacggcgctttgtccatccatcgcatcaaacgcagcgacgacaccgctgctttgacagaacagacgcgagaagtgcaacggttgaccatggaactgcagcagatcatgcgcggcgatttcaagacgttcatgcagaaggagattttcgagcagcccgactcagtggtgaacacaatgcgtggccgtgtgcacgaggacggacgcattgtgctgggagggatcaaagtgagtggcgacggtgagagacgcgtaaacaatgcccaccaccgatgtcaaggagtacacgaacgaccttcgccgttgccgtcgtctgatcatgatcgcctgcggcacttcgtaccattcggcattggcttgtcgtcagctgatggaggaactgaccgagctgccggtggtggtcgagttggccagcgacttcatcgatcgtgaaaggcccatctttcgtgacgatgtctgcttttttatca

SEQ ID NO: 39972 - DNA, 876 bp, Heterodera glycines
  misc_feature (10)..(10): n is a, c, g, or t
ttattttaanttcattttttcgtcaaaaaaactaaaaattgttccttgtattaaaaatttcacattgcccatataaattaatgaataaactagagaccgagatttccaaaaatgcggatcggaccgggctgatattttcagaagcaacgggtttccgggcccggcctctcaaaaaccggtcaaaccggatttttccaaaaatcaccgggccggtttgccgggcccggctcaaaaccggtctctagaataaaccttgaaaaagatcattttcctatgtaccaacgcgaaactttacaccgaatgtaaatttgaactgaactttttttgtcaacaatttatacataaagaatttacaaaaaaaaacaggaaatatgaaataaactattgaaaaacggatagaatcactcatctaatacccaaatagaaaatagaaaaagcatatggaaaaactaaaagaaaatctctctttgatcagtgcggcacattgtatgatgtcacaaccgcgatcagcagcagcggacacaccgcaatcattcttaaagaaataaaatttacattttttaaaattttattttagcgaaatttcggcattttttaaaccctcagggcacaaaccaccccagatatatttgagtcaccctaaaattcgtatataggccttactcgtactaaaatgcctgtttttttatcttcccctaaatctcatctatttggactgcgtgctgaatgggatagaaaatttgaaacagataaatgattttttcccctatttttatgaaaaaaatgattaatttttgaacaaaccaagttctttgaatgcattcaaaattgtttaattcagggactcgtttgaaggaaatgaaacgacatgactaa

SEQ ID NO: 39973 - DNA, 874 bp, Heterodera glycines
ggccaaaccaaataaaatttacaatattctccagaattttcccttcaaaatgagcataaaatggttttatttgctctagtattcaccaagttataagctaaaaaaatttcataaaattgtcgatgttgtacgtaactaacgcttttcgaatatgattttttattgccacgaaaacttttattaatgaaaaaataattctgccttcttctttaaaagaagaaattgaaattaacacacaacatagggaggacttgaacctgggaccccccttttggtgactaactcacagaccactaagacgaaaaagccagcataattgtacttggagcccaaaattgggccgctgtgtatagaaccctttgctaaaatcgatttactaaattttgttttaatttttgtgcgtcttcggtgaacctcctgccggtaatcgccattcagtgcagcaatgatcactgttttgccagtgtttgccaattcttgcgcgtatttgacgatgtctttgaactaacacaaatggaaatgccaaatgtgataaattaacggagggaaaaagcccacaaattggccctcgtcgatgccaatgacatcgaatttgttcagttcctcgaatgcgtcttccattttcgtcgcactaatcgcctccattttgcgtttgtcgtgtgtgcatgcgtgcgactcgtcgtaacgcgtgtcgagcgcatatttaaccactgcgactttccgtccggcaagaatgtaccgctgagccaatcggaacaattcagtcctgggaatatcattgttaggagggagagaaaccaaaataattttgtatccaattacaattactcacgtttttccgctgaacatgggtccttaaattaaaatattgaag

SEQ ID NO: 39974 - DNA, 1273 bp, Heterodera glycines
  misc_feature (1233)..(1233): n is a, c, g, or t
cgtaaatttatcttaaacttaacaatatcgttaatctttgcgtttgtttagcgaaacaaaaaatgcgttgaatttgctgaaaagtgccagtggcccgtcgagagaaaaagtgaaacaaattgctgccaaatttccttacgaatttgtaaaacatttgaatgggtttggcgttgactccaagggttcgttggtaaacgacgcgtcatcgccttcttttccgcatttggacatcggatcagtgaacaacgacacatatttggtgcagggaaccaataaatcaagacaaattgaatttgtttgtgccgttcagataaaactccaccgaaaagtaattatggccgcacaaaactattgccattgtcaagcgcaatggcattcgctggtcgaattggccttttatttggaggacgtcgaagttgccgcgcaaagcggcactttgcccgcgcgatgggtccaactgggtgtgaacggagtgaatcgcaatacggcgaaacccgcattttctcttttccgcgaccatttcgaagtgttcaccaaacttcgattcctttggtttgttacgctgcgtcggccttttgttcaggtgttttctgttgttaatttgtttgcaacatccacatgagacacagtccaaaaaatcttttttaatatgccataatattaaactgttccttttagtgtttggccgtgtgtttcgccgtaatgaccgccctcattttgtggagcgagtgcacttttttcattgtcagtccccaattgtcgttggccgcgcgaattttgcacggtgccgcccgtggatatcactacaaattcatccaagtcggaatttttcatttgccctttttcaatatattatcagtcctatcaaaaatcgttatttttttttatcgtagattacaacattttacgaggggaaaaataatcatttttgcttttcacccaaagaaaaaaattttccattaaaaccaccatgaatttcactacaatttcccattatatttcagttgtatgctgttgcgatgattctgtacctttgtatttgtgcttattacaccattttccaactccgaatttttcgatattatcgactcgattccaatcaaatgacaggcgaaaattcgctcattttttctgcaatgtttttccaaatggatttcgcgttttacccgagtttcttttcccatttcaggcttatttgccgtctcactgctccgctgtgtctgaatttcttgnaatgattcatttggattcgcatggtaccgccaacagaggc

SEQ ID NO: 39975 - DNA, 531 bp, Heterodera glycines
ctaaaaatatttcaaaattttgcatcatttaagctgattgtaaattttcttgcttcccatcacaatgctcgcggcattttgttcgacaggatcagctgctggcaatcgaattttaataaatgcaccaatttttcgtcgattgaatgtgagggagaagtggtgttttgaaaattttttctctttttatggtctaatttttttctcttttttttacacataatgatgaataccctgaggtttttgaagccgctgatcatgaatatatgacaattatttgcgcctattctggaccccgaacccaaattcgaacaaaaattcgaatttttgaaaattttcttttatgttagaatctgaacaaaatgatcattttttgatgtttcaatgatttgtgactacttttattttttaaatcaatttttggcaatagtgagaattttaaaaaatttgaatttcgactttttgttcgaattggggtttgggatcccgaattggtcgaaaaggatgccatattcatgatcatcgacctagaaa

SEQ ID NO: 39976 - DNA, 1125 bp, Heterodera glycines
  misc_feature (970)..(970): n is a, c, g, or t
  misc_feature (1100)..(1100): n is a, c, g, or t
ttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggatatctctttttttgataaattttatacacatacaaatgctctcgagcatgatagggagggcggtgcgcaatagaccttttatttttgagggaatttttaaatttatactctatcccagaaaatgtctatctctttttttgagaaattttatacctcacaaaagcgcttgcgtatgagacggagggctgtgcacaatcgccattttatttcacagaggatttttatatttagaggttatcccagaaaaatggatatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggatatctctttttttgataaattttatacacatacaaatgctctcgagcatgatnagggagggcggtgcgcaatagaccttttatttttgagggaattttaaaatttatactctatcccagaaaatggctatctctttttttgagaaattttatacctcacaaaagcgcttgcgtatgagacggnagggctgtgcacaatcgccatttta

SEQ ID NO: 39977 - DNA, 974 bp, Heterodera glycines
catatttttaatataaaagcaataattaaatagcttatagtgtaatttattacatatttggttttataatcattagcgttgtgcgtttgtatgcttaaaaaatgccaaaattataaaaaatatgccccaaaaatttaaaaaatggatttaaacaaaaaaactgcagctgtataaattcaaaattgacctgaataaaaaaatcacaaaaatttttttattttataaattaacgtatgaaaagtttgaatgtttttaaatttgtatttaattatctggcaaatgcaattatattgccaaattgagaaagactttcttccgttaaataattttacgagttttttggagcagatttttgaaaattccataacccgaacgaatggaggggcaccgtatccaaaccgaatcgagaaatttcaagttttccattttaaagtttcggtttaccgaccccttgaccggtctatattattaatgacactaattaattataggaaatgtgttattatgctatatctttttattttatcaacgttatagttcatttttttattgcaatttcaagtgcaacgtcaccggtgagttgtttttttactttgccataattccccatttaaatttaataggttgaggacaatgcactgcttgcatttatgaaaagctatggtttgcacaagcagaatgaaattcagaccggtgaatattcggcgcaaaaatacgaagcacaccttggcattgtttattttatgagagagaattggcaatgtgccaaaatttgggacaaatttgacgaatttgaacagggagaatgccaaaaatatcgcaaatatttggagattttgtatgaatatttgttcaccgagtacattggaatgcccgcagtgaagcgaaaatttgtgtttgaaaaattcaaatttgaaattgaaggcccgataatttatgcggtgaattgcctggccaaaatttcatggtttttt

SEQ ID NO: 39978 - DNA, 1006 bp, Heterodera glycines
aaaaaatccccgaaggagagaatttaattaaatccctttcttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaatttaagtacaggctatagggaagctattcccgaaggattcggtctccccctaaatctgggcgcatcgggttcggggggactgcccccgaaaacaaaaa

SEQ ID NO: 39979 - DNA, 662 bp, Heterodera glycines
tttgacgcctccctaccatccgatgagtaatggagaagccgaaaggtttgtacaaaccttcaagcacaagatgcagcgtcaaaaggatggaggagtgccatgtgaggaggctttacaccaggttttgggactttacagagtgacaccccacccagcaacaaattcatcaccagctgaaaagctattcggtcgcaaattgcgtaccatgttggatttggttcgggtttgggatcacaagataattcgtgggttatgtttagggatattaaaagggcatgttctcaaaaacattgaaatttaaccaattccaaaaatcgcccgaaatgtctgtccggaaaattattcgaataatataattattttaattggtaaattacttttcacctgcctataaattaaatattttaaattttcataattatcaaaaacaatttttagaatataatgaaaccaaaaacccatgtttcacccattcagtctattccaaatttatttttataatttttattttacattttattttaaaagacacaaaacatattacttacaaattatttattatatgatggatattctagctaattgcagataatttgcttatacgcaatataaaaaaaatttgagaatatttttccattttagtgcctgttttgagggttttt

SEQ ID NO: 39980 - DNA, 1628 bp, Heterodera glycines
gtcaaaagaggaaaggaaattgctcctttttcattcgatgttgcgattagacgagaacaaacagacgacgaatcgttttctattcgcgagcaaagaaacattttggaaacaatggaagagaatttacagcaacagttgggaggagccatgattctgaaagttgacaacattttttacgatggcatcggaggaattttaatactccgtgtgaaaattgcccgttttataagtacaacgattaagcataaaacacaaatccaaaactttttttagattttggcaggatggaaaaaataatgattgaatcgaaaatggtatcgattctccaaaacaatgaaacttttctggaacggtttaacgttgtttccatatctccaacaagttggttgatcgatttttttttgtttaaaactgcttattttttaagctgtctgttatgtatgtgaaaacgacacactttcgacatccgattttttcggcacaattttttcatttattgacggaaaaaactgtaaagaatcgtttacacttttaacttaaaagcacaatttagcgtggggcgtattttgcgcttgtgtttcaattgttgccgttttcgtgttatttttcaaaggcctccctttcttttggcaattccaagaaggagaaaggaaaatgacagaaaaattggaacaaactttttgtgcgattggttggacatttgcgacgtgcaatgggcgattcagcccaattccatcgctacggaaacccaaagacaatttggtgaacaaaaccctaatggacggtgagtgtttctttcggggggtttaatatgacctgaataatacaagattcggaaacattgttggacaacgaattgtctgacagtgcgagtaattacgaagaggaggagggggaagagattcacccgacaaaacgcatcaaattgtacttcgattctcctgacacccaaacggggcgacattcaacagaatgaacaacagattttcttaccattttcccggtcattttgctggtctcgatgatttactgaagataatgatctcatttccttccaattattgaatgtgaaccttttttgttgttgctgtaatttacagattaatttcctatctgattaatgatgatttaatcagttcgaaccgtaaaatattttttacatttaattaatccctttaatttttgttagtttttttaatatattttttcatggattcatttctaccaaaacccgaggatcattgtcgcattcaaatccttgtaggtatttcccctatatttattttttatgcgtactttttaggtgaaaccgttgggaaatttcagtgtgttgtcttttggtcgccttgtcaaagcattggagcggcggtttacttctgttcatggtgaaatcccatggaaccccaacaagaaaatcctttataatttgttttgagattttgctcttctaaaaagttaaattttcttccaataatttccgtcgttttcagtgtcttccaatgtcaattcgcaacgccaaattctgcctaaattggtcacggagttggatttggaattgaccaggtttggcgagtttcaggttagaaaagtgctcttttattatggtaaatatccccagtatttgaagg

SEQ ID NO: 39981 - DNA, 1378 bp, Heterodera glycines
  misc_feature (83)..(84): n is a, c, g, or t
  misc_feature (87)..(87): n is a, c, g, or t
  misc_feature (98)..(100): n is a, c, g, or t
  misc_feature (103)..(103): n is a, c, g, or t
  misc_feature (106)..(106): n is a, c, g, or t
  misc_feature (109)..(109): n is a, c, g, or t
  misc_feature (112)..(112): n is a, c, g, or t
  misc_feature (128)..(128): n is a, c, g, or t
  misc_feature (130)..(130): n is a, c, g, or t
  misc_feature (134)..(134): n is a, c, g, or t
  misc_feature (153)..(153): n is a, c, g, or t
  misc_feature (167)..(167): n is a, c, g, or t
  misc_feature (169)..(169): n is a, c, g, or t
  misc_feature (181)..(181): n is a, c, g, or t
  misc_feature (184)..(184): n is a, c, g, or t
  misc_feature (187)..(187): n is a, c, g, or t
  misc_feature (192)..(192): n is a, c, g, or t
  misc_feature (195)..(195): n is a, c, g, or t
  misc_feature (197)..(198): n is a, c, g, or t
  misc_feature (200)..(201): n is a, c, g, or t
  misc_feature (203)..(203): n is a, c, g, or t
  misc_feature (210)..(210): n is a, c, g, or t
  misc_feature (215)..(216): n is a, c, g, or t
  misc_feature (234)..(234): n is a, c, g, or t
  misc_feature (242)..(243): n is a, c, g, or t
  misc_feature (253)..(254): n is a, c, g, or t
  misc_feature (260)..(260): n is a, c, g, or t
  misc_feature (276)..(276): n is a, c, g, or t
  misc_feature (285)..(287): n is a, c, g, or t
  misc_feature (294)..(296): n is a, c, g, or t
  misc_feature (299)..(300): n is a, c, g, or t
  misc_feature (331)..(331): n is a, c, g, or t
  misc_feature (353)..(353): n is a, c, g, or t
  misc_feature (355)..(355): n is a, c, g, or t
  misc_feature (366)..(366): n is a, c, g, or t
  misc_feature (379)..(379): n is a, c, g, or t
  misc_feature (384)..(385): n is a, c, g, or t
  misc_feature (398)..(398): n is a, c, g, or t
  misc_feature (407)..(407): n is a, c, g, or t
  misc_feature (418)..(418): n is a, c, g, or t
  misc_feature (424)..(424): n is a, c, g, or t
  misc_feature (426)..(426): n is a, c, g, or t
  misc_feature (434)..(434): n is a, c, g, or t
  misc_feature (436)..(437): n is a, c, g, or t
  misc_feature (439)..(439): n is a, c, g, or t
  misc_feature (445)..(445): n is a, c, g, or t
  misc_feature (450)..(450): n is a, c, g, or t
  misc_feature (452)..(452): n is a, c, g, or t
  misc_feature (454)..(454): n is a, c, g, or t
  misc_feature (456)..(457): n is a, c, g, or t
  misc_feature (459)..(459): n is a, c, g, or t
  misc_feature (461)..(461): n is a, c, g, or t
  misc_feature (466)..(466): n is a, c, g, or t
  misc_feature (472)..(472): n is a, c, g, or t
  misc_feature (475)..(476): n is a, c, g, or t
  misc_feature (481)..(481): n is a, c, g, or t
  misc_feature (487)..(487): n is a, c, g, or t
  misc_feature (493)..(493): n is a, c, g, or t
  misc_feature (495)..(495): n is a, c, g, or t
  misc_feature (498)..(499): n is a, c, g, or t
  misc_feature (501)..(501): n is a, c, g, or t
  misc_feature (508)..(508): n is a, c, g, or t
  misc_feature (511)..(511): n is a, c, g, or t
  misc_feature (514)..(514): n is a, c, g, or t
  misc_feature (523)..(523): n is a, c, g, or t
  misc_feature (525)..(526): n is a, c, g, or t
  misc_feature (534)..(534): n is a, c, g, or t
  misc_feature (537)..(537): n is a, c, g, or t
  misc_feature (541)..(541): n is a, c, g, or t
  misc_feature (544)..(545): n is a, c, g, or t
  misc_feature (548)..(548): n is a, c, g, or t
  misc_feature (550)..(550): n is a, c, g, or t
  misc_feature (552)..(552): n is a, c, g, or t
  misc_feature (557)..(558): n is a, c, g, or t
  misc_feature (572)..(573): n is a, c, g, or t
  misc_feature (575)..(576): n is a, c, g, or t
  misc_feature (579)..(579): n is a, c, g, or t
  misc_feature (581)..(581): n is a, c, g, or t
  misc_feature (586)..(587): n is a, c, g, or t
  misc_feature (589)..(590): n is a, c, g, or t
  misc_feature (592)..(592): n is a, c, g, or t
  misc_feature (594)..(594): n is a, c, g, or t
  misc_feature (598)..(598): n is a, c, g, or t
  misc_feature (605)..(606): n is a, c, g, or t
  misc_feature (611)..(611): n is a, c, g, or t
  misc_feature (617)..(617): n is a, c, g, or t
acaaattttctataatttacggccgctccccctaggctttttttttgaatttttcaattaattatatcctttaatgatatccnntanaaagggtttgnnnatnagnagnagnagaagagttaaggttngntgtnggatttctcacgaaatggngatttgaaatatgngnagaatggagaantgnganagaanggnannanngntggaggnggtgnnaatgtgaaggtaattganaagaaatnngatttttgannatgatnatagggttgttaaagnttaaatgannntttttannnaannaaattttttttttgaaaaattttatattttngtagaatttttttgaaaaaatntnaatttttaaantttagttagggangatgnnggggattggtgtntttggtggnatttttaaatngttttntntaagggananngngtgganaaagngnantnnangngtgangtgttntannggganagtganggaggngnggnngngatgaanggnggnggaggtggnanntattaatnaanattnaanngangngnggaannatttgtggagtttnngnntangnttganngnngntnggantgggggnnggaancgtcgncgcaccgtcgggccgccggcgccgccgccgcggacgaattcagcagcggagtaggagccgctgccggtggtgtccatgcactgcaaaaggcacgctcgtacaccgactgggaggagggcacgccgcgccgcggcggcgggcccattgtcgggcacgcgaatgtgtaggctttctctctcctctctctctctcctttcactctcctctttctctcccctcccttctttctctctctctatctcactctctcactccctctctctctctcatctctctctccctttccggcactctctctcttcaggagtgatcactgatcactacattacagtatgccacaatcagatacgatgacgacatggcgcgcttggagagcgagttccgcgacgcgcgactgatgcggataccgggcaacatggacgagaaggagcagtaccaccgcgagattccgggcggctatgagacgtactcgcgcgagacgaaggcgcacgcggaccatcgcaaattggacgggggcgaccacgcggcacacccgggcgacttcaggtcgacaaaatcaaatcagatgccccaggggaaatccgacacaaaaaattattaaaattattatttttgggatatgaaaaaaaaagattttgctaaaaaattaattgaaaaaatccttaaaattgttgaaatgtctatccttgttttaaaaatagagattaaaattttttaattatcagaattttaagaaaagatttataaaaaataaataataa

SEQ ID NO: 39982 - DNA, 672 bp, Heterodera glycines
tgatgggcccaaattgtgcgagtgggaaacggcccttccatggccaacggcataatcattagcatccttctcaaacgttacggcattcaaaatgagcaatgaaacggcttcacagcagatgttgtgcagcaataaaagaatgaggaaaatgcgtgccatttttgttgtcaaaaaattccttacaaaaatttaatggacaccaataaaattttgcaaaaaaggataaattaattaaattaaaatcctgcgaaagatttttgtgtcccattgatttattacgttttctatcaattataaattggttgattaatttgctgtgcaataaaaatataagccatcattagcatatttatttttgccctttctgtgttgtacataaaacatcatcatcatcatcatctgagcataagcaaatagtaatgaaattatttaaatttatttattttaaacatcaaaattaatattatttaatttgcccatttctctgcccacagaatggagcagcaatagaaatgaatcacgaaaaaaaatctaaaaccaagaagattgcttagagatcttttgattctaaatgattatctggtttaaacttttattatattttggccgcaattcttttttccatttccaaaacgtaatttcagaaataaccaattccttcgctaattcttt

SEQ ID NO: 39983 - DNA, 846 bp, Heterodera glycines
ggggactctaagcatttattgttatcggtccaattataggcgaagtcagcttcggcgggagaattgcgaacgatgcgcggccagccgacagaacaaatgaaaatgaccgttttctaccgatattgggtgagttatattcggacaaacagcaaggagtatgagaaacaaacaaaggccgtattaatgacttttacccacattgtggaattttgacttttggttgtgtgcccgcatattaatattttttaaaaaggtacaaaaagggcgttggctgtgtaaaaaagggaatgttttggaccctttttgagttaaactaaaaataaaaatgttttattgtgagttgcaattcgcccgttttggatatgccaaaatggaagccatattcatgaaaacccataggaacacgttgtccaaaccattaaaaccaaaacctgagttcgctaaagattcgatggcaaaaattcattcattatttgatactttagtgtctgaaagaagccattatgaaggcgacagggcatggactcgtgaacgacttgagccgttttgatttcatcatcgatccaaatgaacgttataagcaaggtaagaaaagggaatgggcgactgaccaacgaaaagcgctttgcttaaaggcagtttcatcacatctacgaccttcacggaggacgcaattaagcagccccaatgggttttcgaagaatcatttgttgatgcgaatcacgtagccgcggtttgcagagaggtgatttaaaataaaatcattggaaccaaaataaacgaaaaaaatattttcagaaagctcatcccgcggtctgtacgtttaggaaagagcagtgcgcgaaa

SEQ ID NO: 39984 - DNA, 993 bp, Heterodera glycines
  misc_feature (898)..(898): n is a, c, g, or t
  misc_feature (912)..(912): n is a, c, g, or t
ttgcggttttgtaaaatgaaaaatttttactctgatgcatctaacggatctcccgcggattttcgagctcatggattacgaatttgacatacaaatctaccaattttgaattcctttacgaaatttgaatcaaaagtctaaaattccaaatatttatttttgaccatttgttcgaattcgggttcaaattgggatttttcaacacccttattcaattaacgatccctgaaaacccctttttcatgatataatatcactaccagggatggggaattccgaggcaccaaaaattttaggaagtcggaattccgaccccaaaaaatcggaacttggaagtcgaaattccgtaccatccctgatctctactatacatatggcaaataattaatttaatcaattaattatctttcaggatcgcggttcggttggcacggcaggcaccggacaatccggcggttccggctcgctatcgttggcaccggtcattgctggcgccggtgccgtacgtggcggcgcacacgcgcagcacaaccaccaatgcaacagcaacaacaataacaataatagcaacagcgtgtccgcgtacaacacggtgaacaccgcgtacgacccgtcgtacaccagcgcaaccgtttactcggactcaatcacgtgcctgcacgcgcctggcgtcctgcagtcgggtggcggcgtcattggggctggcggtggggcgagcagttgcgcggacggcatcacggaccagcggcgcgggtgagtggtgacggatgagtggattaagcaatcaattagattgataggcttaatggctttattggtttaattagatgcttgtgcgtttcttgaaatttgccattccccctcacttccgacatttttttaaaatcaattttattanaaaagattaaccanaaattttatttttttttgaattttttaaaaaataagttttttttttgaaatttttaaatcttttcttgaaattcttgttct

SEQ ID NO: 39985 - DNA, 1193 bp, Heterodera glycines
  misc_feature (58)..(58): n is a, c, g, or t
  misc_feature (61)..(61): n is a, c, g, or t
  misc_feature (1050)..(1050): n is a, c, g, or t
  misc_feature (1084)..(1084): n is a, c, g, or t
aaagcgcaaaaaaatcattcatttaaaattcctcacatttccttaaacgtcgcctcanttngcggcaatagcagcagcaccttttgtcgtaagtttgtgattgcgaaaaatgacgttaactaaaaattttatttagattagtttatttatattaaatttttgagtaacaaattggaaaaagcaaataaacggcgaccaaaaatttatgccaggagcaaaattggcactttttgatgccgaagggttcaaaatttgatgcaaaaaaaacaatgcgattcctcatcaaagtcaatgaaatggaagaaaaaaggccgaatattcgacgccatccgaaatatttgttcatcatttttgtttaggtcgtacgtgatttattcagacccatgggaaattctattttcattcaatcccggctttcttgtgggtctccgattttcggaaaaaatcctacgcgaaagaattttttgaaaattgtaaaatattggcattatgttcttatttgactcataaaaatgaaatgcttcaaaaaaatttatataaaaggaagggaacagtgcataatccaaccattcttcattcatcactatattttttattttggtaaatttccccttttgtactattttttcggccacaaaaacctttcaacaaaactggccaaataccaaagcgaacattttggtatcatttcatggtctttcaaaatgttgtaaaggcaaaaaaacctaacaatttttctctaaaaacagtaaaagtcggctatttgtcatcattcctctgacatcccaaccccatttttcaaaggcctcagtacacccaccacatattgtacatattatctggaaaagcctgatcatctccatccatccatcatcatcatcaccatgacggacgagcccgaaacaaaggaccaactaatctacctgatcatcgtgtgcgagaaggcgcgacgcttcgacgacatggtggaggcgatgaaaaaggtgtggccatccatcccatccgatcggttgtggtcgcaggatttcacaaattttgatgatcaattanatgctttatcccctctcccccatttcagttgatncaatttggaccccaatcttggcctggaggaccgtatgtcgctgggagtgggctacaaaggtgcgatgtcttcacgccgttcgtcatggcgcacgttggtgttcatcgag

SEQ ID NO: 39986 - DNA, 659 bp, Heterodera glycines
atcatggccaagcttgaccagagactcggtcaaatcgtaaattattcgttccatttcgcccgcctttttgtacggaagtatgcccaaaaatgtgctatgacccatcaaaattttcagttttaatccgtttattttggtttttggcacaaaatttttgataggaaaatttttaaaaaccgtttgtttttttaccaaattttgtttgttcgtttttttaaaaattttttttgcacattcttttatcgctcagttttgcattatttctcattaattcattcatttgccgttaaatctttacttccttcttccttcattgtgccaaccacattttttcttcaagctcatctcagaccggataaactgtagtgaacgccccgtgaaaaaatgggtcaaatgatataccaatcgattcgtctcgaggagctaagcacggaaaaatatgcctcgagttgcggaaatgccaaaaacccggtttttgaaccggtttaaaactcgaaaaattgtgtgaaaagggtgtccttgaccctttaaaacggtcaaattcgaacaaatttggtatcattcgaaagcccttgatcagctaagtctaaaaaacaaggtataaattcgaaccgatgccatctaggcactgggacaactgagtcccagtgaaaatagac

SEQ ID NO: 39987 - DNA, 1034 bp, Heterodera glycines
ccacgaaacgaaattggcgaccagcgccatcaaagcataagcgtaacattcacgggcaccaccatcggtggcaccaatgaagcacaacgcggacaccaacagtgaaatgacaaagaaaaacagcgaattcggcacaactttgccggcagcaccgacggagaacagaaacagtgccaacgcgatgagaaaattgacgaacggagagaaggtgtccatgagaaaggaggaatccgctgcggagtcattgctggcactgtcgtttccaacggcatggcttggcacttcttcagcgatggcactttcactgccatggcttggcatttgtcccgctgtggcacttccactgtcactgccatggcttagcatttctcctcccgtaattagcaacaattgatcattttgcggagcattttcagtgcctgacgatgacgaggacgccgaaggcgcgatttgttggttgtcgttttgagacgatggctcatgatgaaccaaattgatcactctctccaagaccgctccttgctgaagcagggaattgttgtgccggaacattttcagtgtgaagaacagcatcatggcgaaggacacataggcgagaacaattgggacgatgttgaaaatggtggaaattctgaaaaaattgggagggaaaatgtcggataaaatgacagaattttaaaaattggccagccaagaatttgtaaaaatttgtcaagttttgcacttttttcttggaacttttggggaaaacaaggcctcggttagaccatacccaatgaattggacaaagcaaatgagcagcaaagtctgcagttgttggagaggaaaaacggcgtaaatgagcgtttgccattgctgttgcagctttgtgagcaaatagtcgaccagagaattcatttacacaaaacaatagggaagaaaaaatcagaaaaaagaaaaatttcgattaacatggcgagtcaattttgggctccaagcgcaaataagtttattatatatttattaatcagaacgccaaaacttgcaaaacttaa

SEQ ID NO: 39988 - DNA, 694 bp, Heterodera glycines
aacacacaaagaataaaaatatttattgatcggtcggtggacaaatgcaaataataataaaaacgaatgaatgagggaagagacaaaaaggaggggaatggtctccttataaacacaatgaggagggtcggggcatggagaacaaagtacaaatatgaaaataattaaaaaggtcaaaacgccaatttaacatctccaacacaatttgttgtgttcctccaattgaacacacaaagaataaaaacatttattgatcggtcggtggacaaatgcaaataataataaaaacgaatgaatgagggaagagacaaaaaggaggggaatggtctccttataaacacaatgaggagggtcggggcatggagaacaaagtacaaatatgaaaataattaaaaaggtcaaaacgccaatttaacatctccaacacctcccttctcaagcttctaactccttcagcggccggaaggcgagaagcgaatcaccggcttcggcttacgctgcgatcgtcgaagagcaaatgtcggcgggtcgtttgcggcttgttgatcagtccgttgatcgaccggatcagcaatttgatgcgccaaatttttgagtttgtccgtttggctggtggaaattggctgctgaccggcaccaggattatgtttcgaattctcttcgaaaacatatttttcgacgaagttggttcgaa

SEQ ID NO: 39989 - DNA, 1310 bp, Heterodera glycines
  misc_feature (32)..(32): n is a, c, g, or t
ttatatagttaaaaatcaatttaagactagtnggcgaaactagttggcgaaacgtcattttttggctgagttggcgaaatgaatgtttttggctgagttggcgaaatgaatgttggttagatgtcggttggcgagatgtaaagttggcaagatgtcagttggcgaaatgtccagattttggctgagttggcgaaatgaatgtttttggctgagttggcgaaatgacaagttggcgaaatgtcatggagcccacctgaatgatgagctttactactattttcatttttatttgttttataaataattttttctaacaactaaaaatgtcacttcataacaaatattgattttttaaataatctttgctaataaattattacagtcgaatttgggagtttgacttttacttttgagtattcatgtccgtgaatggaagtgttgtcgagtgcttgagcgtttaaattaaaaatgcatttttattgataagttgaatttatttattgttttacaccggcaattgcgcacaatcagtcctgtcttccacgttgaatttgacagaaaattatgtcaccgtttcaattcgcaccaatggctgatttggcacgataaattaattgaattcaatttaaatttctttattttttaatatttttgtcatatttttaaagtgaattgatctagccagtaaaatttataaactaaagtagttattaattttactttttgtattagtttaatatgaagaatgagctgaggaaaagagaaataaatatataattatcaagatatattttgattttttatgttaaaatatataatttaatttttctgataaataaaaaattactccatgtaattcgttcgtagtttttttaaattttacttttgattattacttaatttaatgccttctttttatagtatttatttatccatatctattctagctgcacaatggacataatattttctacaataatatgttttttctaaataaataaattttatttattaattattacaattaattagaagttgtaaatattttgcaaaatttacggtaatttaatttttaataatgattttttatataatttcaaaaataaccttttttggtaaattacttaaaaaattatttaatttgataaaaataatactcaaaataaagtggaaaaattaagaattaaatatttgccgtaaagattggcgaaaataaaatttacattttattagacagtatttcaaatcagataaaaaatatatattaattgatttataatttaatatataaaaaaaatcataatcaatta

SEQ ID NO: 39990 - DNA, 1103 bp, Heterodera glycines
aaaataaaaagttaaaagagaatttttttttaaaaaaattttgtcgtaagtactaggattcctgcgcgtgacgggatcccgcgcgggattttgcgggatcacagtcttgcagggattaatccaagcgggatcccgtcccgcaaagaaatttgagttccaatcccgcagcgggatccgcaaatttgattttttgtgcgggattatgcgggattttattatttttttgaaaatttttctaagacagaatgccaaatatttttaaataaattaaataataaatttaattaaagttagctcatttttcatcgtaaactagcggggtcagcgccttcggcgcatcccccgctaggtagtacgcttgtattataggattatgaatgataaaatcgactggctcggccgcttcgcggcctcgcatcctattcttggctttttctccaatcgccgggactcaatccaccagcattcaatcactgggactcaatccaccagcatttcaatcactgggactcaatccaccaacattccaatcaacgggactcaatccaccagcattcaatcactgggactcaattctcctgcgtttcaatcactgggactcaacccaccaacattccaatcaacgggactcaatccaccagcatttcaatcactgggactcaatccaccaacattccaatcactgggactcaatccaccagcatttcaatcagtgggactcaacccaccaacattccaatcaacgggactcaatccaccagcatttcaatcactgggactcaatccaccaacatttcaatcactgggactcaacccaccagcatttcaatcaacgtgactcaatccaccagcattcaatcactgggactcaattcttctgcatttcaattactgggactcaattctcctgcgtttcaatcactgggactcaaccctcaagcatttcaatcgcagggactcaatccaccaacattccgatcaacgggactcaatccaccagcatttcaatcactgggactcaaccctcaagcatttcaatcaacgggactcaatccaccagcgagcaatcactgggactcaattcttctgcatttcaattactg

SEQ ID NO: 39991 - DNA, 908 bp, Heterodera glycines
  misc_feature (809)..(809): n is a, c, g, or t
aattttaaaaaagtgctaattaataaatttttttgtcgctaaaaactcgaaggaaataaaaaattaagttttttaaatcgggagaatcggcggaagggttctgatcaatgccaaaatgtcctccgctccttcaacctgttgctgctgttgtccctcgtgcggggggctcggaaacagcggcgacgaggccaaaaagcgacggaatgcgtccggggtcaggtccgacgccctctcgcgatggacttgcatttggtagcgcttgaacagctcgaactcctcgtcaaagtcctcgtccaactccagcgacggctgcccgatcagacggagctgaacccatgggaagcatttggccatggtcagacgaggggaaaagcgctttcccttttttatttggacccaatgaaaaaattgtattgaataggttggctgtgtgttccccaccaaacctgaagtgtgtgggcccaactcggctcgtcgtacccattgagaaacgactgaacggtccgtcgtcgtgccgactcgcgtgcggcgcgctgccttttgaactgtaacaaaggcggcgctaattataagatggtttacaaaaagtttagtattattttaatgatttgtcgtgcaactttggcaatttctgttggcctcattttatttaccacgcccaatttgtataaaaaaatgcaaaaatttaaataaaattttcggctattcttccgcccacctcctccaagtcaatgccccgcgctctcagccgctcctccgcgcgccgtcgtcgcatttcctttttcttcggctgtctttccattccgtgngaatccaaagttttcgatttccttaaaaatgacaaattattttccgaaaagaaaaccaaaaaatttcaaaaagtttccattttttaaaagttcacattg

SEQ ID NO: 39992 - DNA, 1291 bp, Heterodera glycines
tgtaattacagtggcggaaaaaagtcttgactcaagatgataaaatttgtagaattttaaatttcgactggaaatttagctgattattttttgtttatgtatatttatttaccccgatatatgggcctttcatataccacaaaatcatttcattccgctttatcattctcgtgaataagtctcctaatcaaaccttgctcaaaaaaggggcggaaaaaagtcttgactcaaacttgaaaaaccaccttagagttcatttaaaaacctgaaataattcatgctagcttatcttttgactgatctaaaaaggcttttacaccaacttgatcagatcactccttcatggtgatcagaaagtcaaaaatagcttgaaattgggaaaattttagaaaaaaattcctagggggctgggaaaatttttctgaaattttttgattgggctacctgaaagagcacaaaattctctaacgaattgccttttgaatggtgggcatacatgcgacttgtagataaaaagttatacttgtgttgaatttgatgatgataaaaatcacaattttctaccgaatttcaagggaaaatgatcaaaaattgatcatttttgagttgtccaatttttaacctaagtaagtataactttttacggtcagggacgttttcgcgccgccattttcgcgccgccgttttcgcgctgccgttttcgcgccaggaagttttcgcgccgccgttttcgcgccaggaagttttcgcgccgccgttttcgcgcggttgcatatatgtaaaagaaatatgtgtattagagaaaattgtttttttactaatttttttactcgcatcttgttttaaaatggtaaaagaacgttatttaattttattttcgatcgatcaaatttttttatttaacttttgttagaataaccatcagatcctctaaccaagaattctctgctctttctgggtttaaattattttttttagtttcaaactttattaaaactattttgattgtaactaagagtgttaatgataataaaattatattttttacgctgcaaaaatattggagcagaaatttcaaatatatatattttttgtacttgtcaaaaatttatttatatcataacatacttttgtcgaatattaccatttttaattggacattaataattttaaggcctaattattgttaatatatattattcgtaattttaacaagccgtttaatggtttttttactcgtgatgatttgagataagctaattaccaatttactttctgcaaaacaattcaa

SEQ ID NO: 39993 - DNA, 915 bp, Heterodera glycines
  misc_feature (22)..(22): n is a, c, g, or t
attaggccttaatttaaacttntggtcaagccaactttagctcgcttaggtaggctttaagttatttttaaacaaaagccaaattagttttttgtgtcccaatcgagtctattcgacactctgacgcttaaccgtatttaaaagctgggagtacggtaaagttaatcaactggcgacgatgaaaattattttaataccaaataataatttaagggaaaataaattacataatacaaacgaacataaaaaagatttgggaacaaataaaataataaataagaaattggtttagctctttaagcgatataatggatgatccctgcaaggatgaaaatttttaattagagctgagcgggaccgggaattttgacatgggaccgggactttttgggttgaaaacccgggaaaaaactgggactagtcccggtcccggtcaaaaccgggacttttgtacttgtacattttttagtaccagcgccggtcccgctctgctctaattttcataccatataagaaatttaaggggaaaataaattacataatacaaacgaacataaaaaaagatttgggaacaaataaaataataaataaaaaagtgtgtttagaatgaaaaagatgatttgtttcaggaggcaaattcttttttacccaattcgttttttagtgttataagtatacggagtgtctaacctaccgaatttaatgtctgaaaagttggatagaaattttatgactggaatttttttaggattttgtattttcttatttctatttttaaagaagcaaaaaatttatgcctgaaaagtttgatagaaattaaacgaccggaatttttttttgaggtttttgtttcttaagaaaaaattcaattggtaattcaatataatcaatgatcccctgcattaatgaaaattt

SEQ ID NO: 39994 - DNA, 675 bp, Heterodera glycines
acgatgtcaaaatggtatcaatttaatgatatgtctgctctccttattattcttttgatgtctattgagcttaggaaagtcggaaaattactcatgagaattttaccagcgatacattaaccttcgcctccacgatgtcaaaatggtatcactctaatgatatgtcagctctccttaggtgtcttttgatgactctagagcttaggaaagtcggaaaatttctccggaaaattttcacagctctacattaacctttacctacgcgatgtcaaaatggtatcaatatgatcatatgtctttctatacgaaatctaatcttcggatgttcttgggaccttagtaaagtcggaattcggatcctggaaacggtgcaagttcggcattatgcatcccctgcaattacggattacggatttccgtaatagcaaattcagttgcgcctatccatggtccagacccctgcccctgcttaaaaaaacacccatttttgttcttcatgaaatcgaccgaggaacatagtcatccgaaaaaggatatttatcagttatgtagtaaaaaaaagtgtcgcaagagtcaaaactggactggagaggggatgcaggcgacattctcccttttgcctatataaagggatattagtaagcaaaaaaagcacaaataaaaaaatttttaaat

SEQ ID NO: 39995 - DNA, 851 bp, Heterodera glycines
tttcaggcctcccacagtccaggaaaaaaaatatggatttccatataattccgaaccctattcataactttgctcaagaataaccaaatttcaaattcttgatatcagatagctgtgtcctttattagcctgcaaataaaacaaataatttttaactttcatttttacataataaagaatgaacgcttttcgttctccgttttgatgaggacagaggcaggcaacaaaaaaacccatccgggcgctattaaggctttaaattggttgattaacaattaaaaaagcatatttttgctttgtccccaccgcccgtaaatattcatgaatttttctccgtattctcttgttgtctttatgcatactggaaaaaaagcaacaacaaaaggagagagagagaacacatcctccttttaaagccaacaactcttttgctataacatttatggcttttccttttcgccgcccccctttccgtgctcatttccgccttctccttccggtttctttttctcctcttcctccggtgcggtgctgttctctgagaaaatgtttagaaaaatgtgtaagcattaaccattttaattcatatttattccacactctcttatttttgtcaatgtttcccactcacttcgctttttaggcaccgtggacgtgctcggacctgtgttcatcgctctgtagagggtgtcaatcccagcacggagtgtgtccacaagattactgatgcctgtacaaagctaatcgttatcacattaactgtactcactctcattcatccccgaaaaaaaacaactggatgatggaacaatatgatacactaacctcattagaacgcaaaatgcaacaaa

SEQ ID NO: 39996 - DNA, 1496 bp, Heterodera glycines
tctattttaagtttcagaatttttggaattttttaaccttttttattttttggcaattttttggcccttgggattttcgggttaaattttgaaaattcattgctcagtgaaggtttggtcaatttaagggaattaaagctctaaaaatagagaaaaatcaggagaattttatgggatttaattgaaatttatatcttcaaatgaaaaaaagttattccagaaattctggaaattttctatttttcagaaaaaattttatatctcggttctgaaaagtcattagagaagagtaaaatactacaaaaatccgcaattttttgctctattatataaattttatttgacctttttatcatcttttaaaataaagatacaaaaatataagtgattttggcattcgggaccaaagggggtggacaggatttttgagtggaaaaatttttctcacaaaaatcttccaaaaatatgtctttaggggttatttgggtcgctgatcacgaatacgtgatcagattttacttttgacatagtcaagacctcagaatccctgtgtgattggggattctgaggcatcattttgaggggggtggggcaggttcggatccgggcggtgtacattatttttctgttctttttttgattacttttgcatgtttaatttcacttcaaattattcgaggccataactttttataaaaaagtggtagttaaatggtgtaaagaacttttttatagagcaaaaaattacggattttatcattattcaatattgccagtacccctaacatgaagggagttatgaatttttttccgaaaattcgaaatttttcagggattttggaataacttttttctatccgttgttttactaccaaataaaaagcataaaatgcgccgtatttttcctcattttttagttattcaatcatgaatattcaccctccctatcccgggttacgaatttttgcaaattacaccaaattcccaggggccaaaaaattccgaattttcaaaaaaattttttcaccaacaaaacctacaaattattatattttttggtaaataaaaatatttttttgcagagaattttttctctattttgtcagctttacccggaatccgaacctctaaattgaaatgagtaatagatttttgaaaaattctccgaattctcgcctttgcacctaaataagttaggaaaaacctaaaccgatcatttccatccttttttattagaattctccatatttttctcttttactttattcaaattttagcggaaaaaatggggctttttttatatagtaaatctaccctcccaaacgttataaaacggggatttgttgtcaaattgttttaataaataattcatcaaatgttcaaattatccgttaaaatcaaggccacattatatggcaacaatttttcagttttttgtcactttttaatgaatattttgaatttgttgctctttttaagggactgttgacattcaa

SEQ ID NO: 39997 - DNA, 1273 bp, Heterodera glycines
aaactgttgtgaaaaattgttataactccattcagagaagagatagaaaaaaaaaaaataggtttagagagcccatgaacagctgaatcggatgcaagtaccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaataataataggcttggactaccatactaattagaatttttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaataataataggcttggactaccatactaattagaatttttagaatgtgtctgttaaatgcaaaactgttgtgaaaaattgttataactccattcagagaagagatagaaaaaaaaaaaataggtttagagagcccgtgaacagctgcatcggatgcaagtgccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaattgttgtttttcaaaaaggatactaaaactgggataacccattcagagactagtcaaaaaaaataataataggcttggactaccatactaattagaatttttagaatgtgtctgttaaatgcaaaactgttgtgaaaaattgttataactccattcagagaagagatagaaaaaaaaaaataggtttagagagcccatgaacagctgaatcgtatgcaagtaccgcccgttgctgtacgcctaacagttggtgagcaatgacggaaaat

SEQ ID NO: 39998 - DNA, 1376 bp, Heterodera glycines
  misc_feature (54)..(54): n is a, c, g, or t
  misc_feature (61)..(61): n is a, c, g, or t
  misc_feature (65)..(65): n is a, c, g, or t
aatcattctctgatgcccgcttcttccacagtgaactacctaggtttctcccgnctttgtncgancaaaccgtcgtccttttgccccacttgggactgtccacattaaacacggattttaaggaacaattcggcgatgtcaaggtgttcaaaagttgcggattggttcagtcatttaattgatttgctaatatttttatttattcccttttatttttttgtttcctcagtttgtctgcaccggcggaagctcaactcgaatgtcggaatatgcaaagtttttctcggcgatggccaatgttgcgtcgggtggaaatttgtgcaacagaacggacagattcgtcatgtttaagactggcccggtgctttgggcaaatgtgtgtgtgttttggaaccaaaaattcgctcaaactgtgccgtttttcgtttagcatggcattggcatgccatccgcgtccattttgctgtgtgaggtcagtcaccgtttgcacatagtcagacggagtactgtactcaaaatcacatttatttctatgtgcttactgtatgtcttatcttcccacctgtccctaaagctcttcaaattgctgcgtttggcctgctgtgccgatgtgctgttcatccgcctgggcacctgcggaggcatcgacgtgaagccgggcaccgtaatcatttccaacggagtggtaaacgcggccatggaaaaacacaaattcgtccagtggatccagggaaaagaggtccgaacggagcaaaaaactaaagaaaacaactgctgctaaaaggtgaaacgggacgcactgctcgacgcgcaattgggcgacgatcttttcgacacggccacggaaatgcatttgccagtggaccggggactcactttttgcaccgacgatttttacgagggttaaaacgattaattggggggggggggggggtgtcattatattttatgaggtcttgccattacattttaaacctgtaaccggcctttgtgatttcattgaggggaacgatgatggaaaccaaaacttctgggttaaaattgaaaagctcttcaatttgccttggaaaattttcataaatacgataaaaacgaactccaatcagtcgaatggttagatttcgttttagttagtagacgacgaaaagtgaaaacattaacttgaacaagggtaggagccgagagagggggatgagggacgatccccgccaacccggggaacagggacagcggagatcggaaaatccttaacaaaaatggaataaaacaaaaaatacacccctaagcaatcaaccgaaaaaatttcagaagatacactcccaaagaaaagaaaaattttcacaaaaattgatcccccaaaataattatttttttct

SEQ ID NO: 39999 - DNA, 1101 bp, Heterodera glycines
  misc_feature (13)..(13): n is a, c, g, or t
acacgaaattctntgagaaaaaaaattgaaaaaatttcacctattttttagattttttttaatcctatcaattcaccacaaatttatcgaaaattcttttttcttacaattccttacaataataatttctaagattttttttttgaaaaatttctaacatctgtaaaggtccatctcgaatcggctggtcctgatttttaaattctttgctcttggcattgtgatgtttaaatgaacattgtctcacaattcatttgacatttaggcacgcaaagcaacaactggaaaaacggctactaaagaaggaactgagcgagaaggagttggtgaacgcgttgtccttcgagaaacaacggtccgagtcgatgccacttttggagcagcgcgtcagaattttggagcgcgagttggcccgttttgacggatcatcgacgaggggactgtgcaataacttataatttaaacatttatttatttatttgacgaattgacgcatgtaatttgaggaaaacattcattcgatgggttttgtttttgtactgcttgggggcgtcgcccaggctatgtttaaaaattgcatattttaatagggtccaatttttccattgagctatttttgaaagcattgtgagcaatttgccttgattatagaagagaatttgtttggggtttttagcatttgtccatgtcttctgcgaggcgactattagcaatagcacccccccccccccctaattaccctcctcatttacacgcgcaaatcccgttcgcctgcaacaatgttttaattaattaattacttgttgtgtgtgtgtgtgtgataacgcaaagtccgtaccccgccccacctccgctcccttcccttttcttctgtccgtccgtcttcgtccccatcgtcccttccttttccttccgccgtcgttgcattgccccaggcgttttgtgtcttccagtgacagtcgtcgctaaacgcgcggcggcagaagcatctttggtctgctgatcaacctgacatgaggcagagagattatgctgcatgcgcttttggcgctggcgcgatgatccgactgatcagtagggggggggggggggggggggggg

SEQ ID NO: 40000 - DNA, 1186 bp, Heterodera glycines
  misc_feature (43)..(43): n is a, c, g, or t
  misc_feature (50)..(50): n is a, c, g, or t
  misc_feature (139)..(139): n is a, c, g, or t
gcagtgaatgagcgccaaaatcagtgccgccatcatagcgaanaagatgnagatggatttggtgcaaattgatttcaaaatgggcaaacttttgcaggccttacgaatgactggctttggtttgcacaaatcggttgcncagcataaatatgaagaattgaagagcaaaatggagcaaaaaaagagaggcggaaaactcggaataattgacgtgtgccaattgtggagttgcgcggaagacatcaaaaaaataagccaattaatgaacaaaaccatttcaaacatcaaaaaggagataaacaatgctgaacaattgttaaaaaggagcaaaaagttcgatttaactattattaactattaatccgattttagaagaaaaaaataattaaaatggttttataagtgagaatttccaattaaaattgtcaagctttgcatcaaagcaacaaaaatattatacattttgtttttattgatagtcaaaattgtcctagtcttttttatttgtatgcaaaacttaaaaatcgtttgatttctataaatttaaaataagagaatcttttttgaattttttaaaacatagtttttttcaaatccaaataattatattatgaatcattgcataataaaataaaccacacttaaacttatcactgataatttgttattaataaagaaatgacacttcttcccgacaaaatcttttttgcggtttttactgaatcccacggtccaatatcggcataaagattataatatgaattaaaaaattaaattaacttcctaatttaaatgggtgtcaatgacaactcgtacaaaacgcaaatcgtaaaatgaataggctaggcttaggcttgtttgggcctaggcttaagctaaggctttattttgcaaattttttattgtacgattgctttttgtatgattgccattgacgctttaaatgaatgaatttattaaaatagtaagaaatggaatgaattgggtaagattgaaaatttgttggagggaatgtgtagttaattgagagattggggtattgaattaagggagttagtgtatgaaatgaagtttttgtgtataaatgaattgatgttagttgtggaaaaagagaaggaatagaaatttaaaaggtggattaattttttggaaggaatttatgaagaaagtgaattgagtaaaatga

SEQ ID NO: 40001 - DNA, 1592 bp, Heterodera glycines
ttttgcttgtttgtatgattcacggctcagaaaaaggatgcccgtggcgtaatgaccgatggggggcaggtcaatgttgaaactatgtaaaaaaggtgaacagtaagttgcgatgggacactttgaccaccttttcttcagctcgtccctgtacagtttgtccggaattgcggtcataacgccagcgccatcgccagaatcatcgtcacagaaacaggcgcctcggtggactgaaatttgaattgattcagaaaatatctatggacagtggaaagggggattttagaagataacttacccatccgttcgagcatcactcgaccctcctgcagtatctgaacagtttgaatttattttcaaaaatatttccgtttatttattctctcgattaaatgcctttcaaatggtctctcactttatgcgtcggaatgcctctaacgctcacacaaaatccgacgccacatgcatctttttccagctgaggcctccacagggactgcgtggaaagctcatcgaattgtttttggctaatcagcaccattggagacaacggcgacagcgaccaaaagaaaaaaacggaataaaatggacagatggagagaatgggaatgaaattcgaatgagtagaaactaaaagttaggtatgtaatttgaattaattttttgaaacttaacaaactcataaacccattcaagaacattattcgagagttttgtttaatagtgtacactatgggtattggacacagtgtcactatgggtcaagcccagtgttagacaaaattgctcataacgccaaatagcgcatttggcgtaaatttttgcgcgctaattcaaacttacactgatccgtgcatttttgattgtttattttgataagccactagcggggtcagcgcattcgaaactgcccctcctaattaacgattcttaagccgttgaggactgccatattccctttgactgacacaaaattgccgaaaaagagatagccattttctgaggcccgaaggaaaaattgagagggctaatttatatgtaatattcgaaactgtcaatctaattagcgattcggaagcacattggggcctgccatattccctttgactgacacaaaattgccgaaaaagagatagccattttctgaggcccgaaggaaaaattgagagggctaatttatatgtaatattcgaaactgtcaatctaattagcgattcggaagcacattggggcctgaattaagccatattccctttgactgacacaaaattgccgaaaaagagatagccattttctgaggcccgaaggaaaaattgagagggctaatttatatgtaatattcgaaactgtcaatctaattagcgattcggaagcacattggggcctgaattaagccatattccctttgactgacacaaaattgccgaaaaagagatagccattttctgaggcccgaaggaaaaattgagagggctaatttatatgtaatattcgaaactgtcaatctaattagcgattcggaagcacattggggcctgccatattccctttgactgacacaaaatttgccgaaaagagatagccattttctg

SEQ ID NO: 40002 - DNA, 997 bp, Heterodera glycines
  misc_feature (952)..(952): n is a, c, g, or t
gtttttttcgaaaatgtcaaaatatcggcataaatcgttaaatatgggaaatagactccatcctaaaagcttcaaaccaagctaaaaatgtttttcgtccgtttcaggcctctcacagtccaacaggaaaaaatgggtttccatatgattcaacacttagtaatttcctattcataaatacaatattaaaaaaattaattatccaattttatgctttaatttctatttaacggccccaagaaaaacattaccatccgacaaagttttttttttctaacagagcacaaacaaacaaatatttcatcaatgattttaaatttatcttttttgtccaaaaatataaatacatgaaattagataattagaaaattggataaattgaatgatttcgcgccgaatttctcattagaatctcgcctctgcctggagacaaaacaaaaaagagtcttgatcaaaagcattaagcattgaattaattctataaatcgaaatttcaaggatcgagaattgaaccaaaagccctagctttcgatatttaattgttcatttccccaaatgcccgttgccgaacttcaattgggaaaaatggcacaatgcacgcaacagtaatgccgacgaacaaatttgagacgatgagaagcacagcgatggccaattgttgccaattgcggcggggctctgctgctggagctgagaaatgagcaaaatacattattgactgattaaaagcggcttatcatgcatgatcagggtgattaattaaaacattttttatggcttttgcatattttggcggtctgtgccattcttatttttcgctttgttccttatttttttggaaaagactggtttttcaaggattttgaccaaacattcctgaaaaggtttttaaaaaatccattttatcaaattgctcgaataaataattcaatttcatttaaaattttattanaaaaatctttttatttttttaataaattaaatgtgaatttatttt

SEQ ID NO: 40003 - DNA, 621 bp, Heterodera glycines
cagattccactacggttgtcggtttgcgccaggcgcggttttattcgacacaaaatccaagaaacctaggcggttgaggttgctccagtacgcggttattggaggaggaggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctatcgtttttatttattttttgcaaaattaattcttaaatatttttcagaaagggttgtgaaacgcaccaaattttatttacatgttagtttaggcactctgatgctttttctatcaaaaagggagatgaataaaattttcaaatacttttaattcctttttaaacaggccaaaaagtttaggctcatctttttagtgaaaattcgatcactcatattttttgctaattgagcagaagcg

SEQ ID NO: 40004 - DNA, 418 bp, Heterodera glycines
ctcctgtatttcaatcactgggactcaacccaccaacattccaatcacggggactcaacccaccagcatttcaatcactgggactcaattctgcatttcaatcactggcactcaacccaccagcatttcaatcactgggactcaacccaccagcatttcaatcactggcactcaacccaccagcatttcaatcactgggactcaacccaccagcattccaataactgggactcaacccaccagcatttcaatcactggcactcaacccaccagcatttcaatcactgggactcaattctgcatttcaatcactggcactcaacccaccagcatttcaatcactgggactcaacccaccagcatttcaatcactgggactcaattctacccaccgagcatttcaatcactgggactcaa

SEQ ID NO: 40005 - DNA, 963 bp, Heterodera glycines
agaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttagaccattttttgctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgttgagaagctttttgagcgtaattacgatttttacttacaccatttttt

SEQ ID NO: 40006 - DNA, 926 bp, Heterodera glycines
cagctgatgccgtcggaaaaactccgattttttggcctcttttttttctttcagtttcaccactgattgttgaggcaatttttttcgccaatttcttttgtctacaaacattatttattgcgtttcatcctgtagtgtgtaaaaaattttcaataaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggccgatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataattttttttccgattcctttatctccaagcatgagccttataagtgattgttcatatccttctcttgaaaaaaaattgccagtaaaaaaaacacgttttctgaatattaacaaacaaaaatttttagacactttctaaaagaggaaggaaaaaaatttttcatttggccctaattatttatttata

SEQ ID NO: 40007 - DNA, 1250 bp, Heterodera glycines
ttatttctttaattttttataattttgctatttttccttttttgttttttcttcttcttatgatttgatcttgcaactttctagattatattattaaattgtacattttcttcagctttgataatgattttgtatttttcttaccattttttaaatatgtttaatttttaatgaaagaattgaatagttattatttgtgaatttagttttgtatgttgtacaaaaaatgattactattttattgtattatttattatattacattattcaatgctaaattacatttattctttttcgtttataaattttaaatttgttattttttaattaaattaccatattttttattttacggtcatataattttttcgaagttaattttttgaatctgattacttttttcactcatttattaattatttttgtgtgctttttgttgtttttgttaattgcataattatttgttatttttacttttttttatatttcataagatttgtactaattgtaatgaataatcatttatttacttcatttcatttatttattcaaaattttaaaatattatttttttaaatctttttttactattttaatatcatgttcacatgtcggttttttccttttcttcattgggccactttgatttattaattagagaattcaaatttaattttgttgcaaaatattttcgtctttttgccgaccagttgaatgaatttttgtttataaaatttttttttataaatgatttcttttacttaataattatacgaaaattaaaaatttaatttttcgtttattatgaatttataaaaattttaatttgaattatttaaactctattacttggattatcatttattttttcaaatttatttttttgcttctatgagtgggcgccacaccgattttgttgatattcatacgtaatttttttgcaattcgtaaaatagcctggttttcaccggggaatttcgtaaaatccatttgagataaataacattcattcactaaaatagttaaaaggatgaaaagaaaaaattaataatattttggtttacaatattttttcaataaaaataatcaatgttatcttgttgcttttcttgtgacctcgagacaatacaataggctttttactttgctttaagcctttcttttattatttatcagtaaaattgttataatttatttctatcattatttaatttaattttcatgctcagttctgggcttctgattccggc

SEQ ID NO: 40008 - DNA, 1119 bp, Heterodera glycines
tatattaacctaaaatattaatcataaaattatattaccattatttttgtgagacctgaaattattaatattgattaccattgtcgattttttttacaattttggcattttcttctgctgaaataggaatagacggctaaattttaatattattattataattttgggcaagtatgcaaatgtaaaaagtaataaatttatatttataacaaattcattatttaatatagataagtaatatggattgaaatttcgaaaattattaaaattttaatttaaaaaaaataatttcagaacaaaaaacttatttcgaatgttcaatagatttgggccagttttaccttctcccgtccaaaattataatgttttctgatttttatagagatatgtttttttattccttaccagggaattgagtgtttatgttgaatttttccaaaaatgtataaaaaaggtaacaaaaatatgtgtgtttaaatcaaatttatgaataaaattaattggggaaattcacaaaaattgcaaaatttcaaaattatttgctgcttaatcgattgcaaaaaaaaggaaactaatgacggtcataacaattttttttttcattgatgcgtcataaaatttttatgcaggaaaatagtttacaaaaaatttcacgtgaatttctgctgtttttcctaagtggtcagaacacactggacaaatgggaaagctggctggaaatgccaccttctccatggagaatgccaatgccaatgccatgcaaatgtaaacacacgtaaggtaatggcatccccaaatacgccaccttgaaaagcttccccgggaaaagattgtataaaaaagagcgatctaatgccagaaagtagcaacagcaatcatttattgttatatttttcactgaaacagttttttgtctggcttctcgagaatttgtatttattcaaatctgagactttaatttgttggcactcacgatctgatgagccgcttgagtttttcagcttttcccgacctttttagttttgtcaatctccgattctagcaaattgaaccttggaatttaggcgagccggatcttgaaagccttttctcgacatgccgaaacccggcgatttcact

SEQ ID NO: 40009 - DNA, 933 bp, Heterodera glycines
  misc_feature (904)..(904): n is a, c, g, or t
aatagcttcccctatagccttgtactttaaatcgtgcgttagattttttgctcccccataattgttggagtcccccaaacggacacttgaaaaaatcgatttttttgttttcggggcagtccccccgaaccgatgcgcccagatttatggggagaccgaatccttcgggaatagcttccctatagcctgtacttttattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctcccccataaatgtttgagtacacgcaaacgngacacttgaaaaaatcgatttttttgttt

SEQ ID NO: 40010 - DNA, 924 bp, Heterodera glycines
ttctgaaaaaaatatttatgaattaattatgcaaaaatacattaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcattaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcattaaaagttaagcctaaactttttggcctgtttaaaaaggaattaaaaatttt

SEQ ID NO: 40011 - DNA, 974 bp, Heterodera glycines
  misc_feature (29)..(29): n is a, c, g, or t
  misc_feature (109)..(109): n is a, c, g, or t
cggattagcatcggggttacgagataganaattgtcctaaaaagagatagccatttttctgagaattaattcacaatttccgcagctcttgcggtaatggaaaaaattntgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagagagccatttttctgagaattaattcacaatttccgcag

SEQ ID NO: 40012 - DNA, 1045 bp, Heterodera glycines
ccacggcatttcaggtgtcggccacttcaaatgtgctgtttctgcctttcatggccactttccaccccaattatctcaccgcttatttcgtcggcatgagtttcagttcgttggtgccaagtgtgctcaaactgatccaaggtttttttttgactctttttattttttttatttatttatttttttcgctaattttttgcgacaaaatttgaatattcaaagtatgcaaatctgagtttttgaccaagttcaggttaggcatttagaattggtaacatggggaaaccacggtttcctgactgaaagttgtttcaagaattttttctacaaaatttttccggacggtggcgtttcaacgtttccgaaccatgtggtcattcattatacatatttcttataaaagcatggtgtcgtcatgaaaaatttcgtccaacataccacacccatcgggaaaatttgaaattttttccatttctgtaataaattttcacaaacaaaaaattgcaaaatttcgccaaattttgtaaaatttgagtgaggcaggtcttgaaggggcgtgaccataagggaaaatcgaaaatttttttagcacaaaaatactattttttgcccccttaaaatttcaggtgttggcaattacgactgtgtaccaaatggcaccgcgaacagcacacttgttgctgtttacatggaaccgttgttccacattcggctgtacaacatggccatgttcgcttggatgtgtgccgcaaccgcttcgtttgcctttttgtattggaatgggcggaggaaggcaaaaaggacgacaacagcgggggcaaaggttgggaaaatgggcgacaaattgtgtgtgtgcataggtacacaatatgtaaaacggtggtggtaccatgattcaggtccgtagacaggggagtgatgaataaatttctaaaatttttaaaaaaaaacaaaaaaatcccctagcgccacttttggcatcgacagacctatattttgtcatattgttttttggaattcgagtcgaaatgcaaaaattgtgatc

SEQ ID NO: 40013 - DNA, 1047 bp, Heterodera glycines
gagtgccgaaaattgcaggtgatctaagcctagaaaaaatggttcaataaaaatcgtaattacgctcaaaaagcttctcaaacaattttagcgcttacaattccttctacaatcgcatttatacataccgttatgagcgctaaaattatcagagtgccgaaaattgcatgtgatctaagcctagaaaaaatggttcaataaaaatcgtaattacgctcaaaaagcttctcaaacaattttagcgcttccaattccttctacaatcgcctttatacatcccattatgaacgctaaaattatcagagtgccgaaaatcgcatgtgatctaagcctagaaaaaatggttcaagtaaaaattgtaattacgctcaaaaagcttctcaaacaattttagcgcttccaattccttctacaatcgcctttattcatcccattatgaacgctaaaattatcagagtgccgaaaatcgcatgtgatctaagcctagaaaaaatggttcaagtaaaaatcgtaattacgctcaaaaagcttctcaaacaattttagcgcttcaaattcattctacaatcgcctttatacatcctattatgaacgctaaaattatcagagtgccgaaaatcgcatgtgatctaagcagcctagaaaaaatgattcaataaaaatcgtaattacgctcaaaaagcttctcaaacaattttagcgcttccaattccttctacaatcgcctttatacatcctattatgaacgctaaaattatcagagtgccgaaaatcgcatgtgatctaagcagcctagaaaaaaatggtttaagtaaaaatcgtaattacgctcaaaaaggttctcaaacaattttagcgcttccaattccttctacaatcgcctttatacatcccattatgaacgctaaaattatcagagtgccgaaaatcgcatgtgatctaagcctagaaaaaatggttcaagtaaaaattgtaattacgctcaaaaagcttctcaaacaattttagcgcttccaattccttctacaatcgcctttattcatccca

SEQ ID NO: 40014 - DNA, 889 bp, Heterodera glycines
  misc_feature (67)..(67): n is a, c, g, or t
cccttaagcactccggtaaaatcctttttcatcgtctcacggttcgttgtgccaccgctttagaagncgtgccacttacgctttgaccataacttcgaattggtgttgtgggatttcatccgccaatttcttcactatttccgcggcttttgcctttgcattcactccgggacaaagtgccgaaagttcgtcaatcggtttatcgttaacaaaaatgcaaattttctctaaccgacaatctctgtaccctgaaaagcggtctcgcattaaaatgtttaaattttaaatgtgtaatttgggcacacatgggcaagggacgcgtcgcccccccccccgcttcgtcgtaacgcacccacactcttccgtcgtaaggggtgcggctgtaaaagaggtgggggagtggggcgcaggccaaagggaaacgaggaaaaatttcaaatttttttctaacaaaatttacttaaaatccatccctattaaatatccctggcgcacgtatgctttttttttgaggggtgacccttccgccaaatttaataataatcattcgctttgctcccttcaagtttacacgattcttcgacttttttgtggtataaactgaccgtcatccttttgatcaaacgaagcaaatccgctagttgtaagtttgagtttgtcaaaaaaatcgacgataatttccaccaacggcaaccgccacctcagaatcattcgcttttcgtctatgtaagtcgtctcaagcacttccccgcgggcattttggcaaagtctttcaatgttcgagaaatattaggcaggtgtcacaatactgaccaaatacattggttccaaaaaatctcaagtggaaaaatatattacccaacaaataaatactccttccatggcaatt

SEQ ID NO: 40015 - DNA, 1049 bp, Heterodera glycines
  misc_feature (976)..(976): n is a, c, g, or t
  misc_feature (989)..(989): n is a, c, g, or t
  misc_feature (1034)..(1034): n is a, c, g, or t
agtgatgcctgaacaaaaattttattttagcagcatccttaatttctcaccttaatgtcagtgtctatgaatagtgacgtcgccattcgtcgaatgatgttccttgacacaggcagtttattttttcgtttttcagtgatccattcggccattgcaatgtcgatgtccgggcgttgaactgggcgaccggctccaccaagtctcatgcgcttccccccattcggtgtcatgctaaaatttttggtcacaaaaaatattaaaatgtcacgtacatttgatttctcagtttgttttcatgtgccatccagttcttgatctgtttcctgtccactttgaactttcttgctgctgaatgtatagagttctcttgcgcccactcgactgcatccagttttttcgtcgcatcgttattcctgtggcgcttcttgtcttttgcctgcgtgccttcattctcttcgttttgcggttcgtagtcatcattttctgagccttctgctatcggtgcatttccttcgtttacgcagttgtggcatacgaccattccgccgaagccttcattctcaactccaccagaatcgccacagaatgtgtgacacggcaatttacagacagaacagttgtggcttcctccataaattgctttacaaacacagcaaaaagattccattgctaaaatgaaaacaaatgtgctaaaatgttacgtcagtaatagagccgtgattttagtgaaaaaacttttttgcttttattttgataaaggagctcaaaaaagcatgtcagcattgaattttcgattttgaggccacacaaatcagactttaaggctcctcgccaaaataattaaaattttggcgtaatgtcactattttttcagtattttattaacttacctacctattccgagatttttcattactaaaagtcgcggccctagtcattaaaaatctgtcgaaaataatccccccgtctccattanaggccctgtctcncattatgtccccctttctgaggaggttgaaaataatccccccggngccttattagagcaa

SEQ ID NO: 40016 - DNA, 1159 bp, Heterodera glycines
  misc_feature (56)..(56): n is a, c, g, or t
ttttaattactgctttccaattgttaccctaccagtggtctttaactgaacacggnccaacatttcgcccttaatttttggtcaatttgcagaaatttctttgatccgatcaaagagtccgcgttccaatcaatgtaatgtaagcaccgacgagcaaagtccttagaaaagaatgaccaataagaaaaccagtgaagtggtaaatggtttaattttacataaaaataatttggtaaaataattaaccattaaattattccattgaaattacgcatatacatagtttaatgaacgacccggaaaaaaatggcacaaatgatctagcattggtttatttcaaagagttaagcatgaaaaatggggtcggggccgttttcgtacgagcacaagtttttgctataacttttttctttgccaaccaaatccaacattgttggtatcattcgatagccctatgtatcctctattagcctgcaaaattttgaaaaatttcgttaaggttcaaaaaagttatggccagaagaattcatcaaaaaaaccagattttccaacttttttggctcgaacttttttttaaactgaacatttaaacccattccgcaattggagaccattttttcgtgcttaactcttcgtgatgtaacaactgatatatcatttgtggcattttccggggcgttcacaaaacttcagccgaattaccaaaatatcattttgacattcgaaagtggccatgaatatttgatttgataaataagtaattatgattgtcaccttctccccaagggaattggccttagaatatgcgatgaaaacattgcgaagtttccaaatgggaaagtcggcacaagctttgatcagcccattgactttatattttttcgcttaatttatatttgtaaaattttaaagcttaaatattttaaaatttacctacgaaaagcacttcaaacagagtgtcatcgtttaatccatttaaatcatccaaataaatgtatcttagcattgctttgaaaggcccaatttcgacgtcggcgacttccacggggcttctcactttggaagggcctttgaaagcatttgtttgtttgttaagcatgggactgactttcaattttgtttttaaatttttcatgacggcccaacagaatctttctaa

SEQ ID NO: 40017 - DNA, 489 bp, Heterodera glycines
ttttgtttttagttaggctaatagagcatgttaagagctttcgaatgataccaagaatgttggatttggatgccaaagaaaaaagctatcgtgcaaaaacctgctggggcccaaacgtgagggcccaactgacgggttccgccatattcttgtcctttattttggcataagaaaatttcaaaaaatttatttaaaaatgttgcaaatgacttgcgatttttaggcaaatgcctaaaatttttgcgcacttaatacgcacagtaagcacgcaaaacgcattttccgcttggtttggggtgtctacgatgactttataatgcctaactttgcctatttggagtttttgcgcctaaggtccctattttaggatttttgaaaaaatccttaacaaaaatgcaatacgaatgaaaaatacacccctaagaaatgaccaaaaaaaaattccaagaaaatacacccctaagaattaaaaaaaattttcaacaaatt

SEQ ID NO: 40018 - DNA, 999 bp, Heterodera glycines
  misc_feature (938)..(938): n is a, c, g, or t
  misc_feature (943)..(943): n is a, c, g, or t
gcggtgcgcaatcgccatttaatttctttcctaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcatgagaggaagggcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaattttttaatttatcttatatccaagaaaaatgactatctcttattttgagaattttatacgttacaaaagcgctcgagcgtgagagggagggcggtgcgcaatcgccattttatttctcagagaatttttaaatttatcttatatccnagaanaatgactatctcttattttgagaaatttatacgttacaaatgctctcgagcatgat

SEQ ID NO: 40019 - DNA, 1077 bp, Heterodera glycines
tcgagatcactttttatgaacaggtgggggggggggggggggtgcggtccatctccgctcccctcccggggtgacctgcttgaaggtgagctcgaacagctccaaaaggtacagtaagtcgtctccggcggaaaatgcctcgcctcccaacccggcaattggcagtgccgttgaccttctgatgatgagattttgtcaatcaaacaaataccgtatgactaatcaaaaaatgacttacaacattttactgtgccaactttgatgactcattttaaattgtgttgagtggtaaatggagatgatcgccaatcagaaaaagaagtattgcaccaaaaaacaaaaaataaatcttacatattcgcatttgttgaaaccatggaaaccattttgatgctttgtaccgactttaaattaatgctataaatattttgccaaataaatttaaattagcgtattaaatattttgccaaaaaatttaattaatccatttaaaataaaaaattaattaaataaaaagaaacgtaagcttaaataaagaaacgtaaacaaatcaatagagatgtcaattttatgtaaatacatattttttcctggcttctccatgctctaaatacaggtacaggccaattgggaaatacaggtacagatacaggtacaggcttttttcaaaatgtcgatctctatttatgtacatatttttgacatccctacaaatcaagattgactttctcatttatcagagataattcgcttcagtataattttatttaaaaagtttaaaaatttttagttaagtgggaatgttgacgtccaatttaaaaattttggtaatttccttttttattgctttcattttgaccacgactcaatcacttggacaaaacgatggggatactaacgacggcgaaggcgatgaagacgacgataacccattggtgaagagggaggacaatgtcgtccttttaaatgcggacggtgaaaccgatgttttaaaacagtcgccaggttgaaacaaattccgacaaattaaggcaaagaaaaggaaaattttagttgtgaattgtctggtgaatcatc

SEQ ID NO: 40020 - DNA, 927 bp, Heterodera glycines
  misc_feature (910)..(910): n is a, c, g, or t
  misc_feature (921)..(921): n is a, c, g, or t
gttcatctctctttttgaaacggtttatatgtacaaacacgtaccctaattgataatttaaaaaatagcaaaaacctacaaaaaaaaaacaactttacattacagcaaaacgcaaacacacccttagagagtgcagagaaaaaatacatctctcattttgacgtactatttctttatctctgttcattaaagaaaaacagaatttactaattttcggtgtgtagttttgtgctatgtaaactctgcttaaaaattaattttgcataccgatagagaaaacaaaaaatctggtgattttgcaagggttttatggaagaaaattgagggtttctttatcctgtagagcatagctagagagcatagtcaatttgttattgtaaatttttggcttttttggccctttcactaaaacacccgaaaaaatagatcaaacaaaaacacaagcaaagatacattagtttaatgttattgcaatttttacttccattttaatgaccattcgtcttgggatcggatccgctcgacaaatgatgaatttattttgatttttttcaaagtattttacacttataaattggcacctttattgtgcctacccctctctattataatttacgtgaaaaattcaaaattattaattaaacaggaggcaaattataaataaatttaaaaagattgccctgtaatctgtgactgcagcttgaaatggactttataatctatcactggtttatgaacacttgagtcgacccaataaatactggtgtgatagatggcatggtttatcatttttaataaaatgccacacaattttgagtcctttctcccgttaatcgctaatgaataaaatttagtcgtaactcaaaaatggattaataaaataaatgtcagattcgttttctgcgcctanaataccatagnaaattt

SEQ ID NO: 40021 - DNA, 1432 bp, Heterodera glycines
atatagacctcaaaattcagattattgcttttctttgcatttgcggccaattttccaattttcgccattgggtctccggccatgtaaattaatgtaaatcaatgacctttttttgctttcaacaccgcttttttcgcggcacgttttttctcaagacttttggggaacaaggagggccggcggtgccgatagcgcgccgccgaggaaaaattttgtaatttttaatgcgatttgttaacagaatttgtaaaaaaaatgaccaattgattaagttttgggtttttaggatgcttaatatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgcgtgtaatcccatgactaaatgaaataaaatttaattttttctcaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccggtagcgatgctaatgaaggcgggaattaccgcacactaccggcagcggtacagtcactgctcgacataatttaatattaccactttacaccgtttatatatactattttttcatttaattgcaataattatctatctaattgattatataggctattgctataattttataaaaaggtatgaattaattcttttttagaataaatgttatatcattttttgtccggacttttagtgaaatttaatcatttatccaaaaaaaaagaatccattcataaggttgtccttaatccagctgaaagcatgcttctattccagtgtttttcaactataattaattttatattatttataatcagaattcatatggttggtcaatattatggggtgttaaactccggtaatgataacaaaaaagttgaaagccgacaaaatgtcaaaacaatgctcagacttatggataaatctgtcctgatcagccaatcggccccacctttttcacgtcctcctcctgttcatgagccctcaaactgtgcaccggtttgccctccggctcaatgtcgccctataaaatttgtaaatttaatggaaaagtcagagctttgaggtcgtatgtacggctttacctgtggtcctgtgtcggccgccactttgtcgtcctgtccccgcaatttgttggcacttttgtgccaattgccgacggccctacttcttggccgaacgcgtcatttagttgctgatcacaaaggccgtgaaaaatttcaactgcgcattttaaaaaataatatatttttg

SEQ ID NO: 40022 - DNA, 1685 bp, Heterodera glycines
aaatcatgtttcccactcccttctcccaggggtattactttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtccttttttccccaataaacttgtcaaaccccatttttcgcaccgtgaatgttatttttattgaattctgaaccgttttgagtagattagactagaaaaaattgaaaattttgaaatcatgtttcccactcccttgtcgcgtcccgaaaattaaacgctaaatttcgtcccccgagtgagtcatccattccctccctttgtgaatcgccgcctattttttcctttgtattggccctaaggacaggtgcagacaaaatgaacccctttttctcacgacaactccccccccgccccctttttctctacatataatcacttctgccgcttctgcttttcacttcaatttttcccccttttttcacttcgctttccatcgcttttcctattcgccgaaaatcgccaataaattcgttttcttttcaacttcgcctttggaaaataaagttttggtcagacttaattcgtggtcaaaacccagctaatcctaagttcgggttccccttcccatcccaaccacgacacaacggccgggaaacggctcgaaccctcaaatctcgtttcccattttcctaatcttattcttaaccaaaatgagtgctcctttccgagaacaaattcgccaagcctacgaagaggcacaagacattttgctggaccaaaaggattttcctctccccgctcgccaacccgaacacacggtaaccctttaccacgccgaactgcgttccatcctttccgaattggacacagaattgaaaaattccgaagaaattctcaaagaggtaaatgaaccgtacgaaaaatggatgtccctccgcacaagtatgaccggtaatgaacgaacccaagatggccccctctacgatgaatttgtcctaactgtcccatttctgagtgccatcacaaatctccgtaaatacatccgttcccttcggtcccaaagggcaaaaatcgaacaaagcataaccactgaccctggctcaaacaaaacattcccatccttggtacacctccccaaaaccaccctccctactttctctggtgactgcacctctttacaatcattttggaattcattttcgtccgctgtccatgatcagtctatccccgattcctcaaaattgttatctaaagcaatgcctttccggtcctctctgaac

SEQ ID NO: 40023 - DNA, 1010 bp, Heterodera glycines
  misc_feature (793)..(793): n is a, c, g, or t
cgaattgctgcgcggaaaacgagcaagaaatccatcattcttctttatcatcgactttgtttgaggttgaattgaaccctgaaaagaatatttttattttaaatatttattaattttaattgatttgattattttttacatattgtacaaaaattactgtagggcacttaggacggtgctaggccatttcgtaaaaatgccaattttacagatttttcgagttcagaatatttcattaagttttcagaaagttatggcaattttttaaacatgtttggtcaaactttttgaaaactcaatgaaattttctgcaatttttatggtaatagatagagcaagccgggagctaccgtatgatgataccaagcttatttaatttgatagggtttagaaaagttatgatggatttttcttgaaaaatcggtaagtttttacgaaacgacccagcaggctttaggactattaatctgaattaaataattgctgaaatccactttttcaaatgcattattacacttaaatagggttaatcagtgcccagagtacattaatgcatgttttatgtccttgaaaagtactgtgaatttagtagtgatgctcgagaccaaaaatttccgagactcgagaccgagactcgaccccgagactcgagaccgagacccaaaaccccgaaaccgagacccaaaaccccgagaccgagaccaaaaaaacccgagacccgagacttttttcaaaaattttttcttacacacttaaaaatcgaaaaaaatcaatcttttgagtttttttctcnaaaatttttgtttttttccttatttaagctaccatacatttttccttttcatatgattgacttttttacaccattttttgtggtgctctttttcaaaaaatgtttcggaacaagggggtcccgcgggtgcccgataagccgccgccgggaaaattttttaaaaattttactgccattttggtaaccggatttggtcccaaaaaatgacccaaatttt

SEQ ID NO: 40024 - DNA, 945 bp, Heterodera glycines
cggttggacttggacatgggcggtgggcgcatcctcgcctgcagcgtcgattcatcagttcgcgtttggtctttggagggccaacggctgagggtatgcctattttttgggtttatcccttaatccgttttcaaatgctaattaaaataaccccatgggtttttcgcttttggatatttcattggtcccattaattgtcagttcactttcaccggccattccgagaaagtgaccaccgcacgctttttcaattcgggtcggtcggtggtctccgggtccaatgaccgcacaatcaaagtttgggacattgtgaagagcatatgtgagatgagcaatcgataggacaaatgcgaaataagaaacagagatttcaggtcagaaaacgctttttcctgcttcgacagtggccgatttggtgtccaatgaaaggggcattggttgtccattggtcggtcgattacggcacggaatcgaacaatccgttgcatcgaaatctctttagatcagttgccatttcgacaaaagcattcgcttttgggactttcggtcgggtgaccaaccggcaaaatttctaaaattgggcgcgcgtgtcacgtcgttggacatcacttcgggtgaattctttgcagtgccatgggacgacactcgaccatttcttatggacttttcccacagattgtcgttcccttctctgttcggctcgtgatgaaacgctgactctgatcgatctgcgcacttttgccactttgcacatttacaggtccatccctccgtccattcgtccgtctctctctctctctcttctttttaccacttttctttagtgccgaacaataccgaacttcgtccgactttggccgtgccgtggtcagtccgtccgattcttttgttgcctccggctccgccgatggtcacatttttgtatggaatttgctgaccactcgg

SEQ ID NO: 40025 - DNA, 998 bp, Heterodera glycines
caaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggatagcttccctatagcctgtactttaattctgcgttggattttgctccccataattgtttgagtaccccaaacggacacttgaaaaaatcgattttttttgttttcggggcagtccccccgaccgatgcgcccaattatgggg

SEQ ID NO: 40026 - DNA, 1290 bp, Heterodera glycines
acttgaaaaaatcgatttttttgtttcataaatatttttttcagaaagtgctctaaagtgcaccaaaaatttatttacaacttaattttagcactctgatgctttagtatcaaaaaggaagatggagaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagcgggggggggggcggactctttttgagaaagcgttccccgtttcagagcaatgttcaaagaaagctcatgaccaatttctagccgaccttgcgagcattctaccgagtaacaacacaccgctcattgacagtgatgctggctttaaagtgccatggtataaatccgttgagaagctgggttggtactgattaagtcgagtaagaggaaaagtacaatatgcagacgtaggagcggaaaactggaaacctatcagcaacttacatgatatgtcatctagtcagatccaagtctttaggctataagagtctggctaaaagcaatacaatgtcatgccaaattctattgtataaatatcgctctgaaggtagaaaaaatattcactaggcacgcccccccccccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataaggctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttgagccagctagctcggcgctcatttcagagtgagttagtcctttaccggggagtatccctgcaaagt

SEQ ID NO: 40027 - DNA, 1075 bp, Heterodera glycines
atcaaactgatgtggaagagggaagagaatcagcagggggaagaggtgatttggggcagaaaattgggcaatgatttttcaaagatttttcggaaattgctcgaatgatcaaagtgatcagtgattttttcaaaattaattgctaattgtaagaagggaacatattgtcgtgtaggagggtttaattgattttcaattgtaaatttttgggttttttccctccggctccaaaattgaaaagaaaaaccaaacactttgaaaatattaacaaaaacacgttaatttaatgcgattttcctcatattttaatgaccatttgtcttggggtcggatcagctcgccaaaaacttttttttcatattgaaaattcttttcgaataaatttatttgaaaattatttttctcaatagaaaaataattttttcaaataaaaaatttgaggcaacttgttttcacgaattgaaatgctttcgctttaagtctcaaaaatcgaattgtttgaaattctcgaaaatttgaacacaatttgtgagaaattttgtatccaaattttggaaatcataaacccatatttcactttttttaaaaatgagtttgaaatttgccaacgagaattttactctcgagccaagtctcgagcgtcaatcaaatttttttaattgaggaattaattaattgaatcgcaaaagttcaaaagggtccgccggcatcttcacaagcgattgcttccgctgcaatgtgccgaaagatggaatgcgaattgggatgcactgttcttgacaggagagctgttgttggcgagaaatttctgacaagagaaaaagttttgaaaagagaaagtttctgaacatttggcattctatttttaagaattttcagaaaatcaatgcatgatcctgctgaatcctgcataaaaatcaaatttgcgggtcctgttgcaggattggaattctaaatttttcacaggacaggatccggcaggattaatcctgccaatcctgtaaatcctgtattttccaaaatatgcaggatctgcggactcgggatcctgcaaaatcctgcgcaggatcctgcc

SEQ ID NO: 40028 - DNA, 79 bp, Heterodera glycines
ccccccccctcccctcaacattttgctatttttctccccccccccctcaacattttgctctttttcaaccccccccccc

SEQ ID NO: 40029 - DNA, 1321 bp, Heterodera glycines
  misc_feature (1167)..(1167): n is a, c, g, or t
cctgacgagttatgggcccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaacttggtttgatagcctttcaaatactacacatttttgctcagaaacaatttttcggtcaaagcaacccctggcgagttattcgcctggtactgaagtgtactttttgagcacacttcagttagccaagcgtgcaggccagggggtggctctaataaaaaaataaaaaataccagcatgtagaggacagttgtggggagtgccctcacagcgagcactttttgatccgagttttagaaaaaaagttacgggccctaaactgcaagaaaaagtgagaaatcggtccccgggactcagtcgtccgcgcagaatttttctctataattttcccagatgcgcctcaaaaagttgtaagacccttccactactttcagggcgctcccggccttcggccgggagattttgtttttgcaaacgaaactccttgtcaatataacgtatatagtaaaatgactatctcttattttgagaaattttatacgttacaaaagccgagcgtgagagggagggcggtgcgcaatcgccatttaatttctcagagaatttttaaatttatcttatatccaagaaattgactatctcttattttgagaaattttatacgttacaaatgctctcgagcttgataggaagggcggtgcgcaatcgccatttaatttctcggagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaggggcggtgcgcaatcggcatttaatttctcggagaatttttanatttatcttatatccaagaaaaatgactatctcttattttgagaaattttatacgttacaaaagcgctcgagcgtgagagggagggcggtgcgcaatcgccatttaatttctcagagaatttttaatttatcttatatccaagaaaaatgacta

SEQ ID NO: 40030 - DNA, 1002 bp, Heterodera glycines
ttttttgggaccacagaaaattcttttccttttcaggaggcggtcgattggacgaggaaatgaattttttacccaatgccaaattaaactatcatcggagagagaaacgggccgtttcaccgattgtcgcgcaaaataatcggacggagacaaaagcggcaaatgttgccgaattgccgacagaaaacacatttggtggcggttttcaagtggttttcccttttcacatcacatttctcattcacttctcttcaggttgtcattcaaactccggaggttcccggagaaaacattctgacgcgggaaggactgcaaaggcacgtcgccattttggaagaaatctccaaattcagcgtggaaatgttcggcgagtacgatttacacatttaacccaaaacaaataattttccattgaatttgtcttctttttagaaaatggcatttgtccgacatttgctttaaaccgcccccgccagcctctgccaaagacgaattggcccagtttatgggcgacatcatgtctcagattattccctgcgtttggatcactcccatcgattgcttttgggagggctccaaaccgcttggtccattcccagaatacgacctgtaagacattcataaaatcggattactattatgatttagaggtccttttgcccaatttgtccctttcgtgccaaatggaaaactttcatggaaaacgttgaacccggaagctctgttaaacacgacgcgttcttttgttgatgttggaatggttggcgaactgttcgaacgtgtgggtgctttggtttactcgttttgctagcataaaacaaataatttaggccggcattggcgaggcgtaccaagacaggccctgcatcgacccgttggacccggactgtccgtcgacagcacccaatcacttcgaccgttgtgcggcatatgaacatttttcaaaatggaactctgaactaccaccggaccgtcgtgtcattttgcgctcttcgaatggga

SEQ ID NO: 40031 - DNA, 1252 bp, Heterodera glycines
  misc_feature (13)..(13): n is a, c, g, or t
  misc_feature (618)..(618): n is a, c, g, or t
aaaaatccaattnacagttacgccccgggtgccaacgaatgtaaaaaagcgtgccttatccccgctgccgtcctccttctccacaggttcggtgttcgccttgtcgtccaattcaagtggtgccaatccgagttttgccctcaatttgttcgtctcttcgatggacagcgactcgacactaaacaaatgcattttgttttgccaaatgccaacctttcagaattgtggtgtcaaacccggcctctcccgctctttcgccgtcgtcccccggcgatgtgtcgcgatgctttttatgcctggacgaccttaagaaaattatgcggtttttcaagccttttaggtcgaacccatttccgtactttttggggctgcgcgagcgatgccgtcgatgcgtttgatttccaaattcatcgtcgtcgtcgcgctttttcttcagctcttgtgttgtgtcgaaatccaattccttcttccgctttcgctcatatttatctgatggcattgttttgctgaaaatttcccagtcaaatttcctaaattgaaattaattaattgatactttgtgaccaagtaataagcctcaaaatttaattatattcatttgtcagtggtaaataaacncgggcgcgggacgggaacccaagtgttctactccaatccacgcgtgtcctcttggttttcacctgccacttgagcttgtgttggaatggcaacaactgcttgtccactcgtttgtggttcgatgatcattatatcatcatgatcatctacttcaactggctcagcggccttggatgtcgatggagcctcatccgcatgtcgatagacaattgggcacggagtaggtaccccttcccttggatgatatggaacattatcagagttatacagctcgttaatgtgccacaatatgcgccgcttttcataattgatggacaaatctggcagaacaaacgtgcgattgttcatgagccatgattcagcatataggcacacgaagtacccgcagctgttaccatcgtgttgtaccgtaagatttacggcattaaaaatcccggtcaacactgttgacggcaaaatgtcagaaatgatctttccaattttttccgtcagttgccaatccaacctgccataaggagtaggcaaagaatcgagaatatgtgtaccgcactgaacatcatggataattagagtccaatgtccagggaaatgtactggcaaaaaaatgacttctggctgaaacatttgggtcata

SEQ ID NO: 40032 - DNA, 1146 bp, Heterodera glycines
  misc_feature (1047)..(1047): n is a, c, g, or t
ccagggttcgcagatctgaggctttagcctcattttgtggttttttgataggtcaatgaggctaattttcaaaattagactttgaggctttttgtggttttttgagaaattttgaggcttttggggaaaatcctcagaatcttttaaattttgataaattggcataatgtttggcaatttaaagaatttttttaatgaaaatatgcaaaaaatatggtcaaaattcttattttttcccccggcggcgcctatcggcaccgccggaccgtaaaaatccttaatttacaagcaaaaatttgctcaaattcgcaaaatttggtcatttttcggacaaaatctgttaacaaatcgcattgaaaattacaaaatttttcccggcggcgcctatcggcaccgccggcccccatttcgccccaaaagttttttgggaaaagcgccgcaaaaaaatcaacttcgtttttcatgatccaaaaaaatgcttatttctaacaaaaaaaatgctcaaattgatcatggacaatcaaaaatataacatatgaacattttaaacgtgtttagaaaatcgacaccagaaaccttttatttgaaatgaaaaataaataaaagtttatttataatttattaataaaaaaaaatacaaagtctcattattttatttgaatttacgactcatattaccctaattagtaaatcgagtaaaatatttatttaagaattttttcgtccctaaaaacgttgtcctaattattttttaccatttaaaaagataaaaaattgcactaaataataactcaattgagattacttaataatttattaatcaaaaagataataaaagctgtgatattgtttcatttggaatttaaaattccaattaccagagagaataagaggtactattaaatgaaattttcaataatattaaatatatatagcaaaattgattattaaaaaataattataatgcaaaactgagcagcgattaacaaaaaccaaatataaaaaatcaatgataaattaaattggtttgaataaataacaaaattncaatttcatacaatgattaattcataacgtaatgtataacagtatgagactttagagcagaagagatcgtttttatcttaatctaaaaattcataaaaa

SEQ ID NO: 40033 - DNA, 681 bp, Heterodera glycines
ttcttgcgttttgatgatttgaattattcatttaagtctactgcttcaatgggaaatgctatgaatggatttcatggtggaggaggaggactgtggtgaacaaatggtggtgtatgatgaatggagaagccaaccaacccaaataaattgatttgcatatttaatattgccattctgcatttgatgtaatgggggtgaggggataaagtgattcacagaaatttacggaaacggatggaaaaataaaaattgataaagtttgacttggtccgtgtacggggcgaccgcctcacaccctgagtgatattgccgctcgttagatctcgacaacttaagtccgcgggtgggaagcaacgtaagcctcccaatccctcttcagcccctgttggcagctaaagccatacacctggcctatccatacgcgtgtgggaagcaacgtaagcctcccaatccctcctcagctcctgcccggtgttggcaggtaaagccatacacccggcctatccatccgtgggtgggaagcaacgtaagcctcccaatccctcctcagcccctgcccggtgttggcaggtaaagccatacacccggcctatccatccgtgggtgggaagcaacgtaagcctctcaatccctcctcagcccctgtcggatgttggcagctaaagccatacactcggccta

SEQ ID NO: 40034 - DNA, 1087 bp, Heterodera glycines
acatcaacaacgaaatattttttgaaaactataatagcttttaaactcgcgaagttttcaaagggtaccgaattaataaaaaaaaatggttcataagaagaaaattaagcgccctaaatttggctaattgtcagactgagttgacccctgtgggtgaagtgttggattagcgccgggagcgtttcccccttcttatcctagctggctgggcctctggtttttggttagcagattatgtacatggcccaaaaagccatttgattggattttaacctaataatgattcgcacatgtaaaaataaataaacaaaacatacaaagattcaaattttttgcattttacatgctttaacctttttccgaatgcttaaatcgcttaaaacccgtaatatttggggatttgaaatgattcaaatgctaaaagatttccaaaaattttaaaggccaattccatctaagtaaatagcgtaaaatttttgctgctgcaaaaggtctcgtctttgctgctgttgggtgttggttggtcaactgttattgggggggggggggttggcatcgccgccgtcgccgccgcgggcgccccaccggcggagcagcacaaatgcaaattaaacactccccccgggggaggggggcggggcggggggcaaaattggggttattgccatggctgcgcgacgggtggggggagaggcgcggccggccgcgtcgtaatggcgcggcagatggtcgaccggccaaaattggcaatcgaatttttgggtgggcgagaaatgggggcacaatgtgtgcacagcagcagaacaaaatgttagaggacagtcgaatttgtagtcgtctcgggacaacaattcagtgtgccatttgtagtgctcgagaatgtcggtctcgataaaggtctcgtctttttattcgagtttggtctcgagaaaagtattagggttctttggtctattttcgaaaaaaatatttgagaaaaatcccgtttttattagggtattattgatctatcaaaacgattctcgtcaaattttgaagttaaatttggcaagaaaagctttaaaactgatttaaattagtttgatat

SEQ ID NO: 40035 - DNA, 1169 bp, Heterodera glycines
tttatcatatgctaaatgcttcaccagttttcttatatcaacaactttttttaaaagttcttaccaaaaatccaaaatttttcggttttaaagagtataatttttaaattcctaaaaaggtcgatcttaggggtgtatttttcatttttattgcatttttcttatgaaaatttcccaaaaatgaccgaaatatgctctaaaaacgcaaaatggcaaaatatgaatttgttctcgaaaacccccaaaatataacaacacctgggacctatttcaattcggatcaagtcctcaacttgatgactcgacttgacgaacaaatcgagtgtttagtttcaattaatttttatttatgacttcatctcatcaagtgttgaattacactcgatgtaatttcataatcgagtgtgagaatttaaaatcgaataaataggtttatgttttaattacattttaaagactcgacttgattttttgcacttgatgtacacaaaaacaaaaacaaatttcaaaacggcatatctaaatagaacaaagggtcgagttaagcttaaaaaacaaaaaccaattataaaatcaaaaaatcactagtaaaatacaacaatccaatttactcatgtaaaaaaaatttctttcgaaattgtttttttaataaatcattttaagaagcgttaagtatttcatcatttttattatagattttatttcacaaaagtgcatgtctaacaaaattcctaaaatcttgggaaacatttagagccagaaatatagacccgaacatctctctaccctaaatttccccataaattgccaaatttggtttttttaattagaaatttttttaaaagaagtaaaaataatttgcaaattcaatttttcaaggaaaatttttttgaaaattttttctcactaccgtacttgctcgattatagccccggggggctctattttctaactccctcaaaagggggggggggggacattattcgagaggggggttctaatcgagagggagtttctaatcgagcaagttcggtatctttaatttggactgtttggcgtttaaaaatttagttttttttatgaatcttatcagattataaaaacctcatccaggatttactttggcttagaagaccaatgccttccataaaatttaagctattgagcat

SEQ ID NO: 40036 - DNA, 1122 bp, Heterodera glycines
ttagttgatcagtgtcaaaaacataaggaacatatatgcaggatagctgcattaataagaaaaagaaattaaagaatctatagaagtaaaggaatattaattacgtaaattgtgtattaaatgctgcaaaaattcttcctatgtttataacaaaacactgaaattataatttacacgttaaaataaaaattaaataaaatatttgtcgaaaatctcttaaataggtgtctccaacaatgtttatcaatagcatactaataataaaaaattttttcttcaatgaactacgttaagctagaagccaacaagaaaattaaaaaacaaaaaagcaaagaaaaaattatttaataataatgcagaaatattgaaaaattcactaggccgaaatccgaaatcgaaaaaaagaacggtcataaatgtaatttaaaaaaattataacgaaatacgagtaatacaaataaaataatattttttctaaaaagtaattgatccttaagtacagtaacatgctttgaaaatgccattaacaagaaaacatttcacaagctaatttatttaatacgtgaataactagtaaaatgatagcatcttttctgacccagctaaaaacatacctgaggaaacatacaataagtgagtttatttagcaaaagttaaaaaaagtaattaaaacctaaagcaataaaatattaaatataaaaaataaaatattcagaaatctttattttttaaaaatagaaccaaggatgaaggcttgaatatgaaacaaggtggatcaattggacggaattaactttccttaatcatacatttaaaaaatgattgactataatttttgggtattataattcctattttaaaactaataactattcgaatttttgtaaaaattctttctctaaaaaaaataatttgtaaattttatgtagctaagaattttttgatcaaataccgataaaaatgacaacctgaataatttttctttaatatattcctttttcatatatttttatttctttagtatccgtataccattgcaatgagccccactagtttgtgtccgcccattgtgttatttcttacaatttgtagaatttattacttatattaattattaactta

SEQ ID NO: 40037 - DNA, 1032 bp, Heterodera glycines
  misc_feature (1024)..(1024): n is a, c, g, or t
ttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcatcataaagctttaagggagacaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctaaattacagatgcttttcaaattttgggtgtatccgaatagaaagaagttggaaatcagtacttttcacgcctataaaattcgggccgaaaaaattggtgtttgtgactagaaaaatagcagatgcatatcaaatgactacagaaaattacagcctccaagaaaataattgctttgcacaagcaatattttgtagagcccatcaaacacattgtgcttataggaaaggcagaattaaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcaacggcaaatccaaaatagacaacgacgctttcattataaagctttattggaggcaaagtaatacgaatatttcaatttcttacttatcagaatagacaaagataggttacacacgaacatttttatagaaattccggctgaaactaaaatccctcttttggtcttaacttatgaatttttggccccattatggacgaanttaagtat

SEQ ID NO: 40038 - DNA, 673 bp, Heterodera glycines
  misc_feature (58)..(58): n is a, c, g, or t
caccgacaccaaaaacatggtaattgtctcaggtatgcctttagagaaattttatggntaattattactttttgttcatactttgattttaaaaaatgggaaaatgggggtctgatggtaccgttaggctccgtcgggaaaatttagattattgtgcaaaattaaaatgcagtcgtttaatcccataacaagctccagtcgtattttcccgcatctctttttaataacaattttctcgtaaggtcgttccggcgacagaacccttgcttctaagctgatcagaatcgctgagtcgagagagaagaagagggcgacaaacaacatggtcacattggaagtgaaggtcattgttggttgtcatgtgtaaatgtgttaaccatttaaagttcggaactttagagacggataaaattggaaggggccgaattggaggcgtatttgatgaagaagcgagagaaggaacaggaggcagcgaggataaggtgtcattggcattccattttttccaatgccaaattcaatttgaatcgttaggcttgagactgttcgccggaatgccaggcttgagaatgtcgagtcgtccgaagactcagatgacgaagaaacgttggctgctgtcgttgcctcagtgacgacaagcggaaagaatggaaatttggccaacaaaaagcca

SEQ ID NO: 40039 - DNA, 1329 bp, Heterodera glycines
aaaattttcgattctgatgtcattatcggtcactgacttcctattttggcgacttcgtcactaaaatagttaaaaatcactattttggcgttttgtcactatttcgacattttttggaaaattccttaacaaaaatgcaataaaaccaaaaaatacacccctaagaatcgacctaaaaaaatttcaaaaaaatacacccctaagaatcgtcgagctaaaatttttcaaaatatactcctatgaaatgaaaaaaatttttttgaaaaacttattttttagaacaaaacaaaggttgtcgagaaaaattcggcataacttttcttaaatacaacctaaaaaaataatttcgaatcatacgatagctcttggcttgctctataaacatgaaaaatttcagaatatttcattaagttttctgaaagttatgtctatttttttaacatttttggtcataattttttaaaaactcaatgaaattttctgaacctttttaggctaatagagcaagcgaagagcaattgtatgatatcaagattatttaatgggttatgtttaagaaaagttatgacggatttttctcgaaaaatctgtaaattggcagtttttacgaaacgacctatgtagcaccaattcttttatttattaattcaaaggtttttttgcccaaatgttcgcttttcaagctaaataacggctttattctcgggtcctctcttttggtccccgttcattttgtccttttcttagaaatcgaggggagaatggcgccactcattttctgtttcaattttaagaaaatttaatggaccaaacattttgtttatgtatttatggtttttgaattttcactgctaacgaattgtttgtatttataaagagaaaagatatttaaatttagtaataattcaatgaattcgcgaataaaaggacaataaaacgctaattaacaaagaattcattagtaagtccatttttcaaagggttaattaagcaaagaattcggctgtgatattttaggcaagaaaatgatcatttgatcggcaaaaaactaattcgaaaaaaaccaaacaatgacaaaaggaaatttctaagtaacgaatgaaacatgtggacacttctgggaatttaaataccatttttggcattttcaaacccaaaagggtgtaatttactagaaatataaatttgaaagcacgcaatttgttcggtaaaaagagtggtcattaaaacggaaattctgctgctgaattgggccgatgtgtatgacgcccattatgaggaagaagccccaatgtggcgtgctgctgacgtaaaagcataaaaaataat

SEQ ID NO: 40040 - DNA, 1010 bp, Heterodera glycines
tgcctgaagaatataaatttgactgaacaaaggcggcggcaaaaatgaaagttttgcttttttcttgtttcctaattgggatatttcatttgtattgtagctaaacatagatattttaagttttttccttgtttataattgacaaaaaaaacatttgtaagagttatgggcaaaaacagcttgccagactaaaacgaccctctgactaaaccggccagactaaaacggccagactaaaacggccagactaaaccggccagactaaactgacccggtccgtaaaaagtaccctgtaaactgtataagtgtacccctgtttttgcctttaaatcctttacacggagttggtattcagaatttagcacccgtctcacggactgaaattccgaatgatgttttagccatttttcgaatcttccgcttctctgttgtccctattttaaagcatatcccgatatttgtttttggccccattctctgttaaatttcactttcgtcaatttacggaattgtatcattcgggaaacgccgtgtttgagggcgcgtacaacgatggacacgttgtgctcatacctgatggtgaacaaagcaacagtggataagtgatcggcactcatctccaattgtgatcggaaaaaagcgatatctaattttgtattgtacataaataggttattcggacaataaaactgtaatgtgcatttttaaattggctgtggttttctaaattttgtggcaccgctcaactcgccgcacctttgttttatgctttctcgccgccattgaaaaaatgaatgggagaaaattagattcgataaatcatttaacgaaatattcttaatcagaactttttccctaaatccgcttgcaaaagaaaaaccaaaattctagctatttttttatcgggaccaccaattttgaccatttgcccgttgctgaagggagcaacccccgaaaatccatgaatgaattcttcctgattttattatggaaaaaatttttttgcaatc

SEQ ID NO: 40041 - DNA, 1310 bp, Heterodera glycines
  misc_feature (1301)..(1301): n is a, c, g, or t
tgttaacatattttagtgcaatttgtgttgaaatgatccttcttggattaataatttatttcttatcttcttttctaatttgtgattcgtattaggcggacggtcttgaagcgcattttagttttataattaatttttcatatcagaaatttttattttttaaaatatttttgtttattttaaatttgtttatattttcaaatgctccacagtgacattataagtttttattttttttatttcaactgatgaataaataattttcttttttttaataaacaaatgacttttagaattaaaatgaatgtttttagtttatatttcagcagctttcattaattatttatgcattaatgctcgaacctcgcggattacggcttgatgctgatggctttgttcataatctgcagtgaaagattttcccttaaataatgtttttttcatcttttaaattttatgttgcactgaaaaaattaatttcctttttattataagatttttacttaaacagaagaatctattttattatacctttttttgatgatgctattgcaaaccaaaatttttagtaataataataatatagtataagcaaattaaaccatatttttaaaagtttttcgaattttttaaagtttattataatttattaacgagaagcagtagttacatataccgacttatcgcagtgcgcgaaatgtttttcgcgcacaaacgccagggtgtcgggcggttttgtgtttgaagttgccgcttttggcaggtgttcgggattggtgggggcgggattctctttgaaggcgccgacatcccgagggtattggcgggtttcgggaagtgattgattgattgatttatggtcgggagggggggggtgctaattgcgcgaaattttgattgatttatggactcgaaaaagggagggtggtggtagggggaatggggaatgcagcgcgagttatcgcaatgcgcgaaaacaatggaaatgaatgagggggagtgcgctgggtggcggcggtgacatctggcaacttgtcgtcgctcaacggaattttgacaggatgcgggggggggggggggagagatgtcagagaaaggatggaagggtataatatgcagtggtttggctgaggggggggggaattcaatggaaaatttggagaaggaaatattattaatgtgaagctggcggcaccgtcttttgtatatggcggccattgttcggacacttctgttgatcgttgacagaattgtaagtatctttgggagaaatgggtcgcttggacatcactttctttccnccaataaac

SEQ ID NO: 40042 - DNA, 705 bp, Heterodera glycines
  misc_feature (32)..(33): n is a, c, g, or t
  misc_feature (48)..(48): n is a, c, g, or t
  misc_feature (64)..(64): n is a, c, g, or t
ctttatgtttagtagaagtgtatgtttcaccnncgcccaatttctttntaattgtaaaaaaatntagtaatttctcgggggttttattttcaaaataagtcgaacagttcgccatcccaactcacctatgactaacaatagctgggaatgcaacgattgcaaaatgtcattttcattggccttccgtgtcccattccttccgattgaaaattctgactaaatatcaaattaacaaaacaatgaagggtcgtcaaatatactttatttggttcgcccttgtttatgtactccaaattgcaagtctgcgcaatgacggtctccctcatgttgcgaattttgtcttcagaacataaaagctgtcgcagcagcgctcgtccgttccgcccgtcacacgggtcgtcagaatgcggatgaccatccgcagaaggcgttgccgacacttcaccagcaacaggaacaaagtcgactcccttggaggaaccgtctcgtaaatggctacaaaaggcgaagcgtaatttaccgacacattcggaggcaccacttttgtaccttttgctaccactcgaaatgaacgttttcgcggaatgggctcatcattttcatcaaaagagaattgctgatgcgaacgttgctggtgagaaacaaagtgagcggaagacgtcatcggatttgggggcacagaagaggggggatttgagggagcga

SEQ ID NO: 40043 - DNA, 620 bp, Heterodera glycines
gtacatttttaaatactttaaaatatatttaatttttttcagtaaaaagtgggaagatttaaatggcagtgagtattctaaacggaaaaatgatacccttccgatttgcagcatttgggacgtcgggaaaaagttttttgtttttgtttacattcccgtcacatttcgtaatgactttttctcccccccccccccttttgggcatctatttttattgctttctttattttgggaccattttttaattttgattaactaaatttttggagaatttttctcacaattttccatttttgaatattctattaccaattggtaaacttaaaactttataagtacacaaacatttaaaatttggtcacgtgattaatctcatctcattaattggttccttctcgtcctccccgtccattgtttaactgtttaaattttagtgtaatttttgtgtcaaaaattggcgaactgtcagtcacccaacaaatttttttccctttgtctatgctccatctccccacccattcacctacacactaaagtgtcgctggaatttggtgaagaatgggaaggcgggggggggggagaaaggacatcggaatgtgaggggggggggggggtggagg

SEQ ID NO: 40044 - DNA, 875 bp, Heterodera glycines
ggggggggggagagcaatggcctttttattctccagggaatttttaatttatttttttgccagaaaaatggtatctctttttttgagaaattttttccatacaaatattctcagcatgggcagaggggggcggagagcaatgtccattctattctacaggggaatttttaaatttattctctatgccagaaaaatggttatctcttttttgcgagaaattttgtaccatacacatattcccagcatgggcagaggggcgcggagagcaatgccatttctattctacagggaattttataatttattctctatgtcagaaaaatggttatctcttttttgtgagatattttgtaccatacaaatgttcccagcatgggcagaggggcgcagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgt

SEQ ID NO: 40045 - DNA, 594 bp, Heterodera glycines
aactttataactctattattatcatgttcttgtcctttttaggaggtcattgactcagtcgtggccagattcgacgctgatgaccagttgctatgctccctgcctgtctgtgccccttacacatcgatgcaacgtttcaaattcaaagtgattttgcattggtccgtttcttgacaaaatcaaacattatttaggttaaactgactcctggcatgttcaaacgtggaaaagcggtgaagcaagcgcttgagctgtttaatgttcgtcagttaaataaaaacccatcaattgcaattcccgttttagcgtgacaaatctctctcgcaagctgaagtgactctcctcaaaagtcttacgggtgaaatcgaacgagtaactcaattattgccgtcgaaggttcgcgtgtcggcgccagcaatgaatgtgattaaaagaaaaaaatgattttcaccagaatataaacatacacatcgaatatgcatttttgaagcactcggggtcccattgaaaaataaagatatgttcatgtactaccagttttctctgcttggggagaagtcactagaacgggcccagtacccggtttttaccggg

SEQ ID NO: 40046 - DNA, 360 bp, Heterodera glycines
acaatatatacatacatacatagaatgcttctcacttctcctgttcttcacttcaccatttccattgacttcactgttctgcattggaataaagcgcacttctctaaccgtctactcgctcattattcccccactctttggctggtcccccgtgttttccgcccattcgtctctccgcccgccgcccttcttagcccttccgttgccccctcgtggtcatcccccctcccggtcgttgtccatcccctttgtgcgacaagtgctgtccccgtggcggctccataaaaccttgattttcattgataaagtattttttgaggaaatacttttgaaccaaacctcatttgcctgattgatcta

SEQ ID NO: 40047 - DNA, 730 bp, Heterodera glycines
aaatgttctacggttatggcaataaaattgccaaattgttgatgtttgtcaccaattttgccattttcctcatcggcgtccgcttcttcgttgcattttcggtaaacacaaataattgcaaaattttctttattaatttggaaattagaagtaatatattgacttttcagcccaaattcggaaccaagtttcccgactttgacagtgaggcgcactttgtggatgaattggacaaggtatttaactgggcgaaaattggttaggttcttataatccattgggtgaaatttgagaacagagtttcccaaaaaattgtagccatttaaaaaaatgaaatatttgatgttttcgtttaaaattgaatttgactaccaacaaaatggttttgcatgtttaaattatacaacataattttgtcccattccgaaccctggattcgaataaaactcgaaaattattttttgaacaaaaacggcacattttcaatttagcccctccccccccccccccccccccgaaaaaaccacatggggacccagcaaaaattttttgtcataaaaagtcgtgaagacttgttactagggattttggggttgctaatcacgaatctaacatcgatttttgcaaatcttttaccataactcgaactgaaagtcgaaaacttaagttttttggatttcgcttttttaaatcgaatttaggtttgggattcgaaattaggattaaatat

SEQ ID NO: 40048 - DNA, 946 bp, Heterodera glycines
taacatgcaatttattggttttttaaggtggaaaagataaattggggattttttggtaatttattaaaaattttgttcaaaaagaattaatttcttagaaatgtaaaaataagatattaggcctaaaaccccaaaaacaaagttttatttagttttcagtctccattccatattttcagaaatttttttacgaaattttttttattttttcccaaaattgtccgcaaatgtccgtccgcaaatgccccactgcggcgttaatactatattttattttttcttatttaattgatttaatattatctaatttattttaccttttcattatattactttttattttttgcatattattttaccaaaagtgtaattaaatttgattttatcgtttatttttattacattttttaaatatgctaagcttcaaacgcatttattaattaaaatatgtcaaaatctttcttccaaagacttacaattattctgtttttttattattaattagtttaatatttttatagaaccatttttctctaaggcctttaatattttggttttaaataaagttgatatgtttatttaaatttttaacatttgtaattttattaattaaaatttgtattttcatacataaaagacaataacttttttatcatgcatttttgtaccaaaatggaattacaattatgacaaaatcaaaagtgatattagtcaaatccaataaaccgttaaatgataataaaataaattcattggtgtccccatttttaaaattgaaattgtttaattgcttgatttatatgccttaatttaaagttaaataatttgaataataaaattttttaataattagtccatttgtcaaattacaggttggttttattattcataattaaaaataacaccaatatatatataatatcgttagacaaaaaataaaactgtt

SEQ ID NO: 40049 - DNA, 1302 bp, Heterodera glycines
  misc_feature (1293)..(1293): n is a, c, g, or t
atttgagtgaaaaactgtaattgaaagaaatgttgataccatttcaattccattttgaggcgattgaattttagcgattgattggttcagataaatgaaatatcaattaattaatattaagttttgcgaaacaactataataatttgagaatataatttaaatatttttaaatgaaaatattttttgcggtgcgcgctatcgaaaattctcttttcagaaaattggataaattcatttaatatattttcttgctaaatacaaaaatcaaacagcttacctatctggatatcaaaaacgaactccacgatcatttcgttcaattcagtcactcatcattcagttcattgtttgtgtgagccggtcaatccgggcatggaaatcacattgttcgtgccaggcacattttgttgcgagtggtctccttgaattacagcataattaattagtgacaagttctccataattggttttacccttggggccgtcaaatgacactttggcaatgctaatgccaaactcggcacatttcgagtcaatttcactgatttgcccaccaaactgggcactcaatgcctgccattcgctgttgttgctggcatgggaagaagcggaggcggcaatggcgaacatggcacggacgaagccgaggctgtgggcacactcatctaaaaggcggaaaatataaaaataattaaaataaaataagttaattggctaatttggcaatggatttgatccattagtccatcaataccagaagaatggttggcaagagatgcttcgatgtcggccaaaagagttgcgtcgccgcccttcgagcagccgatcagttggcctttcaatgcgcccgcaacacttttggcatccaaacaaagcgatgacttggaaaaggaatgggcgaaagtgccaacgtaattggccatcagcgaaaccactttttgactgccgggacagcacggatctgcagaaaacaattaataattgcaattaattaattatagttagttaagaaagattaattacgcggtgctgaaacacaacatttgcacagcaaacagaaaactgctacgatggcgagaagagagacggacgaagaaggagaagacatttttgaatgattttggctgatttggtggaatgaataaatgatgctggttggttgatgggattggcttattcatattgcttaaatacgcttttttgttggaaagtgccgacattctttccaagttggcattggctggcggcggctttttctttttgagaggaaattgttggatattttcaaagantattttcct

SEQ ID NO: 40050 - DNA, 1062 bp, Heterodera glycines
ccccatttgatgctaattaataaataaattaataatatccttattcaatgttgcctcattttatgttttgatttaattttaatcctaaaatcattggttagatcattcttctaaatttcgttaatttaccattggtccaatgctcgatttttttggttgaggaaatcagaaattatttctgttttagcaattcacaataacttaatagcaacaaaatttatcatgggatgaaaatgtattatttaaagtgtttgaatattcatttttttataaattcaaaaatttattttctccttataaattctttacttttttccgatgctttcgaattttcggcctctaaaaatctaattgtgagacattcaaaggtcaaaccgcataaccttcagcggtttcatatgttttggttgcaactttcttaaaaaagtgaatacaatttaaaagatgaattttggcatttcgccaaatcatgttaaaaatgtgtgcattcttttgagtcttgaccaaatgttactgttttgagaaatgacgactggtgaggagctccttcggttggcggatgacgatcgcttgtggacatttccggatgagttggtgctgcgcgttgtcggcattgaccactgctcagcggttgaccagggctacccgtctcatgtgcagtgccaattcttcaaggcattgtttcttgctgtgtgcccaagatttttcaacgtgttcagtgaaggggggggggggggtgatgtcaccaatccggcgggcatttcatccctgagcattggttcgcccaatcgcttctgccccaacccgccgccaaggaaatgaagagcacacctagcgatgacaactcttttgatcctcgtaccaatccgacctgatgagttgtttccactcacatcattagcagtttcttaaaggaaataccaattttatgttaattatttttataggatcatcacagaataaggatttccatgtccaccgagacggtgaacttatgacacattggaacgaatattcaaaagatatttcaatatttcaccttttgtcacgagtagaagccga

SEQ ID NO: 40051 - DNA, 935 bp, Heterodera glycines
  misc_feature (814)..(814): n is a, c, g, or t
  misc_feature (859)..(859): n is a, c, g, or t
  misc_feature (893)..(893): n is a, c, g, or t
  misc_feature (899)..(899): n is a, c, g, or t
aggcaaaatatgaacgcttagttgtccaattaaaagcgctttttgaaataattgcttgaaccggtaataatgagaatgtcattttttaaacaattctacgagacaaatactggacctcctatcaattaggcaaaatatgaacgcttgttgtccaattgagagcgctttcgtaaatgataattgcttgacggtaataatgagaatgccattttttaaacaattctacgagacaaatactggacctcctatcaattaggcaaaatatgaacgcttgttgtccaattgagagcgctttcggaaatgataattgcttgaaccggtaataatgagaatgtcattttttaaacaattctacgagacaaatactggacctcctatcaattaggcaaaatatgaacgcttgttgtccaattgagagcgctttcgtaaatgataattgcttgaaccggtaataatgagaatgccatttttaaacaattctacgagacaaatactggacctcctatcaattaggcaaaatatgaacgcttgttgtccaattgagagcgctttcgtaaatgataattgcttgaaccggtaataataagaatgtcattttttaaacaattctacgagacaaatactggacctcctatcaattaggcaaaatatgaacgcttgttgtccaattgagagcgctttcggaaatgataattgcttgaaccggtaataatgagaatgccattttttaaacaattctacgagacaaatactggacctcctatcattaggcaaaatatgaacgcttgttgtccaattgagagcgctttcgtanatgataattgcttgaaccggtaataatgagaatgtcattttttanacaattctacgagaaaaatactggacctcctatncattangcaaatatgaacgcttgttgtccatttaaagcgctt

SEQ ID NO: 40052 - DNA, 917 bp, Heterodera glycines
  misc_feature (862)..(862): n is a, c, g, or t
ttgaattttcttgtgattcacctataattttcagttactaagttgtcagttttattctttaattctataggtaaatcccgaaaacattgcaccaattgacttttctacgataggtaaatcccgaaaacattgcaccaattgacttttctccggattttaagcccgagtgttgaattttcttgtgattcacctataattttcagttaataagttgtcagttttattctttaattctataggtaaatcccgaaaacattgcaccaattgacttttctccggattttaagcccgagtgttgaattttcttgtgattcacctataattttcagttaataagttgtcagttttattctttaattctataggtaaatcccgaaaacattgcaccaattgacttttctacgataggtaaatcccgaaaacattgcaccaattgacttttctccggattttaagcccgagtgttgaattttcttgtgattcacctataattttcagttaataagttgtcagttttattctttaattctataggtaaatcccgaaaacattgcaccaattgacttttctccggattttaagcccgagtgttgaattttcttgtgattcacctataattttcagttaataagttgtcagttttattctttaattctataggtaaatcccgaaaacattgcaccaattgacttttctccggattttaagcccgagtgttgaattttcttgtgattcacctataattttcagttaataagttgtcagttttattctttaattctataagtaaatcccgaaaacattgcaccaattgacttttctccggattttaagaaggagtgttgaattttcttgtgattcncctataattctcaaaaggtaagttgtcagttttattctttaattctataggtaaa

SEQ ID NO: 40053 - DNA, 1035 bp, Heterodera glycines
cggagggaagaaaagtggacgaatggcgcagacgatctttcgaatgggcaaagtgagtgggcggattgtgctgatgagagtgatggcggtggttggacgggaacgaaccgctgctgtccagcgaagagttgagaagttctgcaaggaaacgccaaattctgacagactacgaaagacgaccaaaaaacagcataatgcgaacatatggaggacacggtttaaaaaacattggcttaaacaaaggcttaggtttgggccaagtgttaaaatagtaaatcgtataaacaaacgaattaaataaattcgattttaaatccctattgatttggcgaaatgttttttccttatttaattaaagaaaactgaggaaaatggaaacgaaataaatcaatgaatggtaattcttatttttattaggcagtccaaaaaatagaataaaatacggtaagaaaaaaacatttatttggccgacctttgccttttttcgccttcgccctgcccggggctatcattccccgccgccccctcaattccccgggctttttgccctgaaaaagcctcacaattcaactaatttggccctctttcatcacggtcaactgacagtgtattcggccgagtttagagatgaagaaaaagtaaaaggagagagaagggagggacagagagaaagagagagagtgtgagagagaaaaagaggggaagagagcgaacgcaaggtttggcacaacgaattgccaaaaaaggctcaaaaacatcgcttggggaaaattgaaggaaagagaaagcaggaaatggttgacgtaggaacaaaggaaatgagacggataaaaaaactgagagatgggcggatgggtatcttctccagtcaagagtatgggatgaagaaaaggccaagagagttttccgttgcttttcccgtgaacaaaaatagcgcaatcccaaggggccaaagaggaataataaattgaatgaaagagaaggaacggccaaattatgatgagatgagaatgccgaagtgggacgagaaatggg

SEQ ID NO: 40054 - DNA, 503 bp, Heterodera glycines
  misc_feature (30)..(30): n is a, c, g, or t
  misc_feature (137)..(137): n is a, c, g, or t
  misc_feature (172)..(172): n is a, c, g, or t
  misc_feature (174)..(174): n is a, c, g, or t
  misc_feature (186)..(186): n is a, c, g, or t
  misc_feature (197)..(197): n is a, c, g, or t
  misc_feature (199)..(199): n is a, c, g, or t
  misc_feature (392)..(392): n is a, c, g, or t
aaaaacacaaacaacggcagcgaaaaagangagccacgcgaaaacacagcacaaacgacagcaggcagccaagagaaaaaccagacaaaagacaaagcccgggggacaggacaaacggccgagacaagccgccgccngaggcagacacgcagggcggggcaaaagaaagacncngggggagacgcngaccgaaaagngngagaaacaggggaagcaagaagaggcagaaagcggcaacacaaaagccacagacaaggccaaaaacaagaacaaaagcagccacaaccaagcagaagaaccgcgggaacagaggaaaacacaaaacgcgccgccaagagagcaacaaagaaaagcaagagccaaggacaacgcagcggaaacggacacaccancagaaagcaaaaacagaaacaacggcagcgaaacggagacagccaaagcgaaaacacagcagaaacgacagcaggcacccaagagaaaaaaccgacaaaagacaaagcccg

SEQ ID NO: 40055 - DNA, 969 bp, Heterodera glycines
  misc_feature (951)..(951): n is a, c, g, or t
aaaatggtgtagtaaaaaatcgtatttcgctcaaaaagcttctcaaacaattttagcgcatccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgatcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccaatatgagcgctaaaattatcagagtgccgaaaatcgcatgtgatctaagcctagaaaaaaatggtctaagtaaaaatcgtaattacgctcaaaaagcttctcaaacaattttaacgcttccaattccttctacaatcgcctttatgcatcccattatgagcgctaaaattatcagagtgccgaaaatcgcatgtgatctaagcctagaaaaaaatggtcaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcanaagagcttctcaaacaat

SEQ ID NO: 40056 - DNA, 1048 bp, Heterodera glycines
atggcacgccgattgaaatttgaatacaaaaaagaatgtgctattgtatttggagatttgccccccgaggttaagcgagacacaagtcaaacggttcaacgaccagaacgacccgtgcaaaattctgcttgcaaccgatgcaattggaatgggaatgaacttgaacatcaaaaggtcgcttttctttttaaattgcatgggtcaattaatctttgatatttttcagagtgattttcacaacattgaaaagtcgtgatggctctttgctccctgcgtatttcgtaaaacaaattgccggcagagctggcagatacgcatcagcatattgcaccggcgaagcgatggcgttggatgatgctgatgctggactgcttgagaagctgatgaatgaaccaattgattccattgaccaggccggcattttgccttcattcgaccaaattgaggtgagtccacgctctttttcattcatttattcagaaccctttaataatccattgaagatgttttcctttcacttgccgcaatattcgctgactcaactgctagacatattcgtttcaatttgcacagttagcgaaaagtactttctgtgtttgaatgactcaattaaacaaattgcgcaactcattgaacacatccaactttcacttcgggttctcttctcatcatacaatatttatgactttgtcagcaattaaggaacgttacattttctgcctcaccccaatcccttccggtgctcacccctttcttaactcggcttttatcaaaatggtccgacgttattctgagggcaatgcaataactttcgcatggatccgtcctttggttttgcctgagttgcgaattgtcgacagagtcgacgcggtcaatcgacttgttgacgtatacgattttatgggcgcgtacctttggcttagctatcgttttgaggtaacactttatttgcagagaatcaatctttacaatattttctcaatatttaggaacatttttctgaccgagaaaaggtccgcgagttgcaacgagaatgtgtgggatttat

SEQ ID NO: 40057 - DNA, 204 bp, Heterodera glycines
cccccccccccccccccccccccccccccccccctttttttttttttttttattaaaaaaaaaaagagggggggggggggggttgtttttttttttttttttggggggaagggagaacccccccccccccccccttttttttttttttataggagggggggggggggggagaaaagaaaaaaaaaaaaaaaaaaaaaaaaaaaa

SEQ ID NO: 40058 - DNA, 1080 bp, Heterodera glycines
catctttggtagttcgctttggaatagcaagcccgaatgataaatagctcgagcgcaaaacgcgtgcatgtttgggaaaagtatcgttcattaccaataattgaggggtttatttttaaatgaaattttatgataaaccttattatctcagaagctatttaattgattcgaatgtttttatcgcggttaattagagcaccgaaaactggtttgaatcgtgaagtttatcatttctaactcacttctcaaaattgttgataaattgcaaatatatttttccaaaagtctgtagacactttctgaaaataaattctatactcatgtattttccacttattagattttgcaggcttattgctgcatgttctttgacacttcttcaaaataacctatgccctttattcgttcaaaacaccatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcggatgtttttatctcggttaattagagcaacgaaaattggtttgaatcgtgaagtttatcatttctaactcacttctcaaaattgttgataaattgcaaatatatttttccaaaagtctgttgacactttctgaaaataaattctatactcaggtattttccacttattagattttgcaggcttattgctgcatgttctttgacacttcttcaaaataacctatgccctttattcgttcaaaagaccatctttgttgtttcgctttagattgacaagcccgatgatgaatagctcgagcgcaaaacgcgtgcatgtttggaaagtatcgttcataccaataattgaggggtttatttttaaatgaaattttatgataaaccttattatctcagaagctatttaattgattcgaatgtttttatcgcgggtaatagagcaccgaaaactggtttgaatcgtgaagtttatcatttctaactcacttctcaaaattgttgata

SEQ ID NO: 40059 - DNA, 878 bp, Heterodera glycines
ccttctctagtctgggctctaccaaacactcacatcccccctgaaatgcaaacgaaaaaaattcttgccgaaaaaatgtttatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacattttccttctctagtctggctctaccaaacactcacacgatatttgaaatgctaaccgaaaaaaattcttgccgaaaaaatggctatctcttttttctcct

SEQ ID NO: 40060 - DNA, 1271 bp, Heterodera glycines
ctccgatgaaaagtccgaaaaaacgacaatcaattctctcccttcaagccgcaggtataccggcaaaacggcctaaggttttgttggtcgatgaaaaaatggaagaggcgaagtgcacttcatgggctgacaaatacaggtggtggtgattcttataaaagctttttaaatataggcgatttttttacatttatcattcgacacattcctccagaatgttaaaaactgacaaaaaattaaaaaccttttaattcggttactttctctacagaccgacttcactcaaacaactgattggacaacaaactgacaaatcttgcgccaacaaacttttgttttggctgaaaaattgggccaaaaataatcttaactcaccgccttctgctgaaaagaaaaaaggcatcgtctccagtacaaaacaaaaaaagaaataatttgtttatttagctcgtccaaatcaattccaagctcaggttgacggagccacgtttaaagcggctttactttccggccctccaggcattgggaagacgacttgcgcattgttgtgctgtaaggagctgggactggctttcgtggaaatgaacgcgtaaatataacattgctaatgaatgggtaacgattggttccataactgacaatgacccacgaaaaaatctaaaaatttagaaagaaataacacattttgattagcttattactagggctgccaattttatgtaaatacatatttttttcctggcttctccatgctctaaatagcaggaaaaacactttcttttttgtgtttgcgaacaaaaaccgggacttttatttacatatttttacatattcggggtttttatacatatttacatacctatttcggaattttctatttgtacatattttggatttttttcatatatattttcacttttttttttacatattttgagtattttttacggaaatttttggaaatcctcaaaaaaaaatccaaaatttcggcaaatatttttgtacatattttcatttttttacatattttgaaaatttataaagaaaaaataagtttgaaaatgttgcctaaaaataccaaaaaaagtaatttttatgtcattttgtggctatttcatactttacggggatcttctttcccaaaaaaataccatttaaaaaaattttatttacatatttggggttttttgtacatattttggaatttttcttatatatttatgtacatatttggaccactttttgtacatatttttggcagccctactcat

SEQ ID NO: 40061 - DNA, 816 bp, Heterodera glycines
atccacatttatgtggcacccaaattttggaactgtctcgcctcgggtggggacttaaaagaaaggtggaggaaaatgtttgaaattttcaagtcaaaatcttcgttcttaaattttatcctattgttttcgcgcttttttcacggttttcgaatcgcggaatcgtgcgggtttaaaatttaaaagccgaaaagtttctatgatttttaacaaaaaaaatcatttgttttttttcattctttagaccctaaaatagtgcatgaaaaggggcgggtttgacgacgagggaattccttacaaagggacgcaccccatcgaatttttgcaattttcagttccattagagcccaaaatcccccacctaaattgactagtgatagtccaattaaggtactattacatccacgtttatgtggcacccaaattttggaactgtctcgccctcgggtgggacttaaaagaaggtagaggaaaatgtttgaaattttcaagtcaaaattttcgttcttaaatttaatgcaatagttttctcgctttttttcacggttttcgaatcgcggaatcgtgcgggtttaaaatttaaaagccgaaaagcttctatgatttttaacaaaaaaaaatcatttgttttttttcattttttagaccctgaaatagtgcatgaaaaggggcgggttagacgacgagggaattccttacaaagggacgcaccccatctaatttttgcaattttcagttccattagagcccaaaatcccccacctaaattgactagtgatagtccaattaaggtactattacatccaccatttatgt

SEQ ID NO: 40062 - DNA, 988 bp, Heterodera glycines
ttatttttattctcaatcaagagccaattttttttaattctcactgtttcattcaaatttagaattttgcctgccattgtttattttacattgacgaaaatgccgacactttgatcaaatcggatggatttttgcaaattgaccaaaaaatgttgtgcgaaattttggaacgcgacgaattgcaaatccctgaagaaattcaatgtggaatgcagtaaattttttttaatttaaaaatgttacaaatttatttttaaataagtccgaatctttttttaatcactaaattgttttgaataaaaaaataaaattttctcttcaatttccttactattttctcttctctgactcgtcgctgctaccatttttagcggcgggcagagaagagaaaaatagtaaggaaatttgagagaaaaacttctctcaatttaacttgatatttctaaattgtgtttaaaagcggaaattatcgcatcgatttttttccataatgttccttttttcacttatttttattctcaatcaagagccaattttttttaatactttattttcattcaaatttagaattttgcctgccattgtttattttacattgacgaaaatgccgacactttgatcaaatcggatggatttttgcaaattgaccaaaaaatgttgtgcgaaattttggaacgcgacgaattgcaaatccctgaagaaattcaatgtggaatgcagtaaattttttttaatttaaaaatgttacaaatttatttttaaataagtccgaatctttttttaatcactaaaaatatttgaataaaaaaataaaattttctcttcaatttccttactattttctcttctctgactcgtcgctgctaccatttttagcggcgggcagagaagagaaaaatagtaaggaaatttgagagaaaaacttctctcaatttacttgatatttccaaattgtgtttaaaagtggaaattatcgcatcgatttttt

SEQ ID NO: 40063 - DNA, 1454 bp, Heterodera glycines
ggtcagttgtggatcattcttaaaaagtgaaaaatgtttaaaaaaattcgtttcatagcgaattggacggattgtctcgcgagcgtggcgcccattcggcgttcaacgtgccaacgttggaggcggccatttacagcgcgcacgacatcaaagcgtgccgcgaggtgaatttggcatcaacaaccccgcccccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaaatcgattttttcaggtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaa

SEQ ID NO: 40064 - DNA, 905 bp, Heterodera glycines
  misc_feature (870)..(870): n is a, c, g, or t
aaagatgctgttttgaacgaataaagggtatagttattttgaaaaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggtattttgaaaaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatcgaaagcgaaacaacaaagatggtgttttgaacgaataaagggcataggttattttgaagaagtgtncaagaacatgcagcaataagcctgcaaaatctaat

SEQ ID NO: 40065 - DNA, 1200 bp, Heterodera glycines
  misc_feature (47)..(47): n is a, c, g, or t
  misc_feature (49)..(50): n is a, c, g, or t
  misc_feature (54)..(54): n is a, c, g, or t
  misc_feature (61)..(62): n is a, c, g, or t
  misc_feature (64)..(64): n is a, c, g, or t
  misc_feature (67)..(67): n is a, c, g, or t
  misc_feature (73)..(73): n is a, c, g, or t
  misc_feature (87)..(88): n is a, c, g, or t
  misc_feature (96)..(98): n is a, c, g, or t
  misc_feature (101)..(103): n is a, c, g, or t
  misc_feature (110)..(110): n is a, c, g, or t
  misc_feature (117)..(118): n is a, c, g, or t
  misc_feature (122)..(122): n is a, c, g, or t
  misc_feature (127)..(127): n is a, c, g, or t
  misc_feature (130)..(130): n is a, c, g, or t
  misc_feature (134)..(136): n is a, c, g, or t
  misc_feature (143)..(143): n is a, c, g, or t
  misc_feature (155)..(155): n is a, c, g, or t
  misc_feature (157)..(157): n is a, c, g, or t
  misc_feature (162)..(162): n is a, c, g, or t
  misc_feature (167)..(167): n is a, c, g, or t
  misc_feature (171)..(171): n is a, c, g, or t
  misc_feature (176)..(176): n is a, c, g, or t
  misc_feature (180)..(181): n is a, c, g, or t
  misc_feature (183)..(184): n is a, c, g, or t
  misc_feature (190)..(190): n is a, c, g, or t
  misc_feature (193)..(193): n is a, c, g, or t
  misc_feature (208)..(208): n is a, c, g, or t
  misc_feature (214)..(214): n is a, c, g, or t
  misc_feature (219)..(219): n is a, c, g, or t
  misc_feature (226)..(226): n is a, c, g, or t
  misc_feature (234)..(234): n is a, c, g, or t
  misc_feature (244)..(244): n is a, c, g, or t
  misc_feature (252)..(252): n is a, c, g, or t
  misc_feature (267)..(267): n is a, c, g, or t
  misc_feature (270)..(270): n is a, c, g, or t
  misc_feature (276)..(276): n is a, c, g, or t
  misc_feature (278)..(278): n is a, c, g, or t
  misc_feature (295)..(296): n is a, c, g, or t
  misc_feature (307)..(307): n is a, c, g, or t
  misc_feature (312)..(312): n is a, c, g, or t
  misc_feature (314)..(314): n is a, c, g, or t
  misc_feature (320)..(320): n is a, c, g, or t
  misc_feature (322)..(322): n is a, c, g, or t
  misc_feature (326)..(326): n is a, c, g, or t
  misc_feature (335)..(335): n is a, c, g, or t
  misc_feature (342)..(343): n is a, c, g, or t
gattttagtgtatcaaaacaccgcattttgccaatttctcctaaggntnnaggntttatannantgntgatgngttttcatttttgnngatttgannnttnnnaattttnataattnnattnattgnganatannnatgattnagaatgggaagngnatttnagtgnggantttgnattnnannttgatnagnagttgtttgtaaatnatgggngaatngttgtangaatgtgngtattgagtnggttgggnaggaagagaatgagnggnaatgantngtgtaatttgtgtgganngtatattggangaggngnaaaaangncgtntagtttgtntaatatnnatttttttggtacggacaaccgctttatcttcaactgttttttgggtccacgcgccatatttttggaagaaaaggattaataactaagtaaaaatcataaattaggataagggaaatattttttcatgacaatgaaaatttggttgtttttcgactatcagtcaagctttccccgggccatctacgagtaattgagtacttttagtttaggtatccaatgaaaaaccatcgaaggggctgaatgagttgttgatccttgcttaactttttcggacacaaaacatacacattctatttaatgaaaattcaaaagaaggaaggagaacattttgaaatgtcggatcttttttcatcaattcggattgttctgttgcccctgaacacgctggtaaaacaaatgtcggtcgctggttatgtagtacccgagaattctgttgtcctccattgggatagttcctaaaacagagataaggcataaaaattaatattgggacacttaaaagcagctctaccttctttaaaaacgaacaaacgcagagaatgagcggtggtatggacggagttggccaagcgaagtttgaacgcgaacacagccatagtttgatcaacattgtcaaaacaatgcgctccggttccgtcacgagcctcggcaataattttcattttgtttaaatttaattggcaaaactaaaagaaaacttcaacatgaaaaacaaagcaagataacaatagagtttcgaattgtgcatatgtgacgtacaaactaattttttttagcaaataaatcaaaaaggaaacattcaaaaaattaaaacaaattgatttaagtgacaaggataaaaatgtaaacaaaacgg

SEQ ID NO: 40066 - DNA, 1303 bp, Heterodera glycines
cccccccttttttcccccgcggaattttttttttttttatttttttgcccggggttggggttatttttttaaaaaaaataaaaaattttaaacttttttttccccccccttttccccgggggttttttttttttttttttttttcccaaaaaaattttcaaacccctttttttgccccgggaaattttttttttttaaattttaacccttttgagtagttaaaaataaaaaaatgaaaatttgaaatcatttttcccctcccttttccaggggttttttttgtaaattttttttcaaaataaacttttcaaccccctttttccccccggaaatgtatttttattgaattttgaaccggtttgagtagatagactagaaaaaatgaaaattttgaaatcatgtttccactcccttctccaaggggtattattttgtaaagtctttttttcccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattatattcacctccattattgatagaaaaagcatcagagtgcctaaactaacatgtaaataaaatttggtaagttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcct

SEQ ID NO: 40067 - DNA, 999 bp, Heterodera glycines
cccaaaggcctacggtcgaaatttgccaaaatatccccaccggagacgcatcttcattctcataagagcaaatggcactcactcatttttagtccatccatcatccatttacgtcacccaaaaacagaatggcacaattcataaaaaaagaaaagaattcagaatggcatgacacacttataaaaataaatccttcagttttggccttttttgtattgtgccaacccttcacttcccatccatttccatcacaagcccatctatgaataatgccgcattgctcttttttgtttagctaagcaaaagtgtgcccaaaacggagaatgggcggaggccaggacggggatggagtgtttaatgggggaatttgcaataatgacgaggaagatgataataataattttgtgtgccgccgcccgccatggcggccaactccgtcccgcgtttccgtcctggccaagccttgaattcaatgtcgaagcgatgcaaatgaattttcagtcctaaaatttggtcgggacggagttggcggaactgatttgtccacctctcccatccacataattttgaagagttcttctttagccgcgattaacataacgtctcccccgccccttactgcccgcctccctaccgtgccaaaaggacgaagagaacaaaaaagagtgaaagagtgggggcaatgatgaagaatgatggcacgaggagcggcatttgaattggcggcacggccaaagagacggaaaagcggcgccgctttgttggggatcaaccaaataaaaggcgacggcacgcttcaaaagcggcatttggcagaatctcagcacaaagtgctgctagctgtaagcataaagtaaaaccagtagaggtcaaattaattataataactgataaataaataaatgagtcgttctaaaagcatttgaaaaaatctaataaaagtcatttttttgaaaatatgagtttttaaactcccatttttacctcccaaaatttggg

SEQ ID NO: 40068 - DNA, 687 bp, Heterodera glycines
ttgcgggattttggaaatttcgaaaaaaagtcaattaaatttcaaaaaatttccaaaaaaaaaacctgacattttgaaaaagaaacttttaggggctcgcgggatgcattaaaaggggctgatgggtcgactaaggtttttcgaatgaatcagatggtaaaaagagatcgggaataaaatctattaagggtacatacatttgagtattttgttgcttttcaaaatctattttttacggcacattttccaaaaaaaatttttggagcagaggggggggggggtccggcggtgtcgaaaggcgctgccgtggggaattttgaaaatttgagtgtgctttgttaaaagattttagcaataaaggcaggtttttgggatttaaggtgtagcccaatatggcgggccgaaggcatcaccaggaaaattttcagtgaaatttgtgatgaaaaatgagttaaactttaattgaatttattataaactttttcaaaaatattggcattctgttttgaaattttcaaaaaatcctatgcgaatcctgcggaatcccgcacaaaagggtcccgctgcgaatcaaaattctctgcgggacgggatcctgcgggattaatcccgcagatcccacaatcccgcattttccaaaaaatgcgggattgcggactgggatcccgcaaaattccgcgcgggatc

SEQ ID NO: 40069 - DNA, 1146 bp, Heterodera glycines
cccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaattaagttgtaaataaaatttggtgcgctttagagcactttctgaaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaaatcgattttttcaggtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggatcggggggactgccccgaaaacaaaaatatatcgattttttcaagtgtccgtttggggtactcatacaattatggcgagca

SEQ ID NO: 40070 - DNA, 1041 bp, Heterodera glycines
tctgtcccggacaaagtcgaacccatttcccctcccagccgatgccacatagggaccaagaaatcagcagaacttcccaaaagaaaaaaagaaacaactaacgtgaaaggaacgattttggtaacgtgcgatgaacgtggaagctcggatagcctccctggggtggcatgtcctggcggaatttttcactcattttcaatggtcagcaaaagaagtggcaatcttgaaaaaaaaagaaattttaaaattgacagacagaaataaaataatatgaaactaaaatataattatcactttacaagtcctctgataatgtatttttggggtccctgatcacgaatctgacatcgattttgaccaattcttaatccttaacccgaacgaacattaataaggaattcgaaaaatttgaattttcgactttttgttgaattcagttaggtattaggaattggtaaaaattgatgccagattcgtgatcagagaacctaaaagcccaagggacaagttttcatgactacatattttttacaaaaaaatttgcaaaataaaatggtctatccccctttggtttttgataaaactcaaaagtgaggcacttttgtaagtaaatgaatttgaaatttcgatcttccggttcagttcgggattagaaattcggaattgatcagatgcgaaatttaagaccgctaacacgttttccctaattctaggacaaaaaaatttttttgattaagaaaaagattttgttgttttaagtagagagcggcgcaggacaggatcctgcgcaggattttgcaggatcccagtccgcaatcctgcatattttggaaaatacaggatttacaggatttgcaggattaatcctgccggatcctgtcctgtaaaaattttgaattccaatcctgcaacaggacctgccaatttgatttttatgcaggattcagcaggatcctgcattgattttttgaaaatttttaaaatagaatgcccaatattcagaaactttcctttttcaaaatttttttcttaataaaaatt

SEQ ID NO: 40071 - DNA, 1363 bp, Heterodera glycines
  misc_feature (370)..(370): n is a, c, g, or t
  misc_feature (373)..(373): n is a, c, g, or t
  misc_feature (375)..(375): n is a, c, g, or t
  misc_feature (622)..(622): n is a, c, g, or t
  misc_feature (1307)..(1307): n is a, c, g, or t
tgctaatgacaaagaattaattaataaatttaaaattactataaatctcacaaataaaaaaatactttattaattattttttaaaacaacttgccattttcatcttgaataaactcaaatgaacttgtaggagttgttgaaatccttgattcaattcgttcgagctgtttaattctgttccacacctgttcatatatgaatcggggtataatcaaatggcaaaagaccgtaatcaaaattcaaattttccataattaacggatttggatttaatttattgattttgggcaaaattgcctaattttacatttgaagtaacttttttgatttttctaggtttgcatcaaaaaggttaatttaaactgaattntangncaaaattccccgaaattacgcgatcaaaaattttgtgcttagaccgaaacgtctataaactataatagcatgcttaacgtgaataaattaaatcaatttcactgcccacctgtttgagctcggtggataataatttaatattgccattcgcttcacgacattcctgcatatacaaaaaaaaaagaaaaaattaattgcaattgggaaactgtgaacgggattgggaaaaaggcaccggcataaaatntacgggtttcaaatcccgacattagaatgcatatgccgagatttgacgggggcacaaattagccgacctgtttcgtttcagcgatttgttggttcaattgctgaacaccaaaagaaatttgacgaatttcggcaccgtaagcggcgtcattaggtgctgttaaattggggggggggtgataaagagaatattataaaaatatttctgatacgaatattacttcgggcatttgaagtatgccttgtcgtagtaacatccaacaattcagccgctgacatcaattcctgcatgaattgcaaatcagaaaattggtaatgaagtcgattttggggcagcatatttgctgaaatgtacaaaattttattttctatttttgtatatatttttgttttaacaaaaaataaattaagtaaatcgttaattcattttatgcctcagatacaaaaatgttcattttgaattcaaatttttgataaaggcaattagtgagtgactaaaatgttcccagcaataaaagacatccccgtccgtcaatcaaaatgtgccaaagaaagtataattattgtttttttaattaattaatctctgattattgatccaacattttttgttggatattattttttaatgtgtttaaaatgtaatccatgtatttttctgaggcccattttattttttgtcccantaatttatcattgtcaatcaaatatgcatttttaggtgttgttcgaacgggtctat

SEQ ID NO: 40072 - DNA, 909 bp, Heterodera glycines
gcatcagaaagtttgtaaatcaaaagaatggggttatgggtgatgatggggagataaaccatcgacaaccacaaaagattacagctgttggcgctggaaaaggaccgcccgtttggaaaattccgaagaagtccacaagcaaaaagggaagtgatggtgctgggaaaccgagtcgagagagccacaacaaccgggagagccacaacaaccaacagtcggattcggcagccaaggggggatacaacggtttgaacattgacggactctttgaggagattgaacagcaaaagaaccaacggacgattaacgaaaatggcggcaacagaaaagaacataacgaagtggcggacacggacagtggcaacaacggtgtgcagtgggaaatgcaatgtaaaactaaatagcgcaccgatacaatgacagcatttattgcttttgcagcggaactctgttcagccaacggacgtgatgacttggtccggtcgccatcacttgctccacaatcttcgccgaacaagttgcagaccagcaaaggcattccaaaacaggagtgtgatgatgagaagtcgcagggatttttcggatctcataagtcgtcgacatgtaagttttgtctgaaaataacttgttttcattgtctatatagtaatatttcatccgttataactcaaataatatgtctcacgatcagtttgcctaaattcggtatttcagtaggactggcgttgtacaaggctgagaaggagggacgcgaattacgatctcgtcatttgcgcagcggacagtctccacaaaatgtgccaaactcatctgtggtacgttccgctttacgttacactacttttaatttcgactttgttcgaatcggtcccgtgggtcgaaattcttgatcatagcctttcagtaatc

SEQ ID NO: 40073 - DNA, 1433 bp, Heterodera glycines
ctaattatctataaagaaatataatatttataaggtttcttttgagggttttctataagagaattttaattgtaattattatatctattaaagaatcagtatttattattttgattcgtaatagtttttgccctataagctcgttttgggcaagcctgtccctgacagataaatccgtattttccatacccttaaaacattaaattgtcaagtcaatcgaatattggcggttttagcgaaataagcaaatatcagcccatggcgctcctcatactgcttcctccgccctctgtctcgccccactatttctccgtcgttgcatgctcttttttacgttttttggcttttatttgttgttttgcgtggggagccgaagctaaaaaagtatgcgtgtggcgaagctaaaaaagtatgagtgatgggtgatcggaaggggcgggtcatttcagtaccgaataaatgattttgattaattaatataaatattttaatcatataattagatttgctgaccttaattataatttagatttattatttaaatatttcccaaacaaattacatttttgtgagagaaatacagtgcccacaaaaagtcatgactcaaacctgaaaaactatcttatagttcatttaaaaacttgaaataattcaagcttgcataacttttggtgctgatcaaaaaaatctcttacaccaacttgatcagattactccttcctagtgaccgggacacccaaaatacactgaaaatcggggaaattttcgaaatccctagggggctgggaaattttttctagagaaaatggacaagcctcttggcaagagcacaaaatttgctaccgaattgctttagaaatgatgggtctacgatttgtacatagaaagttatacttggttgaatatttaatcaccttaaaaatgatcaatttatgatcagcaccataaccttttctagaagcattcaaattaaataatcttggtatcttttgatagccctaagtgtcctctatttgctttaagatttcaaaaatatggttgtgtttcaaaaaagttgtggcttgtaaatttcataaattgatttggtaaacctttttgaccacaacttctttgagacacaacgaaattttttgaaattttaaaggcaaatagaggacacttagagctatgatatcaagaatgtttaattaggatgcttcttggaaaagttacggtgtcttaaatttgtcaaattattctatggtcgtgtctttttttttgtggtcgtgtaaacttaaatatagccaaatataattttattattagctcttattcaattataaatttaaataattaattaatcattagaataactcttccgtactgaaatgacccgccccttccgatcacccatcactcatacttttttagcttcgcccacaatacttttttag

SEQ ID NO: 40074 - DNA, 714 bp, Heterodera glycines
tttttatctttaatataaaaaagttcttcctataaaatgaatttttaaatgcaaaaccaaaggggggaccccatggatttgcatttcatgagaaatttttttgctcctaaaattgccaaaaaatacttttctggggtaatttgaggtgctgaacacgaatatcactttatattgcgttttggattttttggagggtggtaaaaaaattttgaaaaatcaataatttttggcccttgaaaattcaacctaaattttaaaaattcataactcgcctcaaaattgtccaattcagctcatttaaagcattaaaaatcgagaaaaatagggagaattttaagttattttttgagtttccatattttaaaaattcacaaaattaggcctggatttctcaaaaattttaaattttcagaaataaatttataactcatttcaaaaaaggcgctaaagaatatttaaatattcataaaatccgcaatttttttctctataaagagaattttattttacctttttatctcttttttgaaaaaagatacaaaaataaaagtgattttgtaatttgggaccacaggggtgtgaccaggatttttgagtggaaaatttttttcaccaaaaatcttttaaaaatatgtctttagggctattatgacgctgatcacgaatacgtaatcagattttactttggacgtcgtttagccctcataatccctg

SEQ ID NO: 40075 - DNA, 1608 bp, Heterodera glycines
gcaaattccaatttttacaattaaaagcaatgaatgcttcctgaatcatctaagtgtactccgttaagataacattgctgtgataaacggacaattttcgccaaatgttggggatcactttgttaagataaaataagaaaaaaataatccattgataaattaaattcaataaattatcgggtctaaaatagtcctaacaaattcataaaagcggcaaagtccaatgagttttactctgttgacaacttcacgaacaatttaatgccactgaaagtaatcatttattatgcgattgcgatacatttgatgtcatctctgttgtcttcataatccaaagttcagaacataaaaatccgaaatatccaaatttcgtagcaaataatccggattttctggagagttgaggtctgacgacaatgctatgcgtttccgaagaatagaatccgttttcggtttacatatagttataggcataatttatctatgtcaaaatggtcaataaatttctaaattacttttaacttttttgagccgatcccatcatccctaaagcaaatcccctccccccccccccaccaccacaaaaactcataatattttttggctgtgccgcatgacaattctccgtttcaatataaaatatttagtcagttgtactgcaccaatttcttgttgatcggttccaatttcgaacctgcgaagcttttgataggcgccaagtaaaatgctttttttctctctttttgtatgctcaattccgtttgtttcacgaggaaaattaaattattatgaaattaatttaccaaagaaaaaaagcattaacgagaaaaagagacaaacaaaagcttaattaattggatgtttgaccaggcgatggcaggcaaaaagttaagcaaaaaaggcgaagcgctcaaaaattggaacgcataaaaggcgagcgaaaattgtgaaaagacaaataattcattaaagtaaaatcctattgtgaattggcatttctctgtttaaaatgcgcttcgttctgtccctcgcccttttggcacttttcgtcgtccaatgctccgccgacgactcatcgccgtcctcagaggcagctgatgagaatccctctgctgcccatgccgctgctgaaccatcagcggcaggcgatggagtgccgccgccaccgccgtcggccgaaggggcggcagccgaacgaaagaagcgcagcggagggaaagtcgcaccggcactaatcctttaaagaagccgaagaagaagagaagaagaagcggaagaacggaaggaagaagaaactattgatggaattgctgggagagaattggtaagtgatcatattatttggaagcgacacatcaggaatatgaattcgcaaaattatagggatttacgaccctataaaagaaagcattatcaagtccttcttaacactgaatgaaacggctctccaaccttacttaagtttccgaactgaccaagtgatgaaaatccacgcaattgaccattgctccccccttttaccttgatcccatccttttttttttccccccccccccccccctttttttttttttgttttttttttttttttttttttttttccccccc

SEQ ID NO: 40076 - DNA, 803 bp, Heterodera glycines
atggccaaagtgactttgtcctcatttttgtcatacaatcctctgctcgggtccatcaattccttaattatgtgcagtttattgtgaaattccaatttaaaatttaaatcttaaaatacatcttaggagaactttttatgctaaaatttatctattaaaaccttaggattttaaggaaaattctcaggacaaatacatagataaatcctaaaattgtagccctaattatgcactaatgaccacctaatggagcggcgtacaaaagggaaaaggctaaacatttttcgttgctttggtcattcatttttatttctgccaatattttccacagaagttcctttaggtacactttgacttcactttcacggcttgtccaaatttcctctcgcgcaaattcagaaaatttctaaatttctagcgcgagtgtccctcttccatctccgctggaaatgttccaatcagaacaccgcacatggcgtggaaacttcaatgggaattgtccgggcaaatcacgaaaattgtcatgcaaatggaccacactttgcacttcttgcattgacagaaggccaagaggagctgaaaattgtaataattttatcaaatcattaaattgtattttcaaccaatttccttctcaaatttcaacaatgcgatgagagggaaacgaattttgaacagtgccgggccaagcgcagaacggcgatttgcagcggaacagaaaatacccttttgacggcacttttcgtcggcccaacggagtgcctaatgatggaaaacaaacaaatctatttagatgccacaaa

SEQ ID NO: 40077 - DNA, 1019 bp, Heterodera glycines
cggtgcatacgaaatgcaaatgatggcacagtgcaagcgttgcaatgatcgctgcagctgcgccggtgccgagattcgtcggctgctgcccttttctcctgtccaacatcgcaaaaatacttgaattttattttaaaaatctgttaatgataaaatatattttttaatttattgtattatgttatgttctataaaatcctttcttattttaacccatttctatagcccaataaatttgacccgattaaaacccaaaccgtttgaagataagtaaaaataattataaaatatttaaatttgaaatttgacattaaaattattattaaattttatttaactgggtgtttatttttttagattctttggcttaataataacctaataataatataaaatgtgaaaaattctactaattggatttgacagtatatttcgaaaaatggcgtaatattgaggtgcatttctattgtaacaatgacgcccagtgaaatttgcaaatttattgcaataattgaagtgcataattaagaaaaagtattctaaaatttgaaaatgaggaaacggaagaagacaaaaaaaaagttgggcgagggagggcggtgaaagtgttcggaccagcagcagaacactttgtgctaggatggatgagttgctgccccattttctcattttcagcaggcagttggatttggcggacggtggtggagaatgggcgggcgacccgaccttgttttgaattttgaagacacttcgccaactttatttactttcactcttctcgtctacatatttaaaaagatgagcgacgtgcgcattaaacgaacagaaaaaacggcggtggggggaaaatttgcactaagttttgtcggggtttcgcgcgattaaaaattcaattaaaaaatataaatttataacaattgttcttgattcaccaattagcttgaccattaatacaaatgaaagattttcacgtttgttaaaaaaaaactcaaaataaattattaaaaaaaaattgaggg

SEQ ID NO: 40078 - DNA, 561 bp, Heterodera glycines
ccgaattcctcgaaactcgatcagtaaaagtcgcttttgaatacatgtccaaagaaacatataataactcctctaaacttttaatcaaaatttactaatacaaactctcccctcctccgaaatctgaaaaatttaaaattttaatggtaaaatactagaggtgcgccgtgactgaaaaagcccgtgaaccgtaccgtgaccgtgaattggtcccgtgaatcgtgaccgtgatcgaaaaaacccgtgaaattcacggtaaccgtgaccgtgagcgtgaatcacggcgcacctctataaaatactaaaaaattcattcccaaataataattaaaatttttaaatttgcaggcaaccgatttgccattttggagctaaaaattatccttgttcatgtgttccgacggttacgcttctccactacaattccgttcgagaagaatcggtccgcttttgagtctgtggccaggcccgaaattggctgtcttttgcatgtccatgatgcgtcgtcataatgccaaacaaaattgaaaaagagtttttttttttatgaaattcgatatg

SEQ ID NO: 40079 - DNA, 186 bp, Heterodera glycines
cgaccccgacacttccaaccccgaccccgaccccgacacttccaaccccgacgaccccgaccccgacacttccaaccccgacgaccccgacacttccaaccccgacgaccccgaccccgacacttccaaccccgacgaccccgaaccccgacttttccaaccccgacggtcgggggcccaacccta

SEQ ID NO: 40080 - DNA, 1357 bp, Heterodera glycines
ttttgctgggcttagatcacatgtgattttcggcactgtgataatattagcggctcataatggggatgtataaaggcgattgtagaaggaattggaagcgctaaaattgtttgagaagctttttggagcgtaattacggttgttacttagaccatttttttctaggcttagatcacatgcgattttcggcactctgataattttagcgctcataatgggatgtataaaggcgattgtagaaggaattggaagcgctaaaattgttggagaagctttttgagcgtaattacgatttttacttaggccatttttttctaggcttagatcacatgcgattttcggcactttgataattttagcgctataatgggatgtataaaggcgattgtagaaggaattggaagcgctaaaattgtttgagaagcttgttgagcgtaattccgatttttatcttagaccaattttttttaggcttagatcacatgcgattttgggcactctgaaaatttaacaaaaaaccacaaaaaacctcaaaatttttcaaaaaaccacaaaaaacctcaaagcctcatttttaaaatttagcctcattgacctaccaaaaaaccacaaaatgaggctaaagcctcacatatgggaaccctgatcttagggctctcgaatgataccaagatcgttggattttgtttacaaagaaaaatgttacgatcaaaaaacatgtactcgtacgaaaacggcctggccccagaattgatctatccaataagcaacttttacaatcctatttcatgaacagaaaaatctttggtaatatatagaaataattaaatgaaaatggcgattaatatcgtttagaatctcttttgttaattgccagcagtaaaataaaataaatattcttaagatttgattaattactcttaataaacagatgcaaatttcactaaaaagttaaatcttttaattaaataatggatttctcagaatacaattataaacttcaatgaacgatgaaaataactgacattttattaattgtttaagaataaaactagctaaatgatatttaataatttcaaatccacaggggtcaacgtggaaaaaaactcggaatttctaatatttttttaataaagaggaacaattaattaaaaactcttttttcattatttcacggaactttatctgcaaccttttttgccccacagaacagatatgtatgaaattatttatgaattttttattttaatcgtttccttttttcacgcactctcatgtttttatgtatttttttttaattttatttcacatttttttttcatttaagtattctttcattaggtaaatcatttttttt

SEQ ID NO: 40081 - DNA, 1479 bp, Heterodera glycines
  misc_feature (1121)..(1121): n is a, c, g, or t
aaaatttttcaaatttttaataaattttctaggtctctcccgcattttcaagaaaaatttttcaaatatttcagttaacttcccaggtcctgcattttcatgctcagataccaacaattttgtaatagttgtcaaaaaaaaactttttaattgtaggcttagattttcctgcgaaccatccacggaattttagtcaaaagggtataattagcaaaatgatcggaaaagcatccaaacaagttgctttggaatattcaaaaaatatttttttaatatattaaagcattaaatttatccaaattaaatctttttgtcctttttaaatattttccgagaaattcttgaaatataagataataatttattcgaccattttccattctgccgatcactctgatcaaatttattgtagtatccagatgattaattaaataccttttatttttatctattgtttacagtatgaattaattatccttgaattaatgttttaatcactgtcaaccaattaaactttaataattaattgaattaagtttgttttcccactattaactaatataatcattatggattcatttatttaaactatgtatttaacgaccgtttataaccaatgacaatcatttttttgatcaccctaatcacttaccttttttgatcactaactgatccactaatttcaaaatttccaataactttttcataactaaatatataatcatagcaattaatcccataaaatatcaatttaaataggcaattctcgacaatgcatgtacatacaaattgtccatcgtccgtctgtcaataattttccgtccaattgacagccgcccccggggctctaatcgccgcccatttctttcagcagtgatcacaattttatggtggttttgtggttggtggtggtggtggtgaccttctcacctcctcacctctgctcctcacctctgctcctcctcttccaacccaccgacgttttatgccttccttaacgcctcgtttagccgaattttcccgcaaatcgccacccaaagtttggggcactgatccgtcccccgcccccggcgccccccaaattgtccaaccaattccaaacgcgccatttgtgggggggnggggagatgacctctgccggtgccgacagatgatcattatgttcatgttatggtgatgatgatgatttatttgctggctggcgatggcactcaaaaaaaaacaaaacccatcaacaaattgctccgcgccgctaatcggcgcatcaaaaagcgagaaaatgcgcgaaaaaatggcgcagcggcggcgacggcgcaaaatcgcgccgacaaaaagagcaattgtttttttagtagttgaccttttacagggtagagctatttataaaattataaatacgtgaatgtgattattggtctcaattattgtcacttaaatttattttcacttttttatacggtaatcaattattactgtact

SEQ ID NO: 40082 - DNA, 1018 bp, Heterodera glycines
gaaagttgcaaagcactttgaagagagagttaaagaggacgtgaaccgatgagtggaaacggacagagctggcgtatctggtctgcattcacccgtttgttgctgtacgttgggctgctagcctccagactggggtttgctgtccttctttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaaaagggagttaaggtgccaaagtgcccgctcattagaccc

SEQ ID NO: 40083 - DNA, 756 bp, Heterodera glycines
attgcttattcatattatttctttacatttaaaaaatatatttttcactctctaaacaaatccggataaaatgatgataattttatcaacaaaactgatcacattgtccgttctgctgcttccaattttgcttggcattgccaatgccgcgggcatcggcgacagacaaaaaagggcggtggaggaggaaggacgaaaaagcgtgagcgaactgtgtgccatccatgaacagaagttcaaggagttattcgaggttgaaagaggaagtgccgaaaaggaagaagttttatggatggaaaaaattgaaaataaagcggacaaagaggaggaaaaggaaaagcagaaagaaaaggaaaagcgggaagagaaagcggcagaagagagaatggatgctaaaaatgaagcatggcttagcactttgttgggcaattatttgtgccaaaaattgcgggggaaaggcggggagcaaaatgatgagaaattggattatgccattgagaagaatgtgtggacaacgcccgcaactgtagatcctttattagcctgcaaaatttcaaaaagttgcttttctaaacatttttgaccatgtcccgacttgctctggggtcgggccaaaatgaattcacggtgcggggttcaggggcaggcagggacgagactcggaattaataaaaaaagattccgggaaatgccctccttcttgggtaattcatcagcaggatcgaaatggtgaacaaaatatcacaaaattgatca

SEQ ID NO: 40084 - DNA, 934 bp, Heterodera glycines
agtcagcacattacataaagaaaaaaactgacgatctacctcgcggaaaatcagttccatcatcgtgctggagattggtagctgttggcaacaattgctcaaagagagtaacaattggcgggaaaggaggccaagcttaaccaaacattttatgagtaagatgggaaaaaagacattttcaaacagacaactcactgagaataatttttatctcatttaagagaccagaaatgttcggcaaaacaacgggaacgggcacgttcgacaaacgctcgcgcagtgacgccaaatgcaccgcaaaatttctcacaggcatgacaaaaaattcaatgtgctaaacaaattaactgtacatttgattaacaaaatttgtttgaacatacttcacgggtatgcggtgttatgcgaacgaattgttgtgccatttcaaatgcaaataataggtaaattaattaactaaggctaaaaacagttacaaaattaaaatgtcaaattggcagagtttcaatcggaaatgcttagaaaattatgagaaatgaacagaaaggtcagactattttaagaaaacatcacggaaataatgaaagacaaaaggactttttcttgcttattaatagggcccggatttatatagaaaaaaaatccaaaatatggattaaatacagataaaaaataggaaaatatggacaaaacattctgaaaatttgttcgagtcttaattttttttttttgtaagcgaatgttgctaatgaatttttttgcacaatttttgtttagtgtattgctgatttggccgtttgattgaaaccatcaatgtgctcgtttggttgatgggggagaagccgagaaagaaataaattttgtttaaaaaatcgcaaaatagacattaaataggcacaaaaatcctcgaataggcactaaaataggaaaaaaa

SEQ ID NO: 40085 - DNA, 852 bp, Heterodera glycines
  misc_feature (785)..(786): n is a, c, g, or t
  misc_feature (823)..(823): n is a, c, g, or t
  misc_feature (832)..(834): n is a, c, g, or t
ctaatttattggcacgaacatctggtggtggaatcatcttcctgcaattaggggtcattaacaccatcattattggcacacgaaaatgtcggcatattcaaaggaaatgatagcatttgttttcttgacttggattgctctcgagagtgccgtgccgtgaatttgttatgacatttcaagactttctggcggcattttttcatcgaaatggtcattctcgaaagggcaataaaataatgttcctgccctccggcggagagcacacattaaatgcccgaacaccgaatggacgagacccaatttttaatttgccaattgtggccaagtgacaaaatttaaaaaatccggaaaagaattctgtaatcatcagagtgaagcgattacctagtttttaaattttagtttaaattttttaataattttataatcaaaaaaaaaaccaaaattgtgaggatgataagtaaaatttttaatgactaaacaatgtgaaattataaaaccccccaaaaaaatttaatttttttttgaacaaaatttccgagaattttgggaaaaatttgaaaaactaagaaaatttattaagaaattcgccctctccaaataaggacaattctttgaaataaagacacactttccttgactcgagaatactctcgaacagaatgctctcttcgctgtatgttgtttatatttatttaataattaattaatataccccatttttatgccattctaatctttgagagtacggcaaaaatccaatccatttttgtggccattggtgnntctttgagtgtggcaaaataaatcaatggactgtttnttgaacagnnntttttttgtgccgtaccc

SEQ ID NO: 40086 - DNA, 877 bp, Heterodera glycines
agtttcttaaataattagagaattttattgaataaccccccacattacaagttttcctatctttacaaataataaacacatataaatatttattttctttcctttttaaaacttagcctaaaatccacagtttgcctttttggtgcaaaaaaccgacgaaaagtgccaaaataagaacttagttattagattaaagtccaaaatttggaaaaaaaaataataaataattaatggaatatttaacataaaagcgatcttggggaagaatgaaataattggtggaataagcataacagtcagctctttaataatttttttcttattttcaatgaagcaaaaatgagaaaaaaaattgatggatttaacatacatatcattgcattatagagatcaggtgaaaaagtgattgtaatttttcaagtattttgactttaatctaataattcaattaaaaacaaattgagtttcccggcggcggctgtcggcaccccccccccccccactttccccataaacttttataaaattttacgcaaaatttaaattttggtaatctttcttttaacatgtaaaaatgtaattgcactttgaattttttttctcttttaatttgtattggttccataaataatttgtcaattttttgtaaaattaagtttaatttctatttatgtttaagatatatatttttaagttattgccccgggtcattttccctctcgtaaatgaaacaccaacaaaacgacggagaattaataattgccctaattgcccattcgcccgctcgtcgaatgtcttctctttatgtacacattcaacgcacaaacgaatgttaaatgaactgaacaaaattaaatttcttttatttaaatttaaa

SEQ ID NO: 40087 - DNA, 1037 bp, Heterodera glycines
  misc_feature (209)..(209): n is a, c, g, or t
caatcgcttagtgctttaagtttttgtctttgactttgcttttttttccatttatttcaatcggctagtgctttaaaggttttgtgtttttgactttgctttttttttccatttattccaatcgaccacgttaattcattctctatacatttagtgtcttatttcatgaaattatattaatttaattttaaataaagaggcaaattttnacagaaaataaatagacgctgactaattagctaacatttataaagaaagtagaaatttgattaaatgcatatacaatatacaaaatattacttttttaaatttgtataaagcttttattttgtctttgactttgcttttttttccatttatttcaatcggctagtgctttaagtttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaaaatattacttttttaaatttgtataaagttccta

SEQ ID NO: 40088 - DNA, 1610 bp, Heterodera glycines
aaaaattttcgcaaaaaaagtttcttcaaaaatttattatttaattttttgcaaaagtttgcggttgtcggggagaaattgataaaaattttttggtcacttttggggatttttttttgcataaagacattggagtttccaatttttagcacctattttgcacttttttggcttaagaaagtatgaaaatttggcttctcttcagtttctttatcttctttccaatctttttcttgttgttggcctccataacaaggcgatgattttatgttttaaaaattcttaaagaaattgaatatttatgtctcgaacggacagaaatatttattttgttttaaattttagttcacaattttatgcaaaatctcacatgctaattattttgtatttgtttttttgttacattttgcatgaaattttattgtggtaaacaaaaatagagataagtaatttaaatcaaaacaataataaagattcttcaatttaaaattgatacatttatcaaaaaaaaccttcccaatcaggcccatcacacaaaaaactgattcaatttcaattaataattcaagaaaggacctatcatttctcaaacaataattcattcattcattccgctgatcactgcttggccccgcgtgacacgagaacattttttgtcacttttatctagggttgcgtcaccgaccccgacatttttggccattttcggggaaaaccccgaaccccgacgcttccaaccccgaaccccgacccttaaccccgactcggggtcggggttaaatatacacctctaagaatggaatttttgttggggaaaaggcaaaaaagttataagaaatttgaattttgttctttttataaaaaatcacaaacatcggaaacggctttatgtaacctttgtcataattctttttcgtgtaagaaatcgtcgactaaaggattatgggatcatttaaggtcgaagcattatgacgaatttgagcaatgggaaaaaaccaaagaaaaagcaaacaaagaagtactaaatttaaaagtttctataatttttaaagtatttaggggcaacaaaatattacgaaattttttcaacaatctgatgatcaaaagcaaaaggccgacgaattggttctgaaattaatgttgcggacaaattcatcttttttaatcaccgaatcgcctgaattgagagagctgtacagcaaagcatttcctggatttgaagttattttttctctttattattcctaaaaaaatcattttttgcagctacattgtagggactatttccgtaaaattgttctaccaaaaatggcaaatgcaatcaaagaaaaaaatttgttcacaagtttcaaacgattatttcacaataacagagtcaaccgacttcaagtccttcattattaaggttataaattctctttaggttatatttaagttaaaattttagcattactattcatcatattgacaatgaattcaaccgaaacgattttattttggaagcagtacctatcgaatcacattctggcgacaacattgccgactcaatttataatgcacttgatgaaaacggattaaaaattgagaaattaatttccattgtccgtgat

SEQ ID NO: 40089 - DNA, 1102 bp, Heterodera glycines
  misc_feature (841)..(841): n is a, c, g, or t
  misc_feature (874)..(874): n is a, c, g, or t
  misc_feature (1044)..(1044): n is a, c, g, or t
  misc_feature (1084)..(1084): n is a, c, g, or t
gtgaagattaagggacgcaaaagagacgatttaaaagcgattcgaaaattctatcgactgatataataacgatgcagtcgcggcgttggtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatgaccagtcgatatttacactgagcacccgttgaagcgggtgatgcgaagcaatagcaaactgtatttttaaattctggccgcaattctaccaaaaacgtgtttagactgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgngtgatgcgaagccatagcaaactgtatttttanattctgggcgcaattctacccaaaacgtgtttagactgcaataactcggctcagagtgaagattaagggacgcaaaagagacgatttaaaagcgattcgaaaattctatcgactgatataataacgatgcagtcgcggcgttgacaactgagatggaaccaaaagtccantatatctttccataaggctggaaaggcagatttgaatggncagtctatatttacactg

SEQ ID NO: 40090 - DNA, 1672 bp, Heterodera glycines
  misc_feature (1657)..(1658): n is a, c, g, or t
aactttgttctcattttctccaagatttgtcctccctaccacgcgctaaaaaacaaaaaaaaatttggaaaggaatctccctaataaaatattgatcacctcaaatgaattagtgaaaaaattgaaaatggaaaaattcgataactaaatgacaaactgacagcgcacaattttttggcaaaagcaactgaagtaaagagcttttatctccgttttaaatcaggctaagaaaaaaagttttgcggtaatgaaaataaatgaattacaaaaaaatgaaaaataatgaaaaaagacagggatttttagggggttgagttaactgaaaaacaatttttttgtattcaaaattcaaatttggcgcgctaaatgacccaattatttccccaaatcctgccagtgctgactcagctgtcatttataaaatgattgatggccaaaaatgcgcattttggacctaaaaaatgacacgtgactggtcatgtgaccgaattatttcgaaatacaatgcaccgcgcggaaaatgagtcagctgtcaaggataaatgccccaactgtcaatgaaatatgcaaacaacagctggaccccgtccatcccgtgacaggcgttccgcctatcacatgagccctccggggccactataaaagctgcaattgcgcaaaaaatttttcttttttcgagaaaaaatattgctttggaaaatatttcgcaaattgaattttaattcaaatttaccaataaaatatttattttatatacaaaaaaagtccaataaaaaaaaacaaaaaaaatgtctcaggcgcaaaaaaaattcctgaccgtcccggctgaaaaaagaaaagaaagaaatataaaaaattatttcaaaaaaagtattaatgaaattaaattaaatgaaaataattatgtcgaaatttcttcgactgaaagatcaatgcctgattatgggatacaagaaaatacaataagatttatttttaaaaacccaaaaaaagaaaaccgtaaagaaatgtcagaaaatttcaaaaaaataatagaaaatatgattaaaaaatcaatgcttaaaaaagaatggggtggaaaacccagcggatttcaattgatttgtattgtgaaatattgaccgaccccataattttgccggcccgagacccaaaaatgaatacggcggacaccgttttacatgaaatatttcggatcaaccaatcgtatacagaattcgatttgttgcagcagccaatatcttgtattatagcgacatatagtacacccgttgggacaggtaaaaattaaaagtttattttaaaaaatatattttttaaggatttaaccctttggattattgtgaaattaaagagttagggagaatttgtgtcaaaaatatggacaatttttgtaagttaaacaaaaaataatttagcaccaaaaaattttaggtttattttatgccttggttttaagcagattttatcaattaattaacaaaaatgacgaagagaaaatttcgatggatcaatttcgtaaaattataaagaatgaacagagacaaagcgaagcagtaaaaaaattaattattgatgctaaaattaatatgaatgaaaaaacctatggtttaaatcatttgcaaatcgttcaggatttttgggtaagtaaacttannattttaaggattaa

SEQ ID NO: 40091 - DNA, 1652 bp, Heterodera glycines
  misc_feature (1492)..(1492): n is a, c, g, or t
  misc_feature (1557)..(1557): n is a, c, g, or t
  misc_feature (1567)..(1567): n is a, c, g, or t
gataatgggttgcggtatggaattttactgtcaatcatatgtgcagtaaattggaaaatcttttgatcaaactgggcaatttaaaatttgaatcattatttatttatttttgattacggtgtatgattttttacggtaattactgtaaaaaaacacatcaattcgctgctttgttaagttatgagtcaaattgattatccttggattggttgattttttgttcctactcgctgccactcaattcgaaatggaagtcaagaccgctacagtaatcatactggaaaggacggtaattgccactaccttagtctaacaccatggctactgtataaaaggcttcgagattcggctccccaatcgctaaaatttgagtgccagcgagaaaagtaaactaaatgaaatgtttatgatggatgcccgtcgccaacaccgtaggacgagcgccgctgggagtaactactgtagccgtgctcggcaccgcctgctggaccggcgatcacaccgccgccgccaccgctggacaagctaatgctgctcggcgagaattgaccgcttggccgattttgcagcgactgcgcgatgtccggatgttgttaaagcggaaggtaatatgcgtccttctgaaaaagtgtatgaatcggcgtacagggtatgtttgtcaccatggtcatgcaaatgtaattataaacatttaaatttttcaagtcattaaaatgcaattaagtcaaaatgaatttatatattcgatagacctaaaaattctctattagcttgcgaaatttcaaaaaatttcattgaggttcaaaaaagttctggacaaaaaattccgacttaaggttttgtggaatttaattaccatatctttttatatatttaagtaaaaaatttaataaaattatattctgatagaaaacacctagagcttttgaatgataccaagaattattaatttggttgaaaatggaccaagttaagaatttatatgtcttacatttttttgttttcctatcacatggcggatttaggaaacgcccatggtggcggtttttaggaaacgcccatttggcggtttttaggaaacgacctagcacctaaataaataaagcgcgaataacttggaaaacgacgcagcataaatttctgaacttcgcatgaaaaaaattttataataaaaaaaatatatatatatatatatatatcaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaaaccttctgcctttcattatttttctcttgngttcaattccccaacggtacagaatttttttaataatttctttaaattattttcaatttgaattntaattaatanaaaatatttcaatttaaaaattattattttttctttttttaacagcctaaaaactgcaattaaccaaaactttgataattttttg

SEQ ID NO: 40092 - DNA, 982 bp, Heterodera glycines
ctaggcttagatcacatgcgattttcgccactctgataatttagcgctcataatgggatgtataaaggcgattgtagaggatttggaagcgctaaaatgtgtttgagaagctttttgagcgtaattacgatttttacttagaccattttttctaagcttagatcacatgcgattttcggcactctgataattttagcgctcataatgggatgtataaaggcgattgtagaaggaattggaagcgctaaaattgtttgagaagctttttgagcgtaattacgatttttacttacaccattttttctaggcttagatcacatgcgattttcggcactctgataattttagcgctcataatgggatgtataaaggcgattgtagaaggaattggaagcgctaaaattgtttgagaagctttttgagcgtaattacaatttttacttagaccatttttttctaggcttagatcacatgcgattttcggcactctgataattttagcgctcataatgggatgtataaaggcaatagtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataataggatgtataaaggcgattgtagaaggaattggaagcgctaaaattgtttgagaagctttttgagcgtaattacgatttttacttagaccattttttgctaggcttagatcacatgcgattttcggcactctgataattttagcgctcataatgggatgtataaag

SEQ ID NO: 40093 - DNA, 1221 bp, Heterodera glycines
  misc_feature (27)..(28): n is a, c, g, or t
  misc_feature (128)..(128): n is a, c, g, or t
cattttatttctcagagaattttaatnntatctatatcccagaaaaatgactatctcttattttgagaaattttatacgttacaaaagcgctcgagcgtgagagggagggcggtgcgcaatcgccatntaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcatgataggaagggcggcgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggcgcgcaatcgccatttaatttcacagagaatttttaaatttatcttatatccaagaaaaatgactatctcttattttgagaaattttatacgttacaaaagcgctcgagcgtgagaggaagggcggtgcgcaatcgccatttaatttcacagagaatttttaaatttatcttatatccaagaaaaatgactatctcttcttttgagaaattttatacgttacaaaagcgctcgagcatgatagggagggcggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaattatcttatatcccagaaaaatgactatctcttattttgagaaattttatacgttacaaatg

SEQ ID NO: 40094 - DNA, 1550 bp, Heterodera glycines
acgttctgcttcagacgctgaacaaacgtcgcgaactttcggaaatgttgcgctctcagcttcagttacgcaccaatcatctgcgtcctgcctggaaaaattttcgcgtccattgcaacgaactgacaattcatcctgctcaaactgcatatgccatgcgcggttatcttggcattacggtttttttaatttaaatttatcagctcctcaattgtatagatatacattgtttttaggtccgtatttactactatgtgaagcatggcgtaaagctcgtttatcctcagcttccctgtgttcttcaatttggcggtggtgaccattgttctctgtttccgcttgagtgtctgagcgtcataaaaggcctgattaatacgcatcgggtgttttatgtgtgattaagtttgctgtgttattgttgttgttttttttaatttctcctagataaaaaatgttaattattcaaaattgtaccgcggtgtttaaattacagctgttgcctttcacaaaagagcagtttttgaaaattgcaaaaaatggcttcaattccgagtacgacccccaacgatttcatgcaatcatcatacgactacgtctccccaaaaaacgcactcttgcatgtcttttatttcgttcagcccgtgctgtgttgactggtgtgccttgtccagacagagcggtgcgcgaggcacaaaaaatcagacggagggtgcagcatgcgttgggctcccagctaggaatccacgagttacgtgttacaaatgttgttggttcttgcactttatcacatcgattgtccatgctgaattttttaccaacactggacccacacaggttccgcaacatcaaatatgatccttcaattttttcccgcatgcgttgtaaaatagtcattgacgacgacgatcacactttggtcactgggggggggggatcattctggaaaaatcattttaacaggatctaaaaggcaggacaatttgaaccacgctttgcattcattcttagctgtcttaaataattgatttgttcatccaattgtaataaacacttttttgtttttgcaactgattttttttattgattccaagttgacacccaggacagttagaaattaaaaaggcatcatcatcatcatcaacaccaccatcatcggcattaaattgctgtaattcttgctcctgctgatgctgaactgtttgcgcttctcggaatccaaacggggttgtcttcatgccgggtcgaatgcgccccttcacataatggggctgatagtctttgtgagcttcgtgggtgtacaggtccgaacacggacttcgaccaatttgaggaaatttgattcttattgacgcactgcttcccggaacaacatgaacatcttccatgttaagcacatcgtcactttggaatacaatgttaggcggagtgttttgtggaattgtaaaaaaaaattacatttgtccatcaatgttgtaatgttccaaaacaatgtgcttcatggactcgaagaaagcagttgctgggcggaataagaaagacgaaaacttcgg

SEQ ID NO: 40095 - DNA, 1470 bp, Heterodera glycines
ttttcagcacccggaagttcactcgttgcaacggatccaatccaattgggtcccgctgatcagactaaaactgatcaattttgatcatgaaattgatattgtgttcgcttcaattcctggagagcagcaaattgatgccgatgatttacggcagcagaatattttgacaaaatttgaagaaatgatagaaaaattagacaacaaaatcaaacagctaaaagaagaagaagacagaaatgatcaagcctcattaacaaatgccaaggaacaaatactaaagtcactccgatcactcgctggtaattaattaatgaataaagtatataattaagtatatcattccatattaattaatgaatattaagcctaattacataattaagggtatcattccaatcttcaattgcttgcaatgaccaagaagaataataattttcataaattacttttgctactcaaactgtgggcaaaatgtgagttttctaaaaaaatacaattgcaaaaaaactcacaaagcgattttacttcataaaattggtcttttacattaaaatttagctaattacatttataataatgcaatgggcttcttcaatggcacatcgttgggcgttttggcggcaaaaattgtcttactgtatcccgaagcgacagtaccatttctgttggaacgtttcttcttcacttattattcatggtcaaactttaattaattaattaaaagcaattgatgaattcagggaatggcctttgcccgtacaaattgccgaaatccgacccaattcatcattaaattggaatgcatgggatgagcaaaaacatttgttgtcccaatacggtagcggcggtgcgtacagtaaacttatgataccggtgatcactcccggcttcccggaaagtaacagtacatatctaattaattggcaaacaacaaaaatcatcaaaaatgcacttgatgagggtatttctttttttattatacataaatttaaataattttgaaattttgaaattttttttattaattatcaaattaaataaattaccttaatttaattgtattttcacagttacatttcaaatgttttaaattttaaaaaccaatttcctaattctatgcttttcttaattagcatttcaattgtttcattcttcaaaaagtgaaaatgaaaaattgcctatgctctttgaacaacaaataaaattccacgaaaaggtaaattaataattataaattggggacaaaaataattaggtaaatacgcgtaaataattccctattaattacagtactctcaatattttgcgatcacttgtgtcgcatccgatttaaatatgtttaatgaattttgcggatttgttgttacacgcatacgcgttcaacttactcgccttagcgactgcacgcgtgacgatgtcgatttttgtcatttgattttgttaaatcgctgtccaccgtatacttacaaa

SEQ ID NO: 40096 - DNA, 929 bp, Heterodera glycines
ttttaaaatttttcaaaattctgactttttcatttacttatttattttttgcaaattaatttcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagttttatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaatcaattcataaatattttttcagaaactgctctgaaacgcaccaaatgttaattaaaagttaaataaggctctctgatgctttctctatcaaaaagggagatgaataaaaattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttatataaactgatcagaagcgaaccagattttgc

SEQ ID NO: 40097 - DNA, 1730 bp, Heterodera glycines
  misc_feature (1569)..(1569): n is a, c, g, or t
  misc_feature (1581)..(1581): n is a, c, g, or t
  misc_feature (1593)..(1593): n is a, c, g, or t
aagttgcgggcggcgtcgctgcggaacggtcgatgattccgccggggacaatgctcagtgagtgggacacatggcgcgtgcgtttgcttgcacccgcgtgatttctgtcaaattgcgtgtactccgtgtacaggttgcacgattgacctgctctccggtgcggaaaagctgcagcagcagcaacagcagcaagcgagtgcgatcaccttgtccgcaccagcaacagatgacccggttatgggtcgcgcttcggctaacagcagcccgcagccgcaacgctcagcgcgctcgggtgcgcctgccgcgggtgagacgctgtgcgtgcgactcgcgctcagcaacgaagtgccaatacggtgacgcgcactcaaaaaaattttaaatttttttttttttacaataatagagctgtgcttctttttgcggaaggaattttcgcgtcagaatgttatgcaatgtgattttaaaaaaatatttaaattaaattttcattaaaaaaaattcaaaaaataatttaattgaagcaaaaaaaaaatttggaaaaaatttattttttaaatttattttgacaaaaaaaataattttggttttgattgtatttaatataatttttattaaaaaaatataattaaattatattaaagtttttttttgtttaaaaaaatttctattaaataattttctttaaaataataaaaaaaattaaataaaataattatttttattgggaaataaaattattttttaaattttttgaacaaaaaatttagtgactttaattctttttaaatatttaattaaataaaacatgattaaactaaataaacaaaagttatcttataaacacaataaaattttgtttgtaaattgctaattttatattattttattttaattattaattattggcatttttcaagccacccgaatgggaaggaaagtgccgacatggtggtccgattcaatccggccaaaaatgtgttggccgaactgttcatcaaagtgtttgccggcttttccatggagtgatttttaattgtttaattacaaaattattattttaattacctaattaattatttgttcactaattaatgaattaaggcgccatttgcgtgtttttgaagtcaatcagctgttgccacgttttgtgacatttgtccaaatggacccagcctttggaggtggttattttattatttgacaattataaaaataatttattaattttatatatttttaattgctaaagaaataattcttcagagatttgtttattttgtaaaattaaatataattaattaaaaaaaagcctaacgaatatactttatggaggtattaactaagtttttgcatcaaaaatttataaataaaaattaaggaggttatgaatttttgaatttcttgaaaattttttggtgcaaaacttacttttaacaccctaagtaattcttgtttaattaaaaaatttcaaaaaatgcaagaaatttgcgagtattctaattaattaaagtatgtatgttttagttaattatattaattaatcgtttgtatgctttatatttttanaataatttttanaattaaaatttnaaattaatttatttgaagagacgcccgaggcatttgtggcatttcgtctccactgtcgggtggatcaactgcgatcatggtacaaattttgcaaggatcgaatttaggttttaaatctttaaaaatttccattttta

SEQ ID NO: 40098 - DNA, 647 bp, Heterodera glycines
  misc_feature (524)..(524): n is a, c, g, or t
ccaggggcgttcgaaaaccaaaaaaataattttcgaaaacgaaaacgaaacgaaaatatttatttttaacgaaaacgaaacacgaaacgaaaattcaaaattttaaaacttgaaaactaaacgaaacgaaaattttttgacggacgaaaacgaaaacacgaaaacgaaactcaaaaagtgacgaaaaaaggggacgacacgaaaacgacacgaaatttcgcacacccctggtcggcacccggaccctcccttgttcccgaaaattttgaaaaaacgcgccgcaaaaaatgcataaccgttgatatgatgaaaatgatcagtggaaacaaaaaatatccattgtataaattttcacctttttgggtttcgttaaatttgcccgttatgtcctttaaaatcagtatacccgtccttggaaagagagtttatacgagccctgccttaaaaagacttaaaaagtattctacactttgtttgaagcttctaacatgcagtttagtttgagtttgatggtttttcaccanaaagtctcggctggggcctagtctaatttgtaagcaagcatatgccactgatttctcatacaacaataattcctcattcactttttttcactgattgcttggccccgccgcactcaaaagggc

SEQ ID NO: 40099 - DNA, 784 bp, Heterodera glycines
atgccgaggctaaagccaagaaagacgcataagagaaggctaatgccgaggctaaagccaagaaagacgcagaagagaaggctcagaaggatgccgaggctaaagccaagaaagacgcagaagagaaggctcagaaggatgccgaggctaaagccaagaaagacgcagaagagaaggctaatgccgaggctaaagccaagaaagacgcagaagagaaggctaaaaaggatgccgaggctaaagccaagaaagacgcagaagcaaagaaaaaggatgaagaaatgaagaagcaaaaggctaagcccgaagaaaagcctgaggcacctgccgaagccgtagccgtagtgccggaagcgaagaaggcggaagagactaaggaaaagctgaagcaggaagagaaaccagtgaaagtgccaccatctccagcagaaaagaagagaaaagacgcagaagagaaggctaaaaaggatgccgaggctaaagccaagaaagacgcagaagagaaggctcagaaggatgccgaggctaaagccaagaaagacgcagaagagaaggctcagaaggatgccgaggctaaagccaagaaagacgcagaagagaaggctaatgccgaggctaaagccaagaaagacgcagaagagaaggctaagaaggatgcagaggctaaagccaagacagacacagaagagaaggctcagaacgatgccgaggctaaagccaagaaagacgcagaagagaatgctaatgccgaggctaagccaagaaagacgcagaagagaaggct

SEQ ID NO: 40100 - DNA, 1258 bp, Heterodera glycines
  misc_feature (1221)..(1221): n is a, c, g, or t
tggataatgaaacgatgccaaaatggggagacggcggcggttcgatgggagtgggattacgaaattttgggcgattttaacagaatcttcattagggtggatggtgtcaagtgcattgggtgagtaatagaaaagcatttgattttgtttaataagtcaaattacgctgaatttaggtattgtctccgtaaggagagaagctggacaaagcatcgaaatggggggagccttctgacaatgaacggtcaaaagaacaaaaaaagtgatcagctgctgaaatggactaattgggaaatggtcgatcataatttatcaatgataaaacgtaatttatgaaaaaataacagatacatataagtgcaaaacatagtatttttgttgagaaattttcccaaaaaatgtcgaaaaattgaaaaaaaagtgacaaaacgccaaaatagtgaattttcactattttagggaccgggtcgtttcggcgccgacgattcggcgacgacgtttcggcgccagggtcgtttcggcgccgcgccaagccagaaatttaaaaaataaaaaacacgcgaaaaggaagtggtcgctgatcaatgatcacgaatccgggctcagaccagcgctttttctgtcttttatatgaatttagaaaacaaatcaaaaaactgtccccaattaaatttttttgggagttttggccatttttgaaagatttttatcaaattttacaaaatagtttggaaactttgtgaggaagtccttggaggcattacatccaatttgttaaatatattcacatatcaactacaataaaataatcccatgctcttatcgcacactgatcagcaggaaaaaatgcaaatgatcaatagagtaaggtttagaattgaccaaaactaccggaagaacgggtcaagaaaaggataaataatgatcagagaaaaacaagacgtattcatcgaaaaatgatcaagccacaaaagaatacccaaaattggacgattggccaactaataaaattagacgatttacttaatcctaatgaatttacttgaaaccgtaaattttgattcgcaccttttggcgcacaacgacaacccaaagagaatcgttttatttttcgaaatcgcttttttcaagttctaataataaaaaaaacaagttgatcattccaataacagtaaaagaacaatttttatgagcatgtcaataattccataattcaaattnggtcgatcacttctcacaaatcaaagtaaatgtaaaa

SEQ ID NO: 40101 - DNA, 1322 bp, Heterodera glycines
aaaaagataagaaaatatattaaaatttaagtttaccaaaagccaatacgaggggtgtaaaaaaagtctcgggctcgagtcttaaaaatcgagattaaaagccaagaccgagagtcgagaccgagacaaaaaacctgagtcttttctcgactcgagaccgagaccaataaaacccgagtcttttctcaagtcgggacccgagactctcgaacagcactgctgattacccacataattttctgcgattgggtcataagccaacaaaaggttgtcttccgctcgcttcaactgccatgcctgaatagttggaggaaaatttatgatcaagatgaggaatggcaagcaggaggagatgggggctcggcggagcgcagccattttcaagcagtacaaagcaaaggggggaggggcaagtttgattgaaaactgaaaatttactgtcattataacatgctttaaataaacagaaaaacattaaaaaggtgctttttttgattaagggaggctgatgaaacaaaaaattatgtaaaaaaaagaaaaacgaattttttgaattttttattcagaaatttaagaatttttcattaaaaattttgtattaatttctgttaacggatgataatcgagaatatttatgtgtatttttcataatgaatccaaatggtggcaaaaatgtgaaagtaaatcacattaaaatggatatgttttttctgtgttctgccgctgacggcgctgatgatgatgagacttcccacgatgacaaatccacaccattttacaattattttattttaattttttaaataaatttgatgaaataattaatatattactagttatggttttttttaaatttaggtcatatcccaatatacaaagtaagttttatacatgcatattttggtcttaaaatttaattatatttttaaataattaatgctaaagcgttaatcttaaatattgtaaaactgtaattaaatttggtaataaatttcgaaaaattttgatttcacccttacattagtcatcattttgatggttttttaaatattgtaatggcctttttcattatgatggtttttttaaatgtcgccctttatgattgttttttaaataacgacatagcacccttgaacagcattgaattaatagaatattctaaggttcgtcaatggaatgtgaaatattttaaaaattaaattaaattaaatttgacccatccttctctcaactccatccgtctcttcgcgttccatcattttaaaaaaatttgtctcatttaaataataaaaaactaaaattgttgttataatcaaaggcta

SEQ ID NO: 40102 - DNA, 1263 bp, Heterodera glycines
  misc_feature (1158)..(1158): n is a, c, g, or t
  misc_feature (1166)..(1166): n is a, c, g, or t
  misc_feature (1208)..(1208): n is a, c, g, or t
  misc_feature (1219)..(1219): n is a, c, g, or t
  misc_feature (1239)..(1239): n is a, c, g, or t
gatggcacaatgcctgggaatgctgggtgattatttgccatattcctgttttttcaggtgtctccgttcgtctcccctcgtcccgacctcccttccttccaattggacttccattcggaaagggaccgctgcttgcgcgagcggcgtctcttcgaagaccccggcactttttccattccttggcactttgccacttattttcaatgtttttttctcagagttccctgccaccgaccgaagcattttcttcagcaaatctcctcctgaaggcttacaatggaaaaggccgggggtaattagtaatttgttgattgatttggggtcattaattgttcttttcgctgtttaggagctgacttcggacccccaactgatcgcctcttcctcgggtgcttctcgcttcgacgtcgtccaaggccaactcggcgactgttggcttttggctgctgctgccgtgctgactttgcgcgaggaattgtttttccgcgtggttccgcccgatcaaagcttcacggaaaattacgcaggcacttcaaaatacgaaagctaagaaagcctttgaaatcaaatttaggcattttccacttccaattttggcgttacggccaatgggtcgacgtggtaattgacgaccgattgcccaccaaagacggacaccttctgttcatgaactccgccaaacaccactccttttggagtgccctgctcgaaaaggcctatgccaagtgagtaataatcattgattggcccattttccaattttcgctttctttgccttaggctttacggctcttacgaagcgttaaagggcggctcaacttcggaagcgctggaggactttaccgggggactcatcgaacattttgaacttgccgagatgagcagggagcagctgctggctgtgctcgtccgtggctttcagatgggctcctttttcggctgttccatcgatgtttttgctttttctttttttcaattatgcttttccttttttgctgattaggctgatccctcaaaaatggaggccaagttggacaatgggcttgtgatgggccacgcctattcaatcaccgccatccaatcgctgcacgacgacgtcgtgctgttgcgcgtgcgcaacccgtggggacagcacgaatggaacggacggtggtcggnacgggcgnccggagtgggaccaactgacggagagccaacgacgcgcactngtgcgtggaantttggagagggacgcgaaanttttggatgtcgctggacgatttt

SEQ ID NO: 40103 - DNA, 1065 bp, Heterodera glycines
ttggccgatctcacatttcattggcgcggaggacggaactgttggagatgtcgtccgagcgtttgatgccgtcgccctctcatcaaaagtcaaagtgggactgatcatgatcggtcgtgatgcgttgatgcgcaattaaaccgccgacagcatcatggacaaattggggcgactggtgcagatgtgtgccacgttcccccatgtgaccttcttttggcttccgccgccattcgtccgtgatcgacaattcgaacacgaaacactgatcggcaaaatgcgagacttctttggccaaaagaagaacatccaatttgtggccacaacggcgacaggccgttcgcttcttgaaatttggcgctacggcaacggctacaacactgatcatgtgtcgcctgagggagtgatgaaagagaagggactcaacatgttgaaggcgtggcttttgacgcaagtcaaggaatttccgggtgatcaggagttgggcattgagaagaagaagccggagagtggagagaagggaaaaggagcggggacggcagcagatcgacaacacggccgcaccgagccgcctccattccgacgcgacgggcccgtctttcgccgctcgaacagccgaccgttcgttcagcacccgtactcgcgcaccgccgttgatcgccaccctttccgcccctttcgcacgccgaatttgccgaatcccaatcgccgtcactttgatcgctgaggacatcgctcgttgcaagccgaggatgtgataattaaataatgacctcatttgacttttaaagttttaattaatttggcattttgtttatttttttgtgtctttcattttcattttattttttttttcactcttcgcccggacttaaaatttgtgatgcggattgtgtgtggtaattttaatggtgcttttaattgttgtgttgtttaaattaaattgatttggattgctgtggctttaagtgattttaacttccttctcattcttctccttcgccccgttttggaattcggcaaaagagcagagaaggaccccggcaaaaaggcggctattttacgacg

SEQ ID NO: 40104 - DNA, 331 bp, Heterodera glycines
ggcacaacaaaggagggactgaaatgggcaggggagaggaggggaaagggtttgcattggcataataaaggagggactgaaatgggcaggggagaggaggggaaagggtttgcattggcataataaaggagggactgaaacgggcagggggaggaggggaaagggttggcattggcataataaaggagggactgaaacgggcaggggagaggagggaaagggttggcattggcacaacacaggagtgactgaaatggcaggggagaggaggggaaagggtttgcattggcacaataaaggagggactgaaatgcgcaggggagaggagggg

SEQ ID NO: 40105 - DNA, 1221 bp, Heterodera glycines
aatttgatttccgatcaactttttaccgtcggatccaatctaaaaatcttagtcgacccatcaaccccttttaatgcatcccgccagcccttaaaaatttatttttcagcatttttagatttttggaaattttttgaatttaattgaaattttttcgaattttccaaaatcccgcaatcccgcgcgggatcccgcaaattttaaatgcgggatttgcgggattgcgggatttgcgggattaatcccgcgggatcccgtcccgcaaagaattttcagtaccaatcccgcagcgggatccgcaaatttgaaatttccgggctctagacactacattaagttaaataaatggtttcattttggatttatattataggtccgtctcattttgtcttctttcttcactattaatagggctcggatttttaggtgctaaaaatccctaaataggtactaaaataggtgctaaaaaagtgcaaaataggtgctaaaaaccccaaaaaaggccaaaataggtgcgaaaataggtgttaaaaattaaaaaatctagaaataggtaaaaacctaaaaatccgactcctaactattaataatcatacacaataggcgatagataatgcattcattaaatttaaaaaatataactacctaattaaatttttctctttaaatttcatcaatattttttttaattaatttattattttttatattcattttattatatttaatttgatattttaaattttggcgatatgatatagtcgtaaatggtcattgtcgaaacggcattgtcgaaaaggtattgtcgaaacggtcattggcgaaacggtcattgtcgaaatgtccagccaccgtttttggaagtttctctaatattagctggttttaaacgtgcatttcgcaattcagtaaaaaattttcccacacaatttccaatctaataatgtttcaaaagaataatattctgcttaaagttacattttataaataattttttttgaaagttttgcagttttagaatcctccaaggtggccgttttcagggaaaatctatcaccattgtacattttatattttgccattttcatccattatttggtccaattaacttttaaataatttgatttattttttcaacatcagattgcctattttcaaaaccaggacaaatctaaaatgacgggatatgccaaaattggcattattgatgctgggttctca

SEQ ID NO: 40106 - DNA, 1146 bp, Heterodera glycines
  misc_feature (62)..(62): n is a, c, g, or t
atgattagagagagaattttggggaaaagccttttgtttgctaaagttccttgggcatttgncctcattccgctaattgatcaggagattgaccagccgaataccatccccattgtttagagtcgttgattgtgcataggatatatatgtacaaaatatatatatttggtggctttttgttgtccgttgaaagtccgtcgtctgcccgtggtccaccaaaataatgttgtcaaaattgtttaagctttgttttttgctccgtttgatccgcctcctctctcagcttttgttgctgatcatccgatttgtcgtccgtctctcatcgctttatccatcccgctctctcttccccctcccctctatctcccccgcgctctctaaccctctttctcttctgtctgttgtccattgtgtctcattggcttagtgtttaattttttattgggttggcgttgtgtaacattttttccgacaattctctgcccctccatttgctgctgctgtccttgtgttgttgttttgttgtgtggtattccacccggtttttccttttcttttatttatttccttgtcattgtgccccaattttcccattggccgacgtgaaaatatttttggcccattttccgctgcttttgttgtgtttgtcgaccctctcaatgatcacaatgtgtttggtgtttgtgtgcttttagcgtgataattctgaacagttcataatatgtatttttttaggtgttttggttttatttttggcgaacaaagcgaaatttttgttaatgtttttagaattaattggcaattaaatggttggaaggaaggtaattaaaaaaagtcacctctcattaaaagtaaatatatagtttcacaccttcgctaattatcactggacaaattgaataagaattaggaataaatatatgtacgaatgtaaaaattaaacaaaataggcacttatacaggagagacttggaccatgccaagatttcccaagggtttgaccatgaatttggtattgtattgaaaaaaatgcatcaggatctggaaaacttaaatatgaacctttcaaggtccttcgatctcgtgaaattatgataattattgaaattacattcaaaggctggccaattaatgtttaatgatgca

SEQ ID NO: 40107 - DNA, 1065 bp, Heterodera glycines
  misc_feature (1027)..(1027): n is a, c, g, or t
  misc_feature (1042)..(1043): n is a, c, g, or t
ttttttgagcgttggcaaagaggggggggggtctggtggtcagcagcgcagcagcaagtatcagcgcgtgtggagttagagaaagagaaaagagtgaacggaaaactgagagagtaagatgtgagagaagaaagaaaagatggatgagagagtagggagacagacagttagagaaaagagaataaaaatggcgacatggcttgctagcggagaagggaaatggacactgaccatattaattggactttacctctttaaagcactaattttataagcattaaattttttatttaaaattgttttttggttagataaatcactattacattcatggcaccacgacgcaaaagaaaggcgacaaacaatggcaccgatcaacacgacggaagtgacgcagaggcgccagcagcagcagcagcagcaattgatggcaccggaggacaagtgctattttggtctttgctaagagggctttttggtttacaaaattcaccagagggtatatgagtatttaattgaaaaaaattgttaattttggaaaattcggaccattattgaattaaatttgacggtacaaacggacaagcggtaattttttttccctgaaaatttattcctctaatttgcagggcaacaaagtgttgtggcaggcgctggccaatcagcgcatttcatcgtccatctcgcgcagcacggtctcgcgcacagcttcgccggcactgtcttcttcctccgcttcttcgaatgcgtccagacggcaacgaaaaaatcacagcaaaattgggcgtgtaccggtaagaaaaaaaatttttgtattaaagtcaaacacacacacacaaacacacacattcacttcctagataaatgtgaatgacgattgcccaaatgtgccgcctggagttttgcccaatccaaaaacgcgccagtaccaggtcaagagcgtgttggcacagttcactcacgcatcggggaggaaatgctatttcttggagtggctcggtgagtttgatgatgaaattgaaagaanaattgtgtgaatgannacgtggacggatggataaggaa

SEQ ID NO: 40108 - DNA, 698 bp, Heterodera glycines
tgaggaaaagagaaataaatatataataatcaagatatattttggattttttatgttaataatatataatttaatttttctgataaataaaaaattactccatgtaattcgttcgtagttttttttaaatttttcttttgattattacttaatttaatgcattctttttatagtatttatttatccatatctattctagctgcacaatggacataatattttctacaataatatgttttttctaaataaataaattttatttattaattatacaattaattagaagttgtaaatattttgcaaaatttacggtaatttaatttttaataatgattttttatataatttcaaaaataaccttttttggtaaattacttaaaaaattatttaatttgataaaaataatactcaaaataaaatggaaaaattaagaattaaatatttgacgtaaagattggcgaaaataaaatttacttttcattagacagtattacaaatcagataaaaaatatatattaattgatttataatttaatatataaaaaaatcataatcaattattaaaaagaaactgaaagtggttaccatattagttcgtacaatttcctgtgagccaaatttccttgattatgcatgatgactaaaagctcatcaataaaaaacaaatattttttgtatttttaaatataaatattaaa

SEQ ID NO: 40109 - DNA, 1025 bp, Heterodera glycines
gtcacttttgcttctccttcttccgatgatgcttttgtattgtgcagtgcccagttttgttgtttgttgtgtcgtcaatttgtgcacacttctgcctgtgctcagctgccgttgatttgatttgatttgatggcacggacggaggagaacagcagcggcaataaaatagaggaaaaattaatattatttggaatgaatggccggaaatgctaacatcactcccttttatactgctcattcattcgaaatttgaaatcctttttttaccgaatcagagccccgagcccctataataagtgtcgctgatcacggatctgacatccctttcgactaccggattaagatttaaaaaattggatatttcgtggctcagcgaaaaaaggggccgcttaaaaaaggcgtcaaaattttatgcgcaaaattctctccccttataagggggtttctgtgttcactttcgtcatttttgtttttgtttcaacttcaactacaacaacaaatgatgccgtcgcgttcatttttcatcaaattcaaatgggaatttgcctttgtcgcgtttctgctgctgctcagtgaatgcttttgctcggttggcgcacaaccaaccggcggccgaaagtaaaaatgccatttttttttgcaaaattttccattttcacctcccctttttatttcagtgtaacaagtccaagtacgacgggatcaacaggttcaactatgacgacaacaacaacgacgaccactaccaccaccagcagcacgccaacgacgccaaatgggacgacgacgaaaaattggagcgaatcattagcggctgctgttggcggaaagaccacacttgtgctgatcatcgttgggtgcgtttgtccttgtttaccatcattcattggggaccgaccatgacgaaggcgtgtttttttgaatgtcgacaatggcacgaaattccggcattttgggttgttgggggaccgaccctgacgaatgagtgtttttgggatgtcggcaatggcacgaaattctggcat

SEQ ID NO: 40110 - DNA, 662 bp, Heterodera glycines
aaaataggcactaaaaagcctcatttttagggggtgtaaaatgataaaatttattcaaacaagtaaaaaaattaggacaaatcattattgagatatataatttattaaatcaaaaattgataatataaagtgatatgatagcaaataattatttttaaacaatagaaaaattggattaaaaaaatatatatttataatattcgctagatctttaatttaaaattatttcattaattgaaaatttttgcattacttttgttttaatattttaaaattttgaaagaaattttatacaatattagggaaaaattttttatcttattttatagtttttataaattacaaaaaaaaactgtttaaatctttgaatgagttgagttttatttattcattgttgaaatcaacttttatttattcgattaaatgccaaaattattattttttgttttattttttgcatcataaatccattattaaatatttgttatcacttctactgtgaagctttagaactaaaactaaaagatatacaataattgtatttaaattgagtagtttcactttataaaatattgcgattaacattagtatttaatattctcttctctatttattattataatcattttttcatttatattttaaaaataaaaaataattga

SEQ ID NO: 40111 - DNA, 189 bp, Heterodera glycines
gttctgggctccgggtgggccgggtgccgcctcatgaaggggctcgacactcaaatctacgacgtcgtttgcgtgtccccgcgcaatcacatggtcttcacgcctctcttggcttccacgtgcgtcggaactctcgagtttagaaccgttgccgaacccatcgccaggatccaacccgctatctccaga

SEQ ID NO: 40112 - DNA, 1180 bp, Heterodera glycines
tattaaaaccgcagaaaaaataagtaaaaaccgaatcctcaccctacccattaatacgcaaaaactatacatactaaacatgccttaattgtcaatttcaatttttttgtttaataatttttcttggcagattttgattcattagatttgatggcaggcgtatctttgtgtgctagtctcttctccctctttcttgttgcccccccccccccccccccgctctctctctctctctgccctctgttctctctcctttctttgccttgtctctttctctctccctctccttcgccgtttctctttcgtcacactttcgtcagcactgtccatttcaaccaatgggcgtgtaacatgttgggtttttgtggattcgttttcattcatcagatagatgaagcgcgctctcaccattcgcttctttgaaaagagatcgttgagcttcgcaatacttaagtggcaaagcaaacagtcgaagtctattacaacactttttaatttgttatttttacattgacactcacaatcaatcagacatttcttcattttcgtttaagcatgaataacattaaaaatactaaattttatttcattttagaaagactatgaaaaaatcattcgtttcttttctgttttttacggcattgctcgtcattgtttgctcaaaagaggaggaagggggcgcaaaggaaaagaagtacggcacaatcattggtattgaccttggcaccacctactcctgtgttggcgtctacaaaaacggcagagtggagataatcgccaatgaccagggaaaccgaataacgccttcctacgtggctttcacaccagactcgggcgagcgtctgatcggagatgctgcaaaaaaccagttgactctaaacccggaaaacaccattttcgatgccaaacgactcattggacgggaattcaccgacaaaaccgtccaggacgatatgaaactttggccttttaaggttccgaaaagcacgaatatttaataagaaaaaactatttttagatctacaacaaggcaaacaagccccatgttcaagtgaaagtcggtaacgaggataagcaatttgcggcggaggaggtttctgctatggttctgacgaagatgaaggaaattgcggagtcttaccctcggtaacaagtgaaaaatgccgtcgatactgtgccg

SEQ ID NO: 40113 - DNA, 886 bp, Heterodera glycines
tgataattttagcgttcataatgggattgtataaaggcgattgtagaaggaattggaagcgctaaaattgtttgaggagctttttgagcgtaattacgatttttacttacaccattttttgctaggcttagatcacatgcgattttcgccactctgataattttagcgctcacaatgggatgtataaaggcgattgtagaaggaattggaagcgctaaaattgttggaggagcttttggagcgtaattacgattttactaacaccattttttgctaggcttagatcacatgcgattttcggcactctgataattttagcgttcataatgggatgtataaaggcgattgtagaaggaattggaagcgctaaaatcgtttgaggagctttttgagcgtaattacgattttacttacaccatttttttctaggcttagatcacatgcgattttcggcactctgataattttagcgttcataatgggatgtataaaggcgattgtagaaggaattggaagcgctaaaattgtttgagaagctttttgagcgtaattacgatttttacttaaaccattttttgctaggcttagatcacatgcgattttcggcactctgataattttagcgttcataatgggatgtataaaggcgattgtagaaggaattggaagcgctaaaattgtttgaggagctttttgagcgtaattacgatttttacttacaccatttttttctaggcttagatcacatgcgattttcggcactctgataagtttagcgttcataatgggatgtataaaggcgattgtagaaggaattggaagcgctaaaattggttgagaagctttttgagcgtaattacgatttttacttacaccattttttgct

SEQ ID NO: 40114 - DNA, 1683 bp, Heterodera glycines
  misc_feature (704)..(704): n is a, c, g, or t
ttctctggctctgtatctctttatttttctttaaatcagccatcaaaaatacctacctctaaaatgaccatttttacttacttaactctaactccctaaatacttttccattggtattgatctcttgccagaataatggcaacatattattgataataatggcgggtattttggatcatgattgtgttttgttgaaattcaaaaaaaaattttaataaaaaaaatttgggtatcaaaaattatgttccaccctacgtacatacattattaaattaaaaattaattaaataagtttgaacaatgaaattattcattaatattttttctttatctattcgattatatggcaaattgattaaagaaatatattattaaaatattattcataacattaaatttaaaaaaaaacaaaaaaataataaaatgagaaatatttattaaaactagatagggtttaaatctcaattaaacaaaagaattagttgaaaactgtatatcaagtttaaataaaattataaatcataatattataatagaattactttaaaatctatgagtgaataaaaatctggttttactaatggaaaaaaggaaaaataaacaaaatttaaatgatgaatcattaaactattttagctttttaagcataaataaaactcaaatagacatttaaaataaataataaggttgaaaaggggtattanaaaagaaaaattcgaatctgtgaattaaattctgtatttgctctaattatcccccaatctccaattatcccccagtctaggaggtgtttgaataatcccccagtctccatttatcccccagggggataaatagaattttcagaaaattatatgtcgtcaatttttttcaacaaacaaacaaaatcgacagtaaaagtactacaaatgccaaaatagtggcaaagatagtggcgaaaagtccataatgacataattttcagccaaaaattgagcaaaattttttttattcactggattctgttgcaaatgaggttacatttccttctaatattttagaaaatattgacattttttaaatccaaaattcttgtcaagaaaaaaattagggatgaatagcttgcaaaaattttgaaaaaatagttaaatttgaaaaaagttatagccaaaaaagttggaaaatctggttttttgaattcttctgaccttaactttttttaaacctaatgaaatttttggcaattttgcgctaatagagaacacttagggctttcgaatgataccaacaatgttggatttgattgacaatgaaaaaagttatagccaaaaactgggctggcgccgaaacgaggtggccccattcttaggggtgtattttttgttcttgcattttgttgagaaatttttcaaaaaaatgtcggaatagtgaaaaataggtggcaaaatgctaaatttgtggcaaaaaaactattttagtggccaacttccaaaatgttttttatagtggcaagcccaaaatagtgatttaaaaatgccaaaatgactacgaaaacccaaaatttttcatatttttggggtgtaatttttaaaaatttccaaaaaattgaactttaggggtgtatttttcgcttttttgcattttttctgtgaaaatttgccaaaaatggccgaaatatggactaaaacccaaaaaggcgaaata

SEQ ID NO: 40115 - DNA, 1078 bp, Heterodera glycines
ttactgtcttaggtatagtttttccataattcttttccttttaatactcttttttcttcccgttccgaattgacgcccaaccccacctttttcgagtacattatccattcccttctttacttcattaattattgcttgtttgtttggtgtttcagctttctctattgtatccaatacacgtgttccagtgtctaatgcctctctacccaataatgtaccagcagattttaattttggtaaaagtgctctccataaaaacctcaacacatctcctactcctccacctcgctgacgcccataccctcgttggtatgggggtatcccgcgaaaataattaaaggcttctcccgagccaatctgctctactacaacaaaatcatcaaagctaactgagtttggatcaaatatttgatgcaccatatttattcaattattaatatatactataatgtaaaaatgaatatttaaatactaaaatacaatagattttttaaatgctaatacaagtaatgttgtaccccattggaatggaataagccttccctccctagtcctaatttcaatttcaatctcgttaatttcctttactctcaatcacgtctccaaattttccttcaacgacaacaattcgcaaaagtgaagcgagttggtcccctactattacattctcagtgattccattaatgtacacacaaaggctgtctataccaccctttaagtcacaataatactttgctatagctccactcagaatttttgtcgggtcttcgaacccgagaatgtagccgagttgagccgacaactcaataaagtcaattctttggtcattaaaatcaattgaaaatttccgccgctccttcaaatatttaaataagactgtttcaatttgttttgaaacaattaaatcctttaatgattctccacgtgttttgacacctacaatttcttcctctattggtttactagccccaattttttcttttaatatttcgcctcttgtttttccttttgttttttcttcttcgggaatttgttcaattctatttttcaatgcttcgcccatgggttattctttctt

SEQ ID NO: 40116 - DNA, 1030 bp, Heterodera glycines
  misc_feature (54)..(54): n is a, c, g, or t
  misc_feature (145)..(145): n is a, c, g, or t
  misc_feature (178)..(178): n is a, c, g, or t
  misc_feature (202)..(202): n is a, c, g, or t
ctttttgtttggcaactggtagaaattggcagtgaaaaaaagtttgttttgtanctatttacaataaaaatttatgtagcatttctaaaaaggatgtaaaaataagttcttgcgtaatatttttatattgtgtgtgaagaatttngagtctgcttctgatgcaagtggaaaattttcnagcttttctcgaaaagttttttcncagaaaaaggatgggacaaataaaaaactaaacatctctcatgaccaatttaaatttccttacattttgggtttactttattatgctggcccatgaaaaaatgcagtttttccggtgccaaatttttgtgaatttttattcggcgcgtcataagcggattgtttggtggcaaatacaaacaaattttgtgtaattcgaatgcgctatgcgggctcgacatttccaaatgtatcaacaaagggtctatctccactctctggcgaggtatggccagccaaagcagagtggggcataaacaagaattttttaatctttggtatttcctctattttgtgcctgctctacatttatgtcttgtgccaatatgcctattgcaacagaaatttattcagctttcccgataaattgttgagataattattctagacgattttttcatatctcaatgcttaactatcgcctttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgaccaatttaaatttccttacattttgggtttactttattatgctggcccatgaaaaaatgcagtttttccggtgccaaatttttgtgaatttttattcggcgcgtcataagcggattgtttggt

SEQ ID NO: 40117 - DNA, 69 bp, Heterodera glycines
  misc_feature (6)..(7): n is a, c, g, or t
ctgcannggtccacggttgggcgcatgcccctggctgctgaagccaggccccgggccggcgccgccacg

SEQ ID NO: 40118 - DNA, 966 bp, Heterodera glycines
gttgtacatgtggggtttcccccaaaaacgcattactatctgcgggtgagcctacaaaaatgtcgggttgaaaattgctttctcagaagaatagatactctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaatggctatctctttttttctacaccggtggacatgtggggtttccccaaaaacgcattactatctgcgggtgagccctacaaaagggcgggttgaaaaattgctgtctcagaagaaagatattctcagaaaaatggctatctctttttttctaccaccgttgtacatgtggggggttcccccaaaaacgcattactatct

SEQ ID NO: 40119 - DNA, 790 bp, Heterodera glycines
ccgttcatttcttttcataaatgaacaaagaaaaactgacaaacatttagaagtagcatcattcattcaatattgtcaagagattcgcttgcttttaatgttcttttccgtaaattttttattgaatggttcaaatatcaaccgttaatttaaagaaaaattggatatttttttttacaaatcgttacacgctggcttttgttcttgtccgtaaatttgttgaagtcgttaaaatatgaacgtcaatttaggcgctcgaagtgcagaaaaatgcccagcaaaagacgatggaatatctgaacaaaacgaatgaaagactgaaggcgacgggtaaagaaaaaaatgaaaataaataaataaataaaaattaataaaaatgacaaaatattttagcatattattaccgccattcaaagactgctttggacgaagttcagaagagaatcgccgtaatggaagtcatcgtgggcctgctcatctttctgattttcacttcgccatttgcttattatttttcgttttagccatttaatttatcatttttatggcaatctccttaaatttgctaccttaacaaatcacttttcttttgtctctcttttttatgtaactcattcagctaaaaattgaaaaaaatgaaatagtctctccaagtgttttttaattaaattaatatatcgaaagaattctgagtaatttaaaaaaaatcgtgaggtctattttaaaaattggtatttttaagaaaaatctgttaacaaatttcaaattttcaaaaaaaattttcctcgcg

SEQ ID NO: 40120 - DNA, 1168 bp, Heterodera glycines
cggataatggaaaattccatttggccttcttcccgtattccaccgtcaaacactcggccaaaagcgcagagaatccgcttcctaattggtaataattgcctttggcattgttttgtgccattcttttgcctgttccaccgccaaacgaatggaacaggagaaatccctgaaggcctgaacagttctccgccacttcttaaatggttggaatgccgttctttcccttcttcgcttcactactccgaattctgtccatgcacactccgatcagctcctttccgaccgtgtaatggcctcgggcgtagttgttggccgcgtcctctttgccggtgatcagttgctcgggatggaacaactgtctgtaggcacctccccggacttcgtctaataattcccctaattaattcttaattgatttgatcccaaattattcttcttaccaattaccgtcgactccaaatcaatgaacaacgccctcggcacgtatttatctgaaacaattaaagacattaaaacgttatttttatgcttaattcgcgtctcggcaaaaaatgtgtccactgaattgtcggccggaccctcctcactgtccacaaatcggccctctgagttgatgccgtgctcgagacagtacaactcccagcaagcattgccaatttgaacgcccgctttttaatagttatttttaattaattataaattgatttagtgcaccttggcctatgtgtagagaaaccacctctctctttaaaaaagaaatttgtatttaatcttaaaagttttgactaccccaaatttgcccatttgattgggtaaaccgcggaaattttcttttcgaatggattaataaatattggcaaattgaggataaaagtttttgagaaacggtggggggggggaaagagggcggaaacgagcaatccttccagatgaatggaggcattggcacgacacaaattgtaagtgtcttaatggtcgaaaatggaaggacattaagagggacttagagtttatttatttatttatttatttattttgcatttccttttgattatttttaatttaaataaatgaaaaatgaaatgatgataaataagatatttaatttcttatttattctctttttaataaatatccaatgtttgtttcaatttttttgtctttttct

SEQ ID NO: 40121 - DNA, 707 bp, Heterodera glycines
atcttaattccattgatgatgaacgtgagtctccaccagcgtcctgctgcggttccaattcccatgcagtgggatttgacaacgacagtgtggacggatcgctctctgcgatttttcgcttggttggagctgcgtcggcacgcctttgcaatatgcccttgtccttggcatttgttgcatgtggcgtccttaaatcggcaatccgtacgccaatgatccgactgtccacatgagccgcacggatgcgttggtgatccgtggcttgccttgccataattggtgtttggtggacgcgcgggttgctccttggcattgttggtcctcttggttgttgcggtgggttgtcttgtgatttaatattttattgaaagattataaattgttttttattctagattcattttatattttttatcttttggttttcattagataatttttattctatcagagtaaatctaattactgtaattttcgcttgatcaatcaaatggcttaaattactaaaacttaataatattcgtttagattttaatttaaaataattaataattcaactcatgtattaattattttatttttaaagatggcactgcaccgctcattgctgagcatttaataattctgcaaaattttaatgaataaaaaaatcaataaaaattagttatgacacttttgcaaatcacctcatgaccatgtccttcatc

SEQ ID NO: 40122 - DNA, 956 bp, Heterodera glycines
  misc_feature (87)..(87): n is a, c, g, or t
  misc_feature (96)..(96): n is a, c, g, or t
ctttttgagcgtaattacgatttttacttacaccaccccccccaggccttagatccatgcgattttcggcactcccttataaagtgntgataatgnggatgtataaaggagattgtagaaggaattggaagcgttaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgttaaaattgtttgagaagctttttgagcgtaattacgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccatttttttctaggcttagatcacatgcgattttcggcactctgataattttagcgctcataatgggatgtataaaggcgattgtagaaggaattggaagcgctaaaattgtttgaaaagctttttgagcgtaattaccaattttacttacaccatttttt

SEQ ID NO: 40123 - DNA, 894 bp, Heterodera glycines
aaatgtgactttaatttcaatcactttttacagttaaattcatataatctgaaattggctctgaattgcaaaactggtcattagtgaaaatctgtttgttgatttgactccgaatgttgattttatttcggccaaatgttgacttaatttcaatcacttttacagttaaattcatataatctttattggacatttgacttaattatcataaatatttaaaaatatttaattcattattaaaaataaatttatttatttaaaaaaaatcagaatgaatatttctcatttaatgtaaaattcagttcttcgttttataagcattcaaaatttctgaaatacgttaaaaagtgaaaaaaaaattatgaatgataaattaactataacattaaattaatgaccaaaaaatttttatttagccgcagatactgtttatattaaaaaaaaattcgaatgtattttccaataaaattttgtcaacatgtaaaaaatgtttaattttttatccgatcttcaaaagaaaaaaaattcgatctaaataaagattaatgcattttatacatttctaatattaaagaaaataatgaagaaatataaaataaaaatgcaagttctacaccagggctgttgcaagtttcgcctttcgctatttcgctttttttgggcctttcgctttcgccttttcgctttttgactgaaaagcgaaataaaagtacacccctaaagattgggtttttaaaataaataattaatataaacattaaaggagaaaatctatagaatttatcttttaagcttttttatgaaatgtctttaatttggaatttcttcaaactttctgggcgggttgctttctgcaaatcatgtaattataaaaaggattttcctctgcgatca

SEQ ID NO: 40124 - DNA, 743 bp, Heterodera glycines
  misc_feature (77)..(77): n is a, c, g, or t
  misc_feature (726)..(726): n is a, c, g, or t
gctttgcctctaaaaagctcttgagagatttatttagaatgtgaaaatttattttcattattattttggcatttctntagcatgaactggtagatttattagtgctgacaattatattaagtagaaatcactcaggctgtcttttaaaatgtttgacagccattcaaaaattttttataattttttgtcctataattaaactcattgaaaataaagactgctttgcctctaaaaaggctcttgagagatatattttagaatgtgaaaattttattttcattattattttggcatttctttagcatgaattggtagatttattagtgctgacaattatattaagtagaaatcactcaggctgtcttttaaaatgtttgacagccattcaaaatttttttataatttgtgttctataattgaactcattgaaaataaagactgctttgcctctaaaaaggctcttgagagatttattttagaatgtgaaaattttattttcattattattttggcatttctttagcatgaactggtagatttattagtgctgacaattatattaagtagaaatcactcaggctgtcttttaaaatgtttgacagccattcaaaaattttttataattttttgtcctataattgaactcattgaaaatttagactgctttgcctctaaaaaggctcttgagagatatattttagaatgtgaaaattttattttcattanttatttggcatttcttt

SEQ ID NO: 40125 - DNA, 933 bp, Heterodera glycines
aatatcaaaaattaaatggatcggagtcatttttggacgcccccattcttaggcgcaagagaaactaagaaacaatcaaattttgggttgataaaatctctaaatagtgattgaaattgtccaaaaaaaaagttttatttagcgttttatgtgacatggacataattaaattatttgtatatttttttaagatggcccaaaacagacgaaatttttaaccaacgcatatggcaaaatcgaatggaatttctttaaacacatccataacgacaaagtgatccatgatatacattcacattacaatgcacaggaaaagatcactattctagtcgaaaaggcaccagataagcgaattatgactgaatacgttaattatgacgagatgcataaggcaatggaaaaatcatatggaaaattatgcgaacggaattacatcgatttctctgaattgccggtgagtttaaaaaaattaattaattgttccatcaaccttaattaatgttatatctagggttggtcacgaccggttattaaccggtacccccggttttcggttatgccggttttcgacccccagtttacggtttcggtttttggcgcaaaaaagccgggttttggttcgatgaaattattagaggtgcaccgtgacccacggtcacgattcacggtaccaattcacggttattccgtgaaaaatttacactggataaattgaaaatttacgaattacatattgttttcatagagaaatttggtcattttttgggcaaagttgctaagaaacagagcaaaattttcaataatttcccccggcggcgcctatcctatcggcaccgccggctccctcccctattcctgaaacttttttgaacaaagccaactacctatattggagaggaacaaataaaaagcaaagtttcaaggatgatccca

SEQ ID NO: 40126 - DNA, 926 bp, Heterodera glycines
tcgttccaagttcgcttcgattgtttgtccccgtgcttttgtctgtttatttgtcctaatggactgggcattcttttcacctttcagctgatcatctgctgcagatgagtgagtcatcgcccctttctccgccggcggaggcggcgcatccaatcgccccgggcacacttttccaaccgatttccgttgccggcggcaacaaccgcaactccaccgggtccacgaacagcagtcaagcaagttccggcttcgaaagtgccaaagtaggcccaatgaatgccaacgggcacacattgattgacgtccctcttccggattcagagttccagttcgcaccatttggcaacttcgaccagttccggcagttgttcatccggcatcggttcgtcgaccgctgcagctgtcctcccccattgttccgtctttccccccaacgcttcgcccgaagctcccgccagcgcttcctcccgcctctcttccgctggctcttcaactcattgtcgttcttccgcttacttttccatctccgatgggttggattcgtcaattggccctggcgggactttgacagtccaaaaaaggacaaaagaaaaatgcccccgagtaaatatcaccgaaatgatggccaagggcataccggtaatatccaaccgaaggctgttaaatttataatgggattaaaaaaggaggcagagatttatgctgagtggcttcaaaggctgtgcctttccgagtatttggccctgtttcttggccagggctatgatttgccgacattggcacggtcatcgccggaggatttgacaactttgggcattacgcggcccgaggaccggaaaaggcttttccaagacatccagacttggcgaaatgtaacagcgaattgcaaaaaaatcaattgagtcgaattttccctttagtgcaag

SEQ ID NO: 40127 - DNA, 761 bp, Heterodera glycines
taagagctgcagaaattgtgaattaattctcagaaaaatggctatctctttttaggacaattttctatctcgtaaccccgatgttaatccgttccggagagcctgttcaaaattttttccattaccgtaagagctgcggaaattgtgaattaattctcagaaaaatggccatctctttataggacaattttctatctcgtaaccccgatgataatccgttccggagatcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggatagcctcttcaaaattttttccattaccctaagagctgctgaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaagacaattttctatctcgtaaccccgatgctaatccgttccggagagcctcttcaaaattttttccattacc

SEQ ID NO: 40128 - DNA, 952 bp, Heterodera glycines
gcaaagaatggatgatcccatagtgtccatattatgccctaattaatacagtcagtcccgtctcatgtgcgtttttctatgtcttatccatgtaaaaaattttttttgacaaaatccggaaaatcaaatttttatttatgcctagtatttttgtaatgtacattcgcgaaacatttcgtgggctcgagtcatgagaaggaaactcggctctgatcaaaaaccaaaacgatcaagacaaaaaaaaacagattttttttgttttgccaattttgctgagcagcatgaaattgggccaacccattaaatcaaatacttttcggtttggttacgtaataatttcgccattggcttaaaaaaatagaaaaacatttaaattttcgtaatttaatgtcgaaatcaaaactttctatctttttatttaagtcaatcaaattattaattgaattggccttttttaattattattattatatttgcgaaaaaacatattaatacactaattaattagccgggaactcacaaattacctcaatttctttgccgcatgtaatgacggcaatattttcgacttcgccctcctctgctatgtggtcatgaataaactggcagatgtggatcatttggatagtgtcaaagatttcctgatcatatgctgcctcgcaatggtgccattgtaaaatcagcggtgccattgtgaaaaaggtgatgatggcacaacaacaactcagccatagtgccattgtaaaaatatatttttgcttaaaaagaaataaataaatataaattggtaggttgtggagtgattcattatttatttttttgaatttcaacgtggaaaaacaaaaattataatgaattacgtaaacaaaatgaggtaatgaaaacatttcaagcttcgcaaaaatttggccaagtttctgggattatgtttcaaagacctcagcatcaagct

SEQ ID NO: 40129 - DNA, 646 bp, Heterodera glycines
  misc_feature (10)..(10): n is a, c, g, or t
acaactttantgcattgggacaagaaatccccggggggaggggggagacgaagatggggcgggggaggggaggggagggaaaggaagggagggagtgccacgaatgcattagtggccgtgacagtgtcggaatggcatttttgtgaaaggaaacgattgtctatcagcagcgcagaagagaaaagccaccaataagcatcatcggatacaatgccaaccgattaggggaggggaaaagcggactttgggattaaacaggaaaaatggcaaaagtgaaattggaaaagcggagaggaaggcacttcaggacaaattgcttgtagcgaatttggacaagtttgcgttaagggacagctaaaagcaaagagaaagcgccgacaataataataagcaatttccgttcatcaaaaggctgagggaggtgttaattatgtgataattagcggagattggcgacggcggcggccgcggggggaggggggaggggggagtgatggatgggagtgacacgacacgcaataaatgcatggatgagccatctgatcggcaccggcttgcccgtttccacaggctttgacggtcctctgaatgcgaggcccaaatctgcccaccttcacctggaagaaaaccgcaaaattgtgcgccg

SEQ ID NO: 40130 - DNA, 824 bp, Heterodera glycines
ttctcttctctcctcactttgtcgcgtttcccccttttatttcttttctgctctcttactctctctcgcttgctctctctcttacaaaacaaaaaaacgaaaacaaaattgaataaacaacccttttttggctgtagtatgtgttacatcactttctttttctaacgctcttttttaattttatcttctttttattgaaaaacgaaacgccacacaaatttaacttgacaaaaaggggcggagcttcctctcacttaatataaagtaagggcttgaaaacactgtcgtgccaaaaaaagaatgctgcgttaaaaataattttaaaaaaacattgaacacaaattttggcaatcttttgttaattgaatacgaactaatttgtgcaaatagatttctgctgtaagactgaaaaagtcttggaacggtatttattgtgatgaacaattaaagcaacagacgattcgaaaacttccttattcatttttcttttcttggcttcctgttctaagcaaaatgttgtcgatgctgaacgatcgctttactccttctttggctcctccttctggcgtgacatccgccgatttttgctaaaacaattcgaatttggcaataagagaggaacagagcagacagaactccggtcccacctttttgagcggaacggcgacagaagatgaagtacccgtcggtgctttctaaaaataaattctaaaatttagagataaattgcaaattatttattgatccttcaaatattcgataatgaaagggacggaacagaatccagatccctatttcaacgaaaaacagtttagaatttttga

SEQ ID NO: 40131 - DNA, 1040 bp, Heterodera glycines
  misc_feature (865)..(865): n is a, c, g, or t
  misc_feature (888)..(888): n is a, c, g, or t
  misc_feature (920)..(920): n is a, c, g, or t
  misc_feature (930)..(930): n is a, c, g, or t
  misc_feature (987)..(987): n is a, c, g, or t
  misc_feature (1019)..(1019): n is a, c, g, or t
cccacccgtgttggttggcaccggcattgccgagagcattccgatgaagttgaacagaatgccaacagccaaagcgctaaggaagcacctttttaacacacgcttgatctgagagccataattatgctcaaagcatatgatacaaattcggtcaatggtcatgaaaaacacggacattgggatggttgagagcagcaaatgtgccgaaagcgctatgaagaaaagtgtggcaccatcgtaaagcacacctgaaaaagattttttgcacaaaacggtccagttacaaaaattgatcagttttaaaattggaaatgaaaaaaacacaatcaataaacaaatttttgttaaatttcataatgaatcggaaaaatgaaaaattttcaccctaatttgaggagttttattgcctaattgcacgcaaatgcgtagttttattgcctaattagcattttgccttttaatattttaatggttgattttggagactttgaatttaaacatatttcactgatcagtgatcaccttccgttgggtgccaaataatgattgcatgaatttcatatggtaacagcaaaagtgcggcacacaaccaattgatcaacaatgccatgaagaataacgaaatattcttgcgcacatttgagcgaaggagcagaaagatttgcacaattgcaaccgagtggaaaatgatggccaaaataaattcggccaaaacaaaataggaaccagacatttttaatgagtgcgctaaaatcagggataattaattaatgcatgaattaattaattaaaatggatattattatgactggacttttttaaagaaggcgataaaatcggggaccattaattaattattaattanaataatgaaaaaaattcaaattntgtgtcaataaaaatggtcaatatgtcattgngagcattacnattcttaaaatttttacatgtaatttaaagcgtaatttaaattgccaaataatgatncattaacttaaagcatagtacaattatgagcnaatgatatcaaaatgaatatt

SEQ ID NO: 40132 - DNA, 614 bp, Heterodera glycines
agtttggtgcgcttctgatcagtttctcattaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccctcccacgtccttcagagtacgacaaatatttccacaaaaatttggaaaaattgactacagcaatcgaacgctaacggacaacctaatggaaaaaaatccccgaaggaga

SEQ ID NO: 40133 - DNA, 878 bp, Heterodera glycines
gaagggagctgacagatagaccaaccaaagtggagctttcaagggattgagtgttttgttgaagcgagatgggggtgctgatgaggacgacgaagtcgtcaacactcagccacgtcctcccgcccctccccctccacctccaccaccacctcatcacccatctcaacaacaccaccgtcgccctcccagccttcccgatcagcaatcttcctcatctgacgatagtcatccgcctcgtcctcctcgtccaccacgtcctcagcgaacaaagaaaaaccatcaatcttctctgaaacatggtcgtttgaaccaatggcagcaaaggcgtcgtgacttacaacaacaacaaccggtagtacgtgatctcctcgctgaagcagcagctgctccgttacctgaaagtgacgatgaacaaatgctggaaggtgggtatctgctgccaacaccatcacaaaattatggagacataccagtattgcctgactatgcagatgaaattgaggaaatggacaccgcccaacaaagacttgcaagcagaagaaagttaaaagaggagcagagactagataaaaataaaaaatataaaatttactattcccctccaccatctcccacactaccacccgtgtacaaacgaccagatcatcctcctccacctcctccgcctcgttctatacccaaagttgaactgaaaagggatccacaaccaacaaagttgaaaaaatccgcctcgccaccgcctttaccattgcctccacatcgcgcaaagagagaaccaaaaatagagctcgcccctcctccacctcctcgcaatgtctccaaaagggaaccgaaaattgaactagctcctcctccccttcctcctcgtcacttcacca

SEQ ID NO: 40134 - DNA, 935 bp, Heterodera glycines
agaaaagcactgtttcctttcctccgggctggcattctctcgagataatctctcaagtggcgtgccggctgcttctgctgctccacgagaatgccctcctccggataaagaagcatcattccccaagcccttggctaatctttttgccctcaggcacaattttcgtgtttttgttgccatttgtcatcccctcgggggcctcttctgtcttagggcctccccggcggataaaggcggcccctccgccggcggtgccatcgacagcgggggattccgccaaagaaaggacggcacacacatgtcacattgatatactttgctcttttaaagccaacctcttctccagcattctttcgcttttccattaaatccgatttggaatgggtagagcggttccttttctgcttctctgcccattgacaccgcttttctctttattttaaattcaatttttctctaaccatctcgtaccttttgtactctctctcgctcttctctctgttctctctgtttcccttttctttccattcactttttcctcaaagtttctccttttttcccacaatctttcttttttctgccccatttttctctgctcgctcgtctctccctcactctctttctagctgttatttcgttgttttctctacgccttgctcgttcattctccataccgccatcacactctctccattattcccattctctgacctcatatgtcaaaaacacatccagaaaacagcccccccgggggccatcatcaaaaagggaaagaacggccaaacgaacttcaccaattcattctttcattcattcccccccccccgctctctctttctctctctctttctttttctctcttctcctctctctctctctgtctccctctcgttctctatctctcttctatctatgtgctctctctcttgtaaaat

SEQ ID NO: 40135 - DNA, 1086 bp, Heterodera glycines
taatcaaaaatgcaaaaacttggtggggaattgaactttggcaagccaatagatccacttttatcccactgggccatttgtcatcacaaccatttttgtttatttcctaaatttacataaatattttttccgacagttaacgcggcgtccgagcgtgtgatgaccagcagcagttgttggccgagtggtggacggactgacagcgggcgcgcattgtggaaaatggttaggcaaataaaacaattttatagagcgaggctataagaaatttacaacacccaaacgcgcgctaaaaatgggttaatcaaaagcaaattttgagcagattttatatgtggaatttgatggacggggggagattaacttcttttttcttgcaaattcttccattaaccacaaaaccaaatataattccgattgtggtaacaacaacaacaaattttttttccaacaaaaaaaacgaaacacaaatcaaaatgttttttttttaaaaacataatcaaatctctggccattttccggctcttcttccggctcttcttcctcctcttccccttcttcttctccttccccacttccctccgccgcgccgccatcatcctcttccgcctcttcctcttccgcctcttccccctcttcctcttcatcccctggctgctcatcagccttttcatactcgtacaaggcgtcctctgggtggtttaattcccagagtgagttgccgagcacccttaaccaaaaatagatataacaatatcgtaaaaaaatttttttcaaaatttttggaaattcggcattttagaaataaaacttctcattcgaaaagaaaattatttttcgattaggctattacagctatgatgtttcgcctgtggcattttgtcctgcttccgggacaacccctctcctgtccgtgtgacggacagccttttttcggcctcattttttccacattccaaatttacatagaatttagcgggatttaaacagaaatgaacaaaccttctgaggtcacgcggccggatggtgttcttctccaccgggtaggcacagagctgaattttaagccattataaattaaatgct

SEQ ID NO: 40136 - DNA, 1120 bp, Heterodera glycines
ggtccaggaccaggctttttttcagcaacctggattttcctggatttttgtccaggaaatccaggtcaggctttttttaaaatactgagctctaattattatgaataaaatttaaatgtatttagaagagggatgagaagccttgggataataaaaaaagtatgaaaattggtaagatccaaataccttaaaaaaagaaaataaaaaatccaaactttttaaaatataggaaaaaaagagaaattggtcattaaaatgcagcatttctgaaaacttagcacacaaaaattgatctttagctattttaggcacatttttttttaaaacaaattttaccctaatttgcagaaaatgataacgaaaaatgtcgtttttgtagatctgtttttgaaaattttaagaaagccaacccggaacgagaatggctctcgagcctgagatgataaaatgccgagaatttctcgactcaaaaaccgagaatctcacccatcatcatattaagctccccttcattttaaattataaatttattaaaatatttgaaaattctatcttcatgtaatctgattggaataaagacttcaacggattgtcatcttatttagcaaaatatttttgttcactaaaaattattattgtgcatctatatgtactaattacgaatatctaccaattaacacaaaaattacttccttccccgttcaaatcttttttttttgttgccaaatttggtcaggcaaacaaaaattcaaatataaaatgccttttatggggataactatttttaaaaaaccaattaacatcgcactaaattctgtactttaggcctatttggccaaattcggcacaaaaatttctcaaaaatttaaaaattaaaaagaaaaaacaaaaaaatccaaattttctactagattttataaaaatgtcaaaataactttttaattaaaatcactctccccgctcaaatttcttttctttttttgccccaaattgccagaggcaaacacatacattcacacacaaaatgccttttgtggagggattttgcctgccacgggggaagggattaagccgtaaacttttcgttgaagccaacaacatattgcgcgaaaatgccatt

SEQ ID NO: 40137 - DNA, 1105 bp, Heterodera glycines
agctgcggaaattgtggaattattcctaagaaaaatgggccatctttttttaggccaattttttatctcgtaccccgaagcaaatcctttccccagagcctcttcaaaattttttccattccgcacagagctgcgggaaattgtgatttaattctcaagaaaaatggctatctctttttgggacaatattctatctcgtaacccccgatgctaatccgttccgcggagcctcttcaaaattttttccattaccgcaagagctgcggaaattgtgaattaattctcagaaaaatggccatctctttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccacaagagctgcggaaattgtgaattaattctcagaaaaatggccatctctttttaggacaatattctatctcgtaaccccgatgctaatctgttccgcagaacctcttcaaaattttttccattaccgcaagagctgcggaaattgtgaattaattctcagaaaaatggctatctctttttaggacaatattctatctcgtaaccccgatgctaatc

SEQ ID NO: 40138 - DNA, 839 bp, Heterodera glycines
cccccattccactaattctcatttattcgttctttgactccctagaactatcgcaaatgtatcacttaggcgggcacgccatgccattctctcggtggaaagggattgttggttggttagcattgcttcttttgcctttgcctgtcatctgctgactgacttcgtcttttctcttatgctattggtgcggtaaaaggaaagaaaagtggcgctaaatataatttggcggtctcggcacaaagtgtagcgatgaattgtatcgattttaaatttgacacttcaaataaacccctttttgtgctttttgtcgttcggttccattttaaggcttttgtccattcctttggatatgttgtcattttgttctttcgtctttctcccaatccacccacaattgccttggttctgacagcctttgtgttttgtgtggttacccctccccgcgaggagtgcccgtttcttcgcctctggcaagcttcgtctgtccgtgttaggcacacacttccagcatcagctgctccccttccttccattgggcacatttcccttcccagtgcctgccacggccatccctcccccctttttgcattttccctcatttatatttgtattcgttccttttctcaggctaagaagacaccacattaataaatggaatacccccccctggtaactgattagagacgagtgaaaacagtctgaattgaagtttcgacttatgattttgaatccgtgtttgggctaagaattgacaaaattccgttccaccgtgagtcattgggtgggggggggatgggaagcagtgagatagactaattttaaatgggaaaagacgacca

SEQ ID NO: 40139 - DNA, 1144 bp, Heterodera glycines
  misc_feature (1087)..(1087): n is a, c, g, or t
ttatcaaaaaaaggagatagccatttttctgggataacctataaaatataaaatccttctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataaactataaatataaaaattctctcaaaaataaaatggcgattgcgcaccgccctccctatcatacgcaagcgcatttgtgaggtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacgtctaaatataaaaatcctctgtgaaataaaatggncgattgtgcacagccctccgtctcatactcaagcgcttttgtgaggtataaaatttc

SEQ ID NO: 40140 - DNA, 1244 bp, Heterodera glycines
  misc_feature (1127)..(1127): n is a, c, g, or t
tgaaaatttccatttgatggtttttatataacgaacccctccattgatatatatattttagccattttcggctctgggctatatggtcaatattttccaaagagagagttaagagagagagagagaaggaaagaaatagtgggggagaaagagagagaaaaggagagagagagaaagaaagagaaaagaaaaaatggcaaaagtgagagagataggggaaagtaggcacagatctaaagaaagagagaagcaagcacgagattgagagagagagatagagaagtacatttgaaaaaagacctagagaaagagagatagcgaaaataacagcaaaacacacacacgcactcactttttggctttgttggccaaattcgccctccttggtgatataggtagggctcaacatgatggtgttcggcgacagcacaggccgtttgaacggtgccgtcggcggtgcggaggaagaagcgccctacgggggcaacaaaatatttctctgatatgcttttgatcaatggtgatgtgatcagtgatcgatcgctcagccccttttcgtttttggattttttaagtatttgaaacttaaaacttcgaggcgctggttaaaaagtggcgctctttgaattttattaaaaaccccaattttgaacaatgagagagagcgacagagagagagaggggggacagagagagagcgagagaaaaaaaatcgagcggtagagaatagtagaaacgaaaacagaaaggagagagttttgagagagagaatatgaaacgacagagagagagagagagggagagaaacagagatgcaagagtcttctatcacttagaaaaatttaagaaaatttcgttaatgttcaaaaaaagtatggccagaaaaattaataaaacagatttttaatcattttttgccataagaatcttaacgcaaatttttcatgtttttgtaggataatagacaggcctggtatatttgagggtaatcctcattttgtgattttttgataggtcaatgaggttaaattttcaaaatgagtctttttgtggttttttgagaaattttgaggctttttgtggttttttgagataattttgagggttttgctgggaaaacttcatcnagattttttaaattgtgaataattttcattagtaggcataatgtttgacaattatataattagaattttgttttttaataggtaaatctatcacacggaaatcttacctcatattta

SEQ ID NO: 40141 - DNA, 714 bp, Heterodera glycines
  misc_feature (666)..(666): n is a, c, g, or t
ctctgttcctagttttttgaaaaatcgcaccgaaaaaagcggttttgaaaagcaataaatagtcaaatttatgacgattatcagtttttgtttatattaattgtagtatttttttggcttaatttattaattcgtttcaaaatatttttagatgatattaatttgaaaaacccaaaaaattattaaataaattgcttttgtttgaaaattattttgtctctgtggctctcacaaaatataaagttgtaaatatattatgcttttataattttatactcttgaacccaatatataatattttatttctttaatcttgattgtttttatgttgtattaatttttcattttaactctcataattatttattaatttaattaatgcatttaattaccatcatcctcatcccccgtcatattgctagattataaaattaaataaaattgaataaattttattattcttcccccataaagcaaattaagtgaaaactgctttaaaggtttaatttttagcattttttatagtttattttttattaaattattttggtttcccatattggacaaattttattaatgttgaaatttgtttacaataagtagttgaatattttattaatctgaagagacttttcccagtattttttaatcctttttttccaaggnttaaattaattgtaaattccctaatattcttttcccgggttaaaacca

SEQ ID NO: 40142 - DNA, 530 bp, Heterodera glycines
aattcgaatttttccagaaattctggaataacttttttccttttttagatagaaattccaaataaagtccataaaattctcctgatttttctctatttttaaggctttattcctgtaaaattgatcaacccttcgatttgttatgaattttcaaatattaggccaaaatcccgagggccaaaaaattgccaaatattttcgaatttttaaaaaattccaaaaattctgaaacttaaaatagacatcatattcgtactcagcaccttaaaaatacccagaaaaaaatttttcaccctctttttcaacccaaaaaaaatttccgaaaatttctagggggcctagctcgaaaatttttgaaaaatttccggccatataatacactattcgatagcctttttaaaagctctacaattttgctctaaggcaatttttggctaaaaacgatccctgacgagttataggcccgggactcaaatgtcccgctcaggccaaaaaatttttctatttccgggaaaaaatcgaaatttttc

SEQ ID NO: 40143 - DNA, 810 bp, Heterodera glycines
  misc_feature (759)..(759): n is a, c, g, or t
ttttacttaaactgtgtgagcttaagaaacttttcgtaatttctgttgaatttatttatgtttaagataatttttatgtttattttatactaatattttggtaaatattatttgtaacattagaaaataataattgttgcacttttgacgatccttaagaaaggagagtcaataaataatcgaaatttaattgttgagttcaaaataggattctgctggagggttttccgtggcgtgttcaccaatttgaatcttttttgaataaaaaagcaaaaaaatggtcaaaattaggcaatgtttaaatgggagaagccaagttgaatttggaaaggaccaaaagagtgccaaaaaagaaggccaaaaagacgggatgggaaaatatgaataaaatagtccatagccaaagcaataaaacactttttatagcttattttaggtgaaaaagataaaaataaaaataatttcggcaggcaaagcatttaaaccggtttcaacactttggcgtgagctttattggctttctgcattgtattcgaaccaaatataaaacctataaaattgattttgagttgggccattacgaaggaatcaattttccatttggttcaccccaagtctttttgtaatttgtttctcccatttaaaatgtcaaaaattttgtccatcgatacataaataatttaaaaaattattggtcgtaaaatatgcacgaacagagagggaaaaggaaaaacggtgaataaatagaatgaatgagantatttatctgtaaggggagcggtggacagcacaattagggggggggggggg

SEQ ID NO: 40144 - DNA, 1114 bp, Heterodera glycines
  misc_feature (98)..(98): n is a, c, g, or t
gggagtatccctgcaaagtttggtacgcttctgcctcccataggaaaaatatgagtgatcgaattttcactaaaaaacttaagcctacattttttggnatatttaaaaaggaattaaaaaattttttaaatttaataattttcctgcaccgaaggtactcactcggcctcttcgcggcctcgtggtgggccttcgccccccccacaccccacattataaaattcagatttcaccgctttatccccaaattcaaccactgttgcgtgctggctttttccttcgcaccataaaagaagacaatttttggatgtccatgaactacggtaatgagacacggttggccttacacttcagttgggtgaataatcgcactttggtcgacccagttcttgaacaaattgaagaggtgaattttatggaaaaaaacaaatcctaattaggtgggtttgattaagttaattaggggaataattagcaaaattaaatgattaaatagggataggtggtgaaagagttaattggcagtttttttgtaaataaaataagaatttgagtgatttccgtcaaacacccgtataattgaattttaaatattctaacaattatttatgtttttttagattaaaaagatgagttctcgaatatttttttcttaaataaattttaatttttcgcaccaattatgcattttaatttcaatcatcagaaactgctcaaatttgatgtccgtccgcattgggccaagtattatctgatgaaaccttgccaatttctgcccaattatcctcgccttgaggaatttaggtaaaaaataaaataatgcatgctaattacttttatatataaatgttaaaattgtaataattgttaattagccactgtgcataagaaaattatttgcagacaattggcagaagcaatggacccagcgcataagtttcgaaacaaattcataaaagaaaatgtttttaatgagatataagaaatggaaatgtaccaataaaatgatttgaaattaattattaaaataatcattacaattaattacttattcatttatatgaatgtgcgaagagattaacaaatacattttataaatatgagaatacattaa

SEQ ID NO: 40145 - DNA, 87 bp, Heterodera glycines
ggcgaggcctggatcgagaccacgtccggcgcgatctttcgcgaggcggcgcccgagctcaccgagaccgcgctcggccggctggcg

SEQ ID NO: 40146 - DNA, 1280 bp, Heterodera glycines
  misc_feature (1216)..(1216): n is a, c, g, or t
cgaaaaattataaacgtaaacttataaaacaaatcggcaaaaaatgccgaagaaagagataattgaattttgctgacaaatgaggtaagcgaaaaaagcaatgtaaaacaatgaattttgttgcatatatttctttgttactcgctaaaaataaaatttctttcattgtattaaacaataaattttttgtcattctttattccactgcacattttagttggaaaaattaaaagaacataaaaaaaaatttcttttgcaaatttattaaaatttaaataataaattaaagttttaatttttgcacaatcaataaaatattggataatgaatgattattaataattatccataaaaccattgaggtagaattattttagctattttcctataattctcttctttttcacgcaatgcttccaataaaattttgctttttcaaattatttctttattggcaatttacgctgattctgagccagcaaatttcgtccaaaaaagaatgccgagaatttgaacagaatttattggtattgtttggaggaaataaagcattttctggtgccattgaatttgaaccccttgaaaaatggaccaaagaatgtttcgctgattggttttgtgaaaaaatcaaaacaaaatttgaaaaaagtgctcaaattaatggcgaaattgaggaaaaaatgtcaaaaatgcaagccaaattttgtgaagaaaatgaaaaaggaaaaagcattgaaaaagcgatgaaaagcgttgaaaaagaaacggaagaaataatccaaaatatgaaaatcgaccaaaaaatgcaagaaaaaatgcgaaaaattatggaagatggcataaataaaaatgcattaatcggagagaaattgaaaaaaataatggaccatttcaaaattcaatcattttcggatttgataaatggtaaaagcattagttttggatttattaaccttcaaattcaggggtatttcaaattttgttcggtgaaacggaaaaaatcaaacgcagtcattgataaagcacaaaaggtacagaatttgtgggttttgtgattgattcttgaacagaaatcacaaatcaccttttatttcggggtttttgtgcctaatgtgcctatttcgccatttttggcccttttttcaggattttcagaaaaatccttaaacaaaaatgcaataaaaaagaaaaatacaccccttcgaatcgaccctanaaaattcagaaaatacacccctacgaattgaaaaactttcccaaaaattaacccccaaatttaa

SEQ ID NO: 40147 - DNA, 843 bp, Heterodera glycines
tggatatgagttagaaaagaaagagaaataatttcggacatcttgagaagagctgcattgaatgcttcagtctccgctgctgtacgcccacgcgttgttgagttagggtcgagatcgtcatgaacaaatacaacaaggaggaaaatgaaacaattcggtgctttgccctagggttggagaaagcaatgcgcagaatagctggggagacttagggttagcgcatcaattatttttctcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacgcgttgctgagttagggtcgagatcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaactccgcttggagatgcgttagaaaagaaagaaaaatatgttcggacagcatttgaagagctgcattgaatgctgcagtcgccgctgctgtacgcccacccgttgctgagttagggtcgagagcggcatgaaaaaagacaaaaaggagggaaaatgaaacaaattcgcggctttgcccctcgcgttggagaaagcaatgcgcagaataactggggagacttagggttacgcatcaattatttttttcaaatgtgatcgggggacaaaa

SEQ ID NO: 40148 - DNA, 1219 bp, Heterodera glycines
tcagcagcagcaacagggcggcattcatgtacgggctggagtgatcagggataaatgataaaatgataaatgattgaaaagagccaggggatatgagtgcaaaatgatcagagattggattaaagacgataggtagggggtgataagaagataagtgatcggaaaaagtgaaaggaacagggggtgacaaattaatcattgattggattaacggataagcagggggtgataaaataaatgatcagataaagataatcatgattggacaaaactgggaccaatggtttaccgtgatcgaataaaaaaaatatgagtgattggcgatgggtgttaagctaatgagtttcagacaacagcaatacatgcaatgattcgaccgatcaaaattttatgaaattgatcactgccgatttaaatgtgattttctattcagagaaagccctctggcgcttccatcggtctattggcaccaccaacagaattgcaattcatttcattgtttggttatctgcaaattcaatgtcgcccgcccatacatcgcaaatcgcttgaaggcattaaaaaattaaatttaattgaaatttcactcccagcggggcggctaattaggaaaatttggaaatgaagtgcaaaaaaaaattcttgaatcggagtttttttctaaagaacggcttgtgaaaaaactaaattcacgggtccactaagtttccttctatggattttttaaaaagcccaaatttttagttttataactttcttagaggtttttttaaattttttacaaatatttcaaagaaattttccgtttttattttactaaaataaaactctatgaaagtaagaaaatgaaaattttctttttttaaacatattttcagggaagggggaagcgtagggaacgaactgctccaccaattacccaaactctgtttgtcataatcgttctgagtcgatccacaaaaaaaactcagtgattgataaaataattaaatttaattatataaatcgatgtcaatgaatttaattatacgattaaaatttaaacataaattaaaaaagaaaatataaatttcaccatttaaaatgcttccgaaataaataaatggatgaatgaatttgacgcattgcttgctgcttcaaaacttagaatttcaagccattctattgttattttattcttttttcaattttagtatgaaatttcatgccgttaattttt

SEQ ID NO: 40149 - DNA, 1237 bp, Heterodera glycines
tatatctttgtgatttttggaaagacaatagagttttttaagagcattcgaatgataccaattttattgaatttggtcaacaaagaaaaaagttatgatgctctaaacttggctcacacggaactgactcgcttcgctacagtatccatgctcgcttcgctacagtatccatgctcgcttcgttacagtacccatgtgtaaattttttttctttttttgcagataatgttcgtgctgcattggtccacttcgttggtcacatttttcgtgttcattgtgctcttcgtgttcatcaagcacaacaaatcgcacatcaattggggcacgtccaccgaggcaaaccgttaccggcgcgcactgaactcgttgctgaaaatttcgcgcacggaggaccatgtgaaaaactacaggccccagttgttggtgctgagcgggaacccggtggcccgtcaggtgattagcatttcgaaggacagacagaccaactgctgattttcaaggacaagggcggggagggggatgttcaggaaattaaggaaaatgatatacggacaatttgtgcaaaatattgggtccccccaaataatgaaaatgtaacaattattagggggtataattaagagaataataaattagtcgcaaattattaattggaccaattcagaaagcttaattattagtatgggaataaattgcccggtgggtgggactcaaatataaggaaggcctcaaaagaatggttgttacagggagtgtgcgactccctcaaaaaaatttcggaaatcggaattccggcggctaaaatttcgtccatcgtatatcggaattccgagcccaaaattcggaaattggcaatcggaaatccgcaccctacacatccctgctgtcttaattgttttttcaaaattcacctcaggcacttgtcgactttgcctactgtatctcaaacggtagaagcttgcttctgtgtgggtgggtttaatatctttgtatgctttaaaagcaccaattttattgtatgaataaattaatcatttattacacagacacattgtgccacattgctcatcagttcaagcaacggcgctaattcgaacccttaacaatcagtcagtaggcaaaaatcacaataaaaatgtttgcaccgtaatcggcaatctttcggaattgcggtcccgaattttttttttttttttaattggtaatgcactttttctaggcttaaaaaatacgctaa

SEQ ID NO: 40150 - DNA, 1314 bp, Heterodera glycines
  misc_feature (395)..(395): n is a, c, g, or t
  misc_feature (1293)..(1293): n is a, c, g, or t
  misc_feature (1309)..(1309): n is a, c, g, or t
caattactgagcggaatttgggggagggggcagcaactaacgccgttttcaactgcgtagaagaaaggatgaaaagtggtagcgtaggggaatttgaaattgaatatgaaaaagctgaaataacggatgcggaagggggaggtgaggggacgaggggtgggggaatttggggccaaatttggggggaatttggtgcggaataaggtgccttacactactaaggcacaacaaatcaaaaacggatgaacaaaaaaatgaaaagcattatagacacaaaaaatgaattaagggcttaaatctttttcgtgtggcctgtaaaatccgtcactacaaaccaattttccaaattgcagtcactttcatagactgtaatttaaatgaaaatatgaagaaanagtaaacatttaaataaaaacagcacctaaaaggtcgccattttgttagcacacactaattatgcgaataaattccttttttatgtttgtgactaggcactttcaacccttatctagacctatctatgccttctccaaatgaacatctcgcatatttgcattaattcttatctcgaatctgttcacttaaatgggttctatgggaagggtggtcctttgattataaacaaaaaatggcccttgtccgattcgaagaggcaaaaacgaacagaggaaaaattctgctttcccgtcttggatttgaatattgcttcgaaaattaatcccgaatcgaagaaggctatgagtattggaaatgtcccaagcgtcccacatattgttctggccgggcatgtgttcagcttcagtggcaagttgataacaatggaacccgttataaaatggggcgcgtaactgccgaaaacaatcttcccgcaactttcggacagcataccgtaagcaacaaaattcgctaatacctttcggtgtagataagacaggcaaatgagcaaattcgagaagaagctgtttcgatgatcggcgaaaaaactactgcgatcgttaaaccggaccaatattcttgtttaatgttaaaacattatttaggccgttaaccaaataggcccgtaaaaacttttagaaggagcataaagaaaaattttagtaattgttttcaaaatttacaactcaagaagaaaaaatagtaatacgattaaaaaatagttaactgttgaattttttctttcggagagagtgttgaggaaaattccctccctttggtaactggtataaaccaagatattttttattgtttgttgttgttgaataaataatgaaaagtttgacccagttttccctnttttaaccaaatttgngtaaa

SEQ ID NO: 40151 - DNA, 1482 bp, Heterodera glycines
agagaatgtaaataataaatgattattttttaatgaacttccttaaaaagaaataattttaaaaaaataaaagatttttgcgggtgcgacatttgacaccggcacttcgctccaaatattacctcataatcggcatagttatcgacaattgtaacctctaatttttgctaatatttctcttttaaattcatacatttgtatgaatcacaaattatttgtttttttaataaaattttgaatattttgttttgcgttctgcttaagcactagagcaaacaaaactttgtcagatttaattctataaacccctggaaatactacaaaaaatacagtgcgccatatttcttgttacaatatgtaatggcatttggagtatagcgattcacccaaaaggttatcggcagaaacgtcgctgaaaggttttttggaccataaaaacaaattaagaattcttggtaagtagctctttaaaattctgtcaaatctcaatatttcgtcaagtttcgaaaaagttatgacaagaaggcaccaacactctattatcacttactttttggaaattttttggcgcagtaattagcattagtaaaaacgtatattaaataaattttaattttataaataaattttttttcatttaattattttactgaacaaaattaacaattgcagaaaaaatggaaaaaatgaagcaatatgggcagaagaaaaagaattcctatgttttccgataggaaattgctgaaatttgaaaatctcaacagccttgttagccagcttttaatttttatttaaagaatttttgaattattttttggacatattcgctgtaaattttttagtcttttgtcatttttgttcttcacgaattttcttgttgaaaacctgggaaaaaacggaactagtcccgataccggtcaaaacttgtcaaaaacgggacttttaatttgacgcatttttgaacaaaactttagttaacttgtaacttttacatttccatcagagattcgctattattcattttaaatagggtacttccccgaacattttgtggtaatgagtttttcctattcagtgattatttgtttaaattgaatttttttcattaatgactggtgcatttatgctgtttatatttactcaacttgtgatcggataaattccatacgtaaacttattttttttcaaaaataaattttcccatccatcaaaattgggtgaaaaatgttcaatgttgaagcaataaataataaaatgaaatatgacaaattgaatgaaaaaacttagtcccaagcaggccaaaatactttggagttattattataaaaaataaaaaataataattgagtaattaaactaaataaaaccaaaaaattcttacatagacaaattatatttttcaattttttactcgaatgccaaccgagaaaattttgcctatatttttgcagttttaacgttaaacacatggctccataaaaa

SEQ ID NO: 40152 - DNA, 1031 bp, Heterodera glycines
agaattcaataaaaataacattcacggtgcgaaaaatcggttttgacaagtttattgggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataataccccctgggagaaaggagtggggaaacatgatttcaaaatttttcattttttctagtctaatctactcaaaacgggttcagaaatccaataaaaaataacaattccccggtgccgagaaatggggggtttgaaaagtttattgggggaaaaaa

SEQ ID NO: 40153 - DNA, 1262 bp, Heterodera glycines
  misc_feature (13)..(13): n is a, c, g, or t
tttgaacaaaatnttggcaaaaaattgtcgtttttggtcacattaaacacttccttgggcaatgcctcggcccttttgttcattgaaacgcgaaaaatgtgctaaatttttttgaaattttgtggaaaaattgttcatatatgttgaaatttttgaatatttaatttccggcataaaaaagcattatttacgttttttccccaaattgtcaactaaatgcgctatcaatggcttgcaaataaattgagcaactaagattttttttcaaaataatttcgtaaaaaatttttatcttttttcttaaatcaaaaattttctcacttccccaaattttatagttcatcaacttttgattaatcatttgatttaccaagtcgtggcctgccccgaccaaagtgtccgcaattgagcccataaattgcatgtgactccatccaattgtgggcgaatagacgaggattttaagacgctttttggccaaacttttttgaggcgcttcttccaatggatttgttgaagccaaaagtgtaatttgacaaatcaaaattaatgcgcacaactttgtcagaagcgttggcattttgcaaaaaaaaaaatattattgtaatattttaattttgggaatttcacacttatttttgaggaacaaatgaatgttgaaagaataaaaatgaattcaaataaagtgatttcttcatatcgataagataaaatagaaaaaaaagtagaacaacggaattaataaaatgaaattaatttattttaaaattttcattaatgaaataaacaaatgctgaaaaatgaataaacgacgaagtgttttcaatttagtattatcagtctcaaaagtaagttatagtttcagattttttttaataggaattcaaactacagaacacaaacatgtgattaattgtttgaaaatttcgggaaggaatgcatgtgactttgttttggatttgataatcctctttttctgatttatattattttattttaattattttttaatttttactgatataatattttaaaaatttattattaatatatttttaactttttgttgacttcacacgattacgataaatgccgaaagccgatcgttagggggtgtaaaaaattatcggtctcgaatctcggcgagtctcgaagaccgagacccgaaaaaagcccgagacttttctcgagacggagacactcgagcaccaaactgaaaaggattcggcggatgggcaacacgacagaaaaataaataaaat

SEQ ID NO: 40154 - DNA, 666 bp, Heterodera glycines
caaattaaattttaatattataatgattttttataaattattaaaataatttaatgatatttccgaaattaaacactactcataccgttttttttaatttgttagggtactttctaaatcaattatatcgaattcaattactatcgaaatcacgcagaccgagagaaaattaaaatataaatcatttaaatttgatttgttgtgtccggattcgggattcgaaatagatcaaaatggatgcaggattatgatcattgatcaacgccccctgaaaacctataaatccgtttcttctgaacaattgaaattaaaattttgtggggcttttccgtaattgaaatccacagttacgtcagccctcgaactcacacatatcctccttctccttcagcagaaatctttctaattaagcttctcgccgattatgcattgtgcgcccggggaaggactcgccagaaaaggtcaccaaaaatcacaaattgccaactatcaatgatttaaaaaatagaatgtcattagcgctctcatcaaactcataagcataacttaacaagcttactccgtctccacccgttctcacaaataaaaaaggatcgatttccacgtggatttttaatttgcattgttttgcttttaatgctaggaagtttctgctgcaataaaaaa

SEQ ID NO: 40155 - DNA, 1335 bp, Heterodera glycines
aaaaataaataaaaatttctaaaaatttgatcgtccatactcctttgtaattgatcaggggctcaccaaattttgcaggaatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaattttattcatctccctttttgatagaaaaagcatcagagtgcctaaactaacatgtaaataaaatttggtgcgtttcagaaccctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttt

SEQ ID NO: 40156 - DNA, 609 bp, Heterodera glycines
agcaatcattcaaaggccattttgtagagaattttgtgctctttctctataaaaataaagtttccaacgcaattaattcttcttccctttgtgacgacatcattcggaactcggccaaattgtgctaattgctgccaaaaatgaaccgacggtaatgaattttaaaagtcacaaattcgtcgtttatttgactaaactgttttcccatttcagttggatttgcaacgacgtttggatggacattttcccctcttttgaccgtcctcaactcggcctcaaattggcacttctttcgccacgttttaattcgctggtggacaaatattttgatggcaaaagcgaattgccaatttggagacaaatcgtaattcgtcgcaagggcattggaccagaaatgaaactttatgtagagatggattacgaatttgtgccatttccattgcccgaccgtccgttgcccagcaaaatccgttttgaatggcttcagattgagtaattaaaaaacagttttatggcaataaaagcatttatttcattttcagttacattgatcactccgtcatcgcttttcttcgttcaaatcaccaaatttttgacaaaagagacacc

SEQ ID NO: 40157 - DNA, 956 bp, Heterodera glycines
  misc_feature (933)..(933): n is a, c, g, or t
ccattgtcacaatttccccccattgtatttctcacacatcccacatgtatgggtttaattacccaagtttgagataaaacttgcggagtaatttggtgcaaattcttgggcggcaaatttgggcaattggcggcagcgaaaaacggacaaatcggcgcagacccctcccccatctgcgtcaagtggcgacctgggcatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgttcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaatttcgaatcgcttttaaatcgtctcttttgcgtcccttaatctcactctgagccgagntactgcggtctaaacacgttttt

SEQ ID NO: 40158 - DNA, 918 bp, Heterodera glycines
  misc_feature (50)..(50): n is a, c, g, or t
ctgaccaatttggccatatatcagttgctgtatgcattcttaccaatttntggggtattttaaattaattttaattttaaatttttcaaatttcttaaggcccccaattcgagcttggcaagttggttttatttctggcattctgttaaacgctgctgcgggatcaaatgcgattgttctttattttaacaggtcattatcattatcggattattattattttttttcatttaattaattttaatttattactttattaataattaacttttagcactgaatatcgccgcgtgttcaaaaaagaatttcgcattttattcaatcgtttttgcaacacaaatggtcatttttaataaataaaattttataaaaatattaatctatttgtatttaacttttggaaaataaaacagtttttaaatatttttaaacaaattttaaattaaaaattttttagctgtccaaactattgacacaatccaagtgcgaagtgccaacacaaacaacaacatgaacaacatccgatcaagccaacagatgaatgtgcattcgatcaatttgaatcgctattgaaatggacttatatatttttttattttcttttatcgttttttttttaaaaaataaaattttttattacgatttggcattatgaaaaaattaataaatttgtttgctagctgtttaatgatgtcaagaatttggcacagtttctattttgttccaaatttggcgttgacagtttctcatttcattttagtttttttcattttcttttttgtatagtttttccaattatttttccattttccaatgaaaatgaaaataaaatcctttctgaatgattctgcagaatggtagatgatgcagaccaatgaattccgactttaattagtcattagcagatttataaatcaa

SEQ ID NO: 40159 - DNA, 1017 bp, Heterodera glycines
  misc_feature (829)..(829): n is a, c, g, or t
  misc_feature (880)..(880): n is a, c, g, or t
tcccatatgaaccaagacataaaaagtgcttttgcgcccttcttcccctctggtgtccttcattttagaaaggcactgaaccgtatacaaaaactctcacattctaaaataactcagttaaaacagcttttaattttaattgttctgaaaccaataattttgtctgtaaaaaatagtctcatatgaaccaacacataaaaagtgcctttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcctttgcgcaacaatctcccctctggggtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcttttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcttttgcgcaacaatctcccctctggtgtccttcattttagaaaggcactgaaccgtatacaaaaactctcacattctaaaataactcagttanaacagcttttaattttaattgttctgaaaccaataattttatctgtagaanatagtcccatatgaaccaagacataaaaagtgcttttgcgcacaatctcccctctggtgtcctcattttagaaagcactgaccgtatacagaactctcacatgctacataactcagctaaacagcttttaattttaa

SEQ ID NO: 40160 - DNA, 981 bp, Heterodera glycines
  misc_feature (876)..(876): n is a, c, g, or t
  misc_feature (880)..(880): n is a, c, g, or t
ggcctttttgatgtcctggaagagcaaagagtgaacatgagaaaatggtagattttggtttactgggaagatgcgctcatcgtacacagagtgagcggcatttgacagtgtgaaaggctcctcaatgcaaatgcaatgccattgggacaacgtgttgaagggcgactggaaatttatcaggcacattcgaccaaccccaacacactgacaaatgagaaaataaaaaccaacttgattttgtgccacctgtgccctgttgacctttttgcccattcgaatgcttatcgcgtccgcgtcaaagctaaaagaatggacagtaataacacactattgaatgagttgttaacaattgagggtgggtgatggggaaaacggggactgaaccgggcgctaaaattcatcaacggcacaaatatccgcaataaagccctaagtttcccgaggagttcccccttcgtgtaatcagtcccactcgaattggaaggcgtagtaacggaggaagccgagcagcaactcgctgagcgtcgcgtcgtccttgaactgccagcccatcgcggttggaattggctcgaacggcaacgacacgttcagcgtgcgcacatccgcacgtacgctgaaccgtttcgggtacatttgctgcagattgggcagcaccggtggctgtgcaccgcactgcaaatagtggatgaccatcagcaccagcgagtacgatgtgaaggaggagcaggccgagtcgttgatgccgtgacgctttgcccactctttgaccaccatcaccaacggtcggacacgccagtcaactgcggagaatggaaggatgaacaaacaaacaaaaaaaccatagggtctgtccgaggcaaccgaattttggacaancaanaaagcaatttttatgggttttccaaaacaggcctctcggggatgacaaaaagccgtttaatgaagaacactcacaagagctgtagtacacatcaaatgcgt

SEQ ID NO: 40161 - DNA, 579 bp, Heterodera glycines
taattcattaccagggctgcaaaaaatatgcaaatgcatatttttttcctggcttctccatgctctaaatagcaggaaaaacactttcttttttgtgtttgcgtataaaaatcggcgacttttatttgcatatttcgaggtttttgtgcatatttgcatattttggctttttctgcatatttcgtgcatattttgccattttttgtgcatatattccgattttttgcatattttgccattttcggtatattttttccgatttttaatatctctcaggaaaacatttgcttatgcctaaaattaaatcaaactctgcatggatgcgcgagtggatcaataggatgagctttactgccgaaaatcttgaaaaatttttgatctgaaattgcaaaaataaccgataaaatttatgctgaagaaacttttttttttaaattattttgcacccctaattttcaagtttttttgtgcatatttgatgcatattttgcgatttttgtgcatatttcacgattttatttgcatatttatgtgcatattttggccatttttcgtgcatattttttgcagccctgttaa

SEQ ID NO: 40162 - DNA, 878 bp, Heterodera glycines
  misc_feature (870)..(870): n is a, c, g, or t
ttctttttgaattaactataattttttaactttgtttctttgttatctcattagtttaatataaaattgctatgacgaaataaataaaatatgataacttcacaattataagaaaaaataaataaaattcttaatgataatcttatattaaattaaaagtgtttgattttattttttttaatataatttttattattcttaaataaaagaaataaataactttcaaaaaaatatggatattatattctttttatttataataatctcgtcggttattcctctttgtgcaagtttctgtcaaacaaatttttactttaaaaaataatgattaaatacactatacaaaaccaaaagcataattaattattatggcatttttaataatgtaatatttattatttcaggtttattttttatctagagtcgacaattaattctttttacttttactctcgtggcgtaaaaacggaaacagtcttggtttcgacctgttaatattcaataaattttttaattaataattcttattggcaaaaatttgttgtgaaaatcgttcaaaaaaaaataattcgtataaagttttaaatatatcatatcaaacgaacattagaatatttcatggttaatatttgaacaccaatcttgtataatttaatttaatgttgttatgattatgcaatcagattatattgaagataataaaatattaatttttacaattaatttaaaagcttttttattatttaccttaaattgattgaaatgatttattttattgatatttgattatttttccagtggatttattttataacgtaatgattatttaatgtggtcgagaataacttaacatttagggcttttcattanattctcaa

SEQ ID NO: 40163 - DNA, 846 bp, Heterodera glycines
  misc_feature (788)..(788): n is a, c, g, or t
tccagggatggtgatgtgcctgctctcctacggtgccggactcgacgagcaggctgacgacagtgacaaaatgacggcactgcattttgcggtgtccaggcgcaacctgcagatcacacgcttgctgctctgcctgggcgccgacccgaacgtggccaatgcgcacggggacacgccacggcatttggccgccaaattgaacgagtaaatttttttttttttggggcggggaggttaataattcatttttgggcctaaattttcggtacttcgtgtttggctacccctccccctcgagggcgggtagcaaacaaaggagtatcaaatttttattattcctcacccaaataaaggaccccaaaagtccaactctcgtttttgtcctcttaaatatgtcaaaatttttcagggttgatttgctgaaaagtctgatcatatgcgatgctcggcgttgtccactcaccaaggtaacaagcacagattttgctatatatataaaaaaaaaatttttttttctttgccttccaaaaattttttcatggtttcaaattgggtaaacacatccatctctcacgttttgtgaatccacaaatacgcatttttgtgttacaaaaattcgcttttttcccgtattttaggttggctgtgtgtccggttgtgtcaacgagaagcagttgcacgagctgaagaggccgtccaccagttcaatgccatcatccgccaccggcaacaccacttcaacatcttcgacggcatcgtcatcgtcgtcaagcagttcaacaacatcnggcagcggcgtcggccaccgcagctgctgctgctacggcaccaccagctcaaccagca

SEQ ID NO: 40164 - DNA, 962 bp, Heterodera glycines
  misc_feature (175)..(176): n is a, c, g, or t
cgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactcnncggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttacggaatagcttcactatagcctgtactttaattctgcgttagaggttgctccccataattgtttgagtaccccaacctgacacttgaaaaaatcgatttatttttgttttcggggcagtccccccgaaccgatgcgcccagatttatggggagaccgaatccttcgggaatagcttccctatagcctgtactttaattctgcgttggatttttgctccccataattggttgagtaccccaaacggacacttgaaaaaatcgatttttttgttttcggggtaggccccccgaaccgatgcgcccagatttatggggagaccgaatccttcggga

SEQ ID NO: 40165 - DNA, 1077 bp, Heterodera glycines
ttctgatccgtcatcgtcggtgcgttgtttccgctccctctgcctgcgcttttgcgtaccgtacgttccgatgcctcacgcgtctttcgctcgcgccactgctgtctttccggcacttcgatgtacgcgaggtccgtccgggcgcagctcagtccgttgctgcgtcgtaggtgtcggatgagcacggtcaccttgccctcctccagactttccttgttcgttgttcggaacccttccgcctcgtcagactccccaatgggccccatgtcctggcctacgccgtcctcctccacctccaacaccgccatggcgtcctcctgctccgttgccgggcaacaactgtcgctttgaagcatttcctcttggtccgtcgccccgtcacgttctccatctttcttcgtgttgtccaatggctccaccttggcgacgggtttcttcacaagggcctgaggagcggacactttggaagttgccaaagcggacgaaggctcattttgtggtggattttcctttaactgttcgttgggagagttcggtgcagacgacaaagcagcagtggaaggaagatttaactgtgaaaagcaaaagataagacacacatcgatggaaaagggacaacaaagaacaaacctcggtagatttggaaattgaacccgtcgaatttgttgtcgtcgccaccgtccccgccggaggcgtaatggtgccattcccttcggcgtcggggcgtctcaacagcaaaggttgctctgcagcgctctcttcaggaacagaggtttcaccagaattggacactgtcgcattcgcttctttgacgtcctcttgctgttgtggtggcgaaggcgttcgggaagaagcggcggacggaagtgccgaattgtcctttttgtgccgcttcgagtcctttgaagagggcgtcggcgtttggtctgtgcccgagtcggtggtcgctgtcccttcccgatgtgcacgctttcgactctttgtcgcatttcgcagaggcgtgctccgcctctgctgctccgtcgtgacgacattgctctccgccgtcccttcccgtgacgctgcttctgttcccct

SEQ ID NO: 40166 - DNA, 998 bp, Heterodera glycines
cctctaaatataaaaatcctctgtgaaataaaatggccttcactagcagccctccgtctcatacgcaagcgcttttgtgccgtataaaatttctcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggataacctctaaatataaaaatcctctgtgaaataaaatggcgattgtgcacagccctccgtatcatgctcgagagcatttgtatgtgtataaaatttatcaaaaaaagagatagccattttttctgggatagagtataaattttaaaaattcccctcaaaaataaaagggtctatttcgcacagcccctccctatcatgctccaagagcattttgtatgtgtattaaaattttctcaaaaaaa

SEQ ID NO: 40167 - DNA, 1139 bp, Heterodera glycines
  misc_feature (1005)..(1005): n is a, c, g, or t
  misc_feature (1059)..(1059): n is a, c, g, or t
ctcaataatttatgcaattttagtccagcacagttttcctttatctatttcaacattaactgaaatgtgtatgcaatttcttgacgaaaatgctgaaacagtcatcaaatggcaacaaatgctcatgatgccaaagcaaataatcgaaatttttctttaccgttccaaaatccagatcagcaatgagatgttattatatgactttgtaaactgcattttttacatcattttacttaatttaatttgtgtatgttttactaggccatccgttgggccaaacagtggtgccacgacaatgaaatgccaattacggtagaaactcttcgcaaaacgcttgggaagcttatacagcgcatacgttttgtccatatggaataacaatgtttcgaagagcaaattggtactaaaatgggaaatatttttaaaaattaattttttttttcaagtgccatcaggcattttgaccgagcaacaaattgccgaaattcgaccatttcttttgccgaattgccgtggaatgccattgcctaagacgttgaagccacaaaaccaagaaaatacttgtacagtgtgacaatcacaatggaaattgaacatttaacgaattttgttggcccaatccacagccgtgccttttacacttgtggccttaattggcatatgtccatcgcttgtgtcggtggctgggcagaaaacagaaagaccttactgtgcactctcaactgtaaccgtgacgaaaacggtgggaatgaatgatgaatttttgtctcaaaaccccctggggggtgaggtcaacagaaaattttgccattgcaatccccagccatgaattaatttattttttggaattttaatgaatttataaagagaattagtcaaattttcataaatttctctctttcctttagcttatatgtaagcactgtttcccaaaaaaacaaatttgttcccatttaaattgtatattctaattaagagccgtggttgatgtactgcaacttttgngccatgccgcgaattgatttcgcatggtttgttttggcagatgatcatctgcangacagattcttgctcggcgcatttgaaggagaaattaaatccaatacaaattatgtgcaaaaccgtatcttgattgaggt

SEQ ID NO: 40168 - DNA, 1430 bp, Heterodera glycines
  misc_feature (181)..(181): n is a, c, g, or t
  misc_feature (399)..(400): n is a, c, g, or t
  misc_feature (426)..(426): n is a, c, g, or t
tttttttttttttttttttaaaaaaaaaaaaaaaaggggggggggcccccccccaaaaaaaaatttctccggcgtttccccacaaacatattttaataatttttgtggaaaaaaaaaaaatttttttctcccccccccccccccccccccccccccccaaaccttttttttgtgtgttgtngttagaatgtttaattaaaaaaaaatttttggaaagtttcttaaaatttggtttttcaaaaaaaaaaaaatacgtaccagcagtgccctttgaaatcttgtcaaagctcagcactgactatgcatggcagcgccagactcaaaaacccatttcctcaagaaattaatcaaaaatcgaaatttggtcagtttttgacaaaaatctactagcagtttacnntcaaaatttcataaatttcccccgancgacgcctattttaaattcactgaatcgaagtgctactcaatttggtttgctacacagccgatgacacttactacctcaaattattataaaagcataaataaaatttgaaaaaatgttaagggtgggtcgacgtaagcttttaccacacagcgggggccaactacaattaggaatgacaaacgataaaattttactgttttcctagtttttaggattgtagaatcaagggaaaaaatgaaattggaatgattccaatattattatttattatgtgaagaggacaaaattggaagcatcaattacctaaaaatactgctgatttgagagcagtaaaaaatgccagccaaaaattccatttttattgttaattaactgatcgattttcggacttcctctctgtttggccgttaattcgccgatcgatcaaatggatcaattccgcgtcctttccgatcagacactcccgctttgaattggcttaatgtgcagcgaataatatgccctcagggaaaaggttccaaaggacaaatgtttcaaatccatgtgaaaataattcaaattaaaattcctattcctatttgaattcaattttttcactaaaaagtaaataatggccgctcccgtgccttttcgtgccgattcaaacacccaccaatacacagcatcattcccggggccaatttattatagggacacttttggattagagcaacaaacggacgaagcggagttggaaaatgaggcgacaatgggtaaaaagagtaatttttaattaacattaaaaaatatattatataaaattaatttaaaagaatcaaatttaatttgcataattggccccatcggattatccactcaattttctaactaattaattacccaattagcagcaaagttcggcggccattcgtcgtccgccgttccgccgtcactcactttccctcccccgctgtattaccgcgacacttttgggcttgaaccattggcggaggacgagcagaat

SEQ ID NO: 40169 - DNA, 1218 bp, Heterodera glycines
atttttttgaaaatacggtaatatattttgaaaattctcacgttttccggttttggccgcttcgatggccgaccggaggacaattgagcgcttcttacgtccgccaccgccgccgcaaccgcagcagcaacagcctaaaacttttttggttaaaacattaaaaacagtcctgaaaattcgggaaaaattaggaaaaaatttccaaaacatcgattgcctggaccttggcaatttgatcagcagtggtgggttacaacattggcacggcccgacacaggtacagccacaacagcaaggcttactgtaataatttaaaaatataaaaaaatttcagagaatttaaaaaatttcctcttaccaacagcagcaacaactggcatcagcaaaatgttggttctggtcaatgtttgcaaacagaatgaccaacagaaatgggaatgtgaagagcaattgcattttattttttaaattttgttttttaaattttctaaatttaaaattatttaaaatatatttttatttattattatttttgagggggggggggtaaataaatatttttaaatttatttaaatttgcacttttttgtgaatcgaccaactacggtagttttaaatatactttgagtggcatttttaggaaacgacccaccaccagtgttaccaatgccgtcaccttccaaagccacaaattaatgcggcgattgtttctgccgcttttcacgaatacggcagaagaaatgacggcggaggattttgcttttcccattaaaaattaatttttattttaagaaaaacttgccaattttgaattgataatcatcatcattttggtgtttgcattcttttatcaggggtaatagaaataaattttttaattttagcttggaaaaaaattttccttaaccaaaataatcgaaaaaccgaaaataggggattctgattaataatgggtcgtattctacattaattttttactatttgatgtattaattaattcataattgttaaaatttttaaataagttatcggaaaattaattttttaattgaattggtcgacaaagaaaatctttacattgctttttattattgtaagtcatagtttttgtttttcaataaaaaatttattacttaacaaaaacatccgccaaaattggcacacttatgataatcccatttgtttaaaatattgcttcatcatttaatataaaaacac

SEQ ID NO: 40170 - DNA, 633 bp, Heterodera glycines
agttggccgccggaccggaatgcctatagttttcctctttgcgccgtcaaaagttacccctgcatgccaaatttcagctccccccgattagcggttccggagatttttgttttagcaacgaaacacgatttgattttatagtatataaactagcgggtgcgtgaaccgtcggctctgggcttgggataaagcgcttcgcgctttgggagcttcgctacctagattagctctggttgtggagattttgaatttttaaaaaattatctgggacttttaggccgcttcgcggcctcgaacgggcgcttcgcgcccgttttttaaattttgttgggcttatacgggcgcttcgcgcccgtttctaaatttgttgggctattaaggcagcttcgagacctcagacgggcgcttcgcgtgttgttttatttcttatgcctcattccgggttgtctgtgctgacaaaggcggacggttgaatttggctaatcgtaaaatctgtgacgtgatcagttgatcatactgatcccttgttgcttgtgaagatccgctccgcggcggcggacagcgatcagttgaccagactgactcctctccgacctgtcgaccttgtaccagcgtctgccatccgctgatcac

SEQ ID NO: 40171 - DNA, 1010 bp, Heterodera glycines
  misc_feature (157)..(157): n is a, c, g, or t
tgagcatactgtagtatcgtagccttaaaaaaagaatttctccaaaataaaaatgcaaaaattcttttgtagagcgaaaaattgttcagcttcatacttaagaaaaattgaaaatttttggaattccgataaaaaattgatttatagagagagaatntagttcttgggtatgtattgtagttgaccatattttttccgcataactcgaaaatcgatgaaccaactttttgttcttgatagagtgaatgttgtgcaattttcccatattttatggcgaattttcaatttaagtgccagaaaatcgggcagttttcgtcttttttttgtcttggtatccaatcgggcacttaaaatataagtccgcaaaacaaaaacaaaaattggaatttttggcattctttcggtcccaccaattcagtctcagtacatttttgagcatcataagaattttgttgacaaaaccaacgaaaattggggttttcgaaaagtacttaacttgctatattagccaatccaaaacataaagtttctcaaaccttcaaaataaataaaatatgaaaactttaaaatacttttagcttttaattttgcaacttttcttaaagagttgtttaatcgcttaacaattacctatttgcttgaattattcgcttctaaaacaacatgtatagattttgtacatattaattgtgaatgaaaaatgcactgaattggcatgggattgaacggtgctgggacgttagtcaaaaaccatcaaaatgggcgttagtcaaaaaaccatcaaatgaataatttttgacagaaaattattcataatttcgtctaaaatagatcaaattttataatatagatatttttcgatagccctaagtgttttctattatcctgcaaaattagaaaaaaattctttaagtttaaaaaagttatgacctgagaagctcaaaaacccaagtttttttgaacatttttagtcataactttcttgatacttaacgaaactttttggaatt

SEQ ID NO: 40172 - DNA, 1243 bp, Heterodera glycines
  misc_feature (49)..(49): n is a, c, g, or t
  misc_feature (68)..(68): n is a, c, g, or t
tccgcaatttggccaaatgtcttccgttgggccattcgtaacatttgcncaattccattcgtcgcttntcgttcttcttccgactccaaaacggtgcctttccaatattcccatgcaaatggtccattgtttcgacgatcgtttcgatgtcgccattcattggctcatcaaaaagccatcggtcaaacgccgtcaaaacatttttaatgcgaaaagaatgcgacggattcttcaaatcagagatttttagaatatttattaaatggaacttaagaaaattaactcacaatttgcaacggaatttccttttccgttttatccgttaatttttcgccctttggacttagacaagaaaaaaggcgaaagtgagcaatgaaagctatcagaattggcaaaaaagaaagaatcattttcgaaagagaaaacatttagaaaataataaaaaagaaatatttgcaatgtttttaagggatgcaattttaattggatcgatattcaatttaagatttgccaatcacttccaccaatttagtgacgacaattatttaaaaattacactctcgcaaaatcgagacaaataattagagaccggaattctcaaaaatgccggaccggaccggactggtattttcaaaaatgaccggattcgggatccggtctctcataatccggtcaatccggtaatccggtcaatccagattttcaaattgccggatccggaaccgaattccggattggtaaaaatttatatttcacatgttaatttgggaaaaaacccttaaaatttcatctattatatgtagaaatttggtgcaccagaaaatgtcgtcatagaaaagacaatgcgccgaaaaaaatatataaaatttcaatttttcaaaaaaaatttaaaaaatttattttaaagttttttatttttgaaaacctatgtttaatgaaaaaataaaaaaatttttttgcggcgccctttttccaaaaacttttgggaaagaaagaggtgggtcccggcggtgccgataggcgccgccgggaaaaattttgaaaatttgaggcgatttgcaaacagattttcaccaaaaatgagcttttttttttttgctgttttgggcaaattttttaaaaagaaaaaaatttttgtagggcccggcggtgctgacaagctcccgccgggggagaaattgaaattttgaccattttaagttaaagaacattatgccaaataagaaattttttcaaagaaaaa

SEQ ID NO: 40173 - DNA, 1110 bp, Heterodera glycines
tttctaaatatttttttcagaaagtgctctaaagctcacccccgcattatttacaacttaattttagcactctgatgctctcttatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaaaatatgtcggctctgaagtgcttgggagggggggggtgccaaaagaggaggattttgagacagtgcgggtgagtgaagaggcaaaacgaattcactcttttttccatggcacattcaatctattcgtttgggtcaatttatggatttgacgatttggtatacaatcaaacaatgctttcagttgattagcaatggtgcatacggcgccgtttatttggtcaaacatcggcggagtcggctgagatacgcactgaagaaaatgaaaaagcaaacactgctgatgcgcaaccaaattgagcaagtttatgcggagagggacatcctcactttcacggacaatgtgagttgacaaagccatgggacggaaaaatgttactgtttcagcctttcgtggtgtgtttttacggttccttcgagaccaagcagcacctttgcatgctcatggaatacgttgagggcggtgactgcgcttcattgttaaaagtccctaaaatttgttttcaattgtaccaattcatttcagtccgccggaactttgcccatcgaattggcccgcctttatgtggcggaaacggtgttggccatcgaatatttgcactcgtgtggcattgtgcacagggatttaaagccggacaatttgctaatcacttccatgggacacataaactgacggatttccgccctctcaaaaattgggtttatgaat

SEQ ID NO: 40174 - DNA, 933 bp, Heterodera glycines
  misc_feature (895)..(895): n is a, c, g, or t
ccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttattttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaanattttgaaatcatgtttcccactccctttctccagggg

SEQ ID NO: 40175 - DNA, 861 bp, Heterodera glycines
catcggtttcgtgtcggtaactgattatttaaatttcctcccatctaagttgatttatttaaagcagttttttgtcttcctttattattctcttgctttgaggtggatttttgtttgtcttctgtcggcgttacttttttaaagttttactgtattcgctaaaattaattaaatttctcagggttgtctttctgccttagctttgatgaaataaatatatattagctaaatattattctttataatcattttatctgtcatgtaaacatttttgtcgttcatatttatcgaataattccttcttgaaacatttttaagtcctgacatttatttaatttattttctccaatttttgaatccaaatttattccaggtgtattttttatttgggtttcttctccattgattcattggtttaaaattttatttttcaattgtttgaatttaatcttgctattaatattttttggcaaaatattgcattttattatatataataactgatcaaatttttactatttttgtacctttctcttgctaatttctctgttctgtgcgatttctgatcagtgctttctttatcttgttcgtacttaagcttttagattaaaaggaaaaactttatatgatttaaaatttttattaataaaacttcctattttatataaatttttatttataatcttctataaaatataataattgggtcaattattttcaaaattttttgagcaatttttatcattattattatcattttaaaatatgctttttctgacaatgactcctaaaattaaatagaataattttcagaaaaataatttattttcatttgttatttatttatttatttatattatc

SEQ ID NO: 40176 - DNA, 306 bp, Heterodera glycines
ctcgtgaccggaaaatcggtcagtggaaaatgcgtcagtggaaaatgcgtcagtagaaaatgcgtcagtgataaaaaatactttaaaataaagttgtatggcatttgtattgtaatatagaagtaaacttctataagaaaatcattctcaattgcgaaccccggacccaaactcgaacaaaaaatcgaaagtcaaaatttcgaaattagagtttttcttcaaaattggtttaaatacacagaaacaaactgaaatacatcaatcctgcaataggagatcatttatgccgtttttgaaccaaaaatg

SEQ ID NO: 40177 - DNA, 931 bp, Heterodera glycines
ctatacgtttaatcatttatcagtgccattctgttatcttcctcggatttattgaaaactgatcagtgatcttgatcccgtcctaattgttttacagtttatgttaaaaattagagactaccccagaatcggtacgaggccgagatcccaaatttgcgcggaccgcgaccgtgggattttctgtccacgacccaccccagactcgaacctcacctcttttaattgactcttacgataactactaacaaatatgacaaaaacaattagccaagattgactggtgagtgtgtgatttaaattgtactgatctgcccagggcattttttaatttgcgcacttttttgctgctacgtatcacgcgctttctacgctgtgtgtaatacactttttgaatggagagaggttccccggagggcgggtggtggtggagtggggtgactgagtggccatgcggttgttattgtgctgatgttaggtacgttcccaatggggaacgtgtcgagaggggaggtacagaaagaacaaaatgtcgtacactataaaggccagggtttgttctttgccttatttcaccaacccaaccaatgaccatttttgttttaaattcctatttcactcattcgcctgtcccttccattttttttcgtatttttcgctcctttctccgccatcccaattccctccaatttatatagcgaccgcgagaataaccacgtggtgggccatgtggtttgttagtgaaagaggcgaaaaaaaatgcatgcgggcggccattttgggtacattgtgctacaaaatgggaaatgacgtgactaatgatcactttaatcagtcagcgtttccaaatttttaaagccaaattttcatattactcttcaatttttggtgctcggtgcgggtgctttataaatattttagtattattttgaat

SEQ ID NO: 40178 - DNA, 1415 bp, Heterodera glycines
  misc_feature (35)..(35): n is a, c, g, or t
  misc_feature (138)..(138): n is a, c, g, or t
  misc_feature (1311)..(1311): n is a, c, g, or t
  misc_feature (1314)..(1314): n is a, c, g, or t
  misc_feature (1319)..(1319): n is a, c, g, or t
  misc_feature (1347)..(1347): n is a, c, g, or t
agaggatgaatatgaaatgtgcagaatgattttantcaaactaaaaaattcattttttattttattggtaaataacttgatacagataaaatttgtttttatatataaatttatattacaattttttctatagtaatntaaaatacgatttagatgttttgatttaaatattcatttttagttcatgagctttttcggtacatttttttcattatgtacattataatttatgtagctgtcattaaagaaaattaattaaaaaacccctttttaaattaaatttgatcaactagtacaactgttgaagttatgagctttgactcatctcggtggccataatataatttaaaacgtacgctcgtccaggtttgacatcgccaacatgttaagtttaacatttacatgtttatttatttttaagttttttactaccttactataataattagtttattttttttatttattggtttataaaaaacaattaacattttgttatgaaactatttttatagatacttcaattttatttgtttttggaacttactagtaatgtgccccaagtttatgatgattataaatataacttttattataaaaatattttttttataattttctcaaatgatatgaagccatttaacatactttattataaaaagaattatttaatttttctcacacagttcatggaaagtattttaattaaatttaataattagttatttttggttattttttgttaaataaacttgtaaagtaaattttcatcttcacgtatcaactgttgcttgtatgtatttttgagtggtaagggtctatttgaattataaaatgcaaaaataatagtttaaaataatttagatttaaaatagtttaaataattaagatttattttgcttattttattcaataagtttattatttttaaaatgaatttttatgtataggtttcgaatttatttttagtgagagatatgtatcttagatttgaaaaaagcttcattaaacatattttctgagaaaaaagcgtttgaaaggaaacacccacaggtcttgcagaaaaataaaaattaaacactgttcaatatacttttctttggtaaaaataagcaaaaaataacaatcaatgtaaaggaagggaattaataaaaagtataaaaaacttgaactcggccattaaacctaaaattcatttttgaagcctcataattttattgcccgctataggtgtgtaatatacaatagaagtcgaccctgctctagcgaatagtatatcatacatatgcagtacctgttttacagttccgncgngtggntgcctttgtagtgaaaataattattaantatttaaccgcattacacatagaagacgaatattgtttagtaaataatggctaatttttcattcaaaa

SEQ ID NO: 40179 - DNA, 1537 bp, Heterodera glycines
  misc_feature (568)..(568): n is a, c, g, or t
  misc_feature (1488)..(1488): n is a, c, g, or t
ccccacagtttcaatagtataatgaataaataaatttaaagaaaaaacagtgaaaataaattttttgtagctaaacataatttttgttatttaacaaagataagattccgcctccgcttcctcgaaatcatacgtcgcgattgatttacctaaaaataaaaattcaattaatacgaaaaaaaattttctattattattttttaaatataattttttatttaagtttttttttcgaaaattaaaataaatttttaaaatgattaggcaaatattttgctgtatttagaatttaatttgattatttttattatagcattttgatcaataaatttatttttttttctgaaatcccgaatccaataaactattttcacttattttttaaattgcatatattaatgttcaagtaaaccagctaatttcgatttaaaatgtaaatttaatgtcactacattttagtaccaaaacgacccctactcggaccaaattccaacattacccgtcactttttggcgacggaattcgcatttgaaacttgaccaagaaattatccttctcatttcattanatttttgaattcaaagtacaaaattcgattctctcctttttaaaaataaaatgagcttttttaaacaaaaattatattaattaaaattaattataagaagatattgataaaaaaaagatattaaaataaatgtaatctttgaaatttttttaaaagttcaattctgacaaaggaagggtcggcaagtgaccgtggaatttccaaatgaagcttggtgtgtgggtgtagatcaccccaaggttctattgtaaaattttagccatttttgccaaatgagctttttaaatatttttccattaaaatcaaaaaattacattaaacataaatatgcaataaatataaatatcctgtaggtttataaaaaaatatttttgtatgattttttttttgagtatcttatgtatcaaaatgattgaaaaattaaaaataaagtttttttttataaataattttttgataatttactataaatgaaattacaattacaaaattttcaatatatattatccaaaattaataataaaattttttgtaaaaagaactagttagaaaacctatttaaaataaattgatcagggaagtttagtaaaaacttttttagaaatagttttaattttaaaaataaaattaatgtgttgcgtttgatagcccgtgaaaaaactttatatttggtgagttgaaattttttattatttttaaatttgaaataatattagacatcgatgaattaatttaccccaagaatatttttattcttgtgcgctacttcctgacaggatggttcagttgactctatacatttcttgatttttttaaagatcaatttattaaattagttaaaagaacggattttaattaaaaattatatttcctattataaaattttttaaagttatctaaaaaattatatatgaatatanctgactctgaatgattataataaataaaattatttttcagctagctaat

SEQ ID NO: 40180 - DNA, 951 bp, Heterodera glycines
tattgggtcataactcgtcaggagttgattttatcaaaaaatcgtctaagagcttttttgcagagaattttaagcccaatctaatgtgctttatctcatgtttttatcttgaatttaaaaaaagttatgaaattaaatttaattttgcaattcaaaaccataggggggaccccatggttttgcatttcatgaaaattatttttgctcctaaattagccaaaatgcatttttatggcataatttgaggtgctgaaacgtatatacgctttattttgcgtttcagactttttggaaggtggttacaaatttttgaaaaatcgtcactatttgggccccgggaaatccagtgaaatttcgaaaattcataactctttcgtttttgatcaaatttagtggaataaggtttgaaaaatagcaaaaaattaggtgaattttatgagatttgtttggaatttctatcttccaaaataaaaaagttattctaaaaattctggaaattttcgatttttcagaaaaaaattcagaactcggttccgtaaaggtgtttttgaaattttaaatactgaaaaaaatccgcaattttttgctctattttataagccgcgaagcggccgaatgacctcaacaaaattaaaagacgggtgcgaagcgcccggcctgaggccgcgaagcggccgaatgttcttaacaaaattaaaaaacgggcgagaagcgcccgtcctgaggccgtgaagcggccgaatgtcccgcaaaaaattaaaagacgggcgcgaagcgcccgtgctgaggccgcgaagcggccgaatgtccccaaaaaattaaaagacgggcgcgaagcgcccgtgctgaggccgcgaagcggccgaatgtccccaaaaaattaaaaaacgggcgcgaagcgcccgatgctgaggtcgcgaagcggacgaatgtccccccaaaaattaaaaa

SEQ ID NO: 40181 - DNA, 1104 bp, Heterodera glycines
acttaatccctttcaattgcatttgttcatggagttttattatggaattaatttctttattttggtagcttttgacgagttcaatagcttcgtgattttttataaattcttcaaagccagacttgctggttgtagaatattcaaataagaataaaattataagttttcaaataaaaattttattcatttttctaaattatagcaatattatgattataaaaataaatacaactaacagataaaatatttataattatatttttattttttgcgttgacatataaaatccatcatatgcatattaatttttttatttacgtagctcgtaaaattatacgtgttgggaattattgatttacacgctattatttttttatataattatatgatttagtgaatcgtataataaatttaaatatttttattcacactgagactatttgcggttcgcccacactgagactatttgcggttcgcccacactgggactattttcggtttgcccacactgagactattttcggttcgcccacactgagacaaattttcggttcgcccacactgagaccattttcggttcgcccacactgagactattttcggttcgacctagcaccaaaattttaatttttaaaaattttgggaaaagtgcagaattgggcccgctaaagaaccgcccaaaacatgttccaatcaatctcttatgacctctgatcaatataaaaaatagtcccgaggtgcggaaatgttgttttttacttgaaaaatggtcagacagagcaaggtcattttgacgtcacaaatatgattgtaaaatagtaaaatcgcacaaaagggatatttaaagcaacaaaattgctcgatcattactaccgatggaaaatatctttaatttgattcgacttggaagtgatgtcgttattaatcccgacactgccgtaaaaataatggcctaataccaaatgagagagaatgccgcagatgtcgaattccaatgacaattcgaactgacaaaggtccagctggcacttttcgatgcagacgttgcaatggcccatcgcattaagtaacagaagggacatgatttgaagccgttcatggaaa

SEQ ID NO: 40182 - DNA, 1132 bp, Heterodera glycines
ttttgttcatttaattttagaatcatttcatttttcgcgactggtcccttttgaatgtcgcgtcttcgcccgaatttgggcattttcggctgttttcttggcaacattgaggacggaacggtgctgcaacaattcatccgagaggcgcatcaaatgaagacgaaattggccagcgaaaacgaaggaggaatttggaatggcaaaagtgtttacgaatcgccgcttttggtgtaaaaaaatggaaaagaatacaatggaagtgattgaaaactagggcagaaataaataaaaatatattattgtgataattattattgaaataaacattttttaaaatattgtagccaataaaattgaagggtaaattgctctatttattggtactttaaaatttaaaatacaaatttaatttaacattgggacgatcagcaccaccggcctaaaaacctgcttaactttttaaaaattgactagaaaatcaaattgaaaatatagaaattttaaaaatgaaaacaaaatgaattttgtcgatccccctgatcgggaatgtacttcccgaccaagtttgccgaaaaagactttttgacagccaaatgagtctattaaaaaattgcaatcgtttcccttaactaaagacacttaggttccaactaagagtttttgatttaaaaaatgatgagttttatggtttttcttattcacggcacaccgcgaaacaatatttccttagaaatgtttaaatttgtcttaaaaactatataataattgaccattctttttgtagatttcaaaaatacattaataataataataatttatacgcaaagcgtgaaaaacaacaataagataaagcaaaatggtcgcacatgagagtggttcataaatgtgtaaaacgatccaaatcaattgagtcaagaagtttagaaaaaacagttgaattttgtaacctaacttctttaggtaataacctatagaagcgagaagcacgaacaaaaaatgaatggtatctaacattagttgagcaaaaagttggcttaattaaattacccagtctactagaaaaattgggttgaggtttattatatttaattaggacaaatccattagttatttcaggaaaagtcttagatca

SEQ ID NO: 40183 - DNA, 896 bp, Heterodera glycines
tccgcgtttgtggtagtggacaaggctgaccagttttggactagcataataaatgagggagtgcgatgcccggggcactctcaaaaccctttggaaaggttgcaaaacgatgggaggacattgatgagaaatgaacggagcgaatgaatggatgctcttcccgtgaatgtttggcttttaccgaaaatcattcgtcgcctttccctttgccttagtctttttcttaaaatgcctccttttttgaccatttcaaccttttttttattctgttatgccgcaatcggctcactgtaaacgccgccggtgccgtccttttcttctcttttctcggagttttcgtcggtttcgtccccgccattctccggcgcggcttttcgttcaacgcaagcgcattcttcattttggccttttgtttttgctcctttcacaaacgaatggccaatttggagaaatcgcgtcagtaccaattaatgtcataaaattgacccaccgccgaagcaaaaaaattcctcaaattcgcgtccctctcattcagttccgtcatttcctctctcgtggccagcggtgcccccgccggtttggccggtctcggcactgccggctctttggggtcattgggcgcttcggcaggctctggtgccgcaagtgctctgagcaatattgggccacgtgggaccttttggattagaattggtgcttcattttaaaaaacatttagtgtaccaattggctcaagccgcccttcaactgacgggcactggggtgggcattgccaatcaggcatcagaaaggtacgaatgccaaggaaccgatcggtgcattcattcagagaattctttcagtgcttggttccctgtggtcgtggaaaatgcggtcagtttgctgtgtgaagaaaa

SEQ ID NO: 40184 - DNA, 959 bp, Heterodera glycines
tatcccagaaaaatgggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatactcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgataggg

SEQ ID NO: 40185 - DNA, 1051 bp, Heterodera glycines
  misc_feature (725)..(725): n is a, c, g, or t
  misc_feature (927)..(927): n is a, c, g, or t
  misc_feature (951)..(951): n is a, c, g, or t
  misc_feature (989)..(989): n is a, c, g, or t
aatcgccccccaccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgatcagtttctgaaaaaaaagttaagcctaaactttttggcctgtttaaaaaggaattaaaaatttttttaaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacacagaattaaagtacatcttataaagaatctactcccaaacaattctttctccccataactttctactcatcatttctcctctattacccctaaaacaaaaaaatctattttttcaaatctccttttttcatactcaaacatttatcaccaacaaaaatccaacacacaattaaaatccacactataatcaatctattcccataatattcaatctccccataaatatctccccatctcttctcacaatctaccccaaaaacaaaaatccctcctttttttcttctttcctttttctctcctctttctttcttctttnccttctctcctcctcccctttctctttctttcttttccctcccttctcccccctctttctttctcccccttcctctccccccctcccttcctctctccttccccccttcccttttcttctcttttttcctctctccttttcctcttctctctctcttctctctctctcttttcctcctccctctttttcttctccctctctnccctcttctcccctcttcttcttnctccccttctctctggttgaagggcttccacacaactnccccaaaaacaaaaaccttagtagatcaagtgtccgtttggggtactcaaaccatttatggg

SEQ ID NO: 40186 - DNA, 1742 bp, Heterodera glycines
ctccgcactccctctctctctcttttttctttatctctctctctcttctccctcttttttctctctctttctctccgcactccctctctctctttctttctctctctctctctctgtctttctctctcctccgctctctctctctctctatctgtttcttctctttctctcctctcttttctcccttcgttttttaccttcaagtgcaaattgccataagtgtcctccaaatcgcaccgtatcaaatcaccgtatttcctctgctccgcctccaaaaaggcgtcttctttttttgccgcccttttcccttcgcttttgctcgcatttccaacaacaaaacgaatgaccacgtctttgggctgaatttgaatattttcctaatggttctcctccgcctactttgaattcttcccttttccctcgtgggggccgactgagccccaaagggcagtcagatgaccttcggggcccagttggtccggggcccagtcgtaccagttcctcccccaccaaccgctgtccgtccccaactctgtcggattgcctcccgccgtatcgctccggtgccattccgtcggctcatcaccaaaactacgccaagcacaggtcggccggcacatggaaatgcgacggcactcgagaaaggcatttggatgcggaagggaagatgaaagttggagaaatggacgacggaagaaaaagagaaaaacaaaggagaagaaggagcggaagaagaagaagaaggaggaagagaagaaggaagagaagaaggaagagcataacgggaagagaaaaagggcctaaaaaacgacagaggttttttgtgttgcttattattagagcccggattttgcagcatttgctgaaattttttcttggggcgtgctaataagcatgaaaaacgcatttctaacttggtttgaggcttctaggctcaactttttttttgctgattttggcttaaattggtattttcatgcttaatgctgagcatgtaatttttgtgctgaatttagcatttagtgcttatttttgtgcttaattgccattttttataaaatattgactaaaacaccgtctctcagcaataaaaacgaaaaatacatccctaagaatcggccctaaaattttcaaaaatgcacccctatgaaaagaaaaattttctcaaaaattcatccacaaaatttttttctttacaaactttttgctttaaaaatgtcaatttttgctaatgaaatattagaattgtcagtgcgaaaaaaaattgagaattattgttaaatgataaaaatcttttgcctaaaaagcaccaaatttttatgcttttttcgatttttatgcttattttgcattttcatgcttatttcgtgcttaatttagtattttttgatgctgagttaagtgtttaattactagggattctttttttaggcacaaaaaatcgcgaaataggcacctaaaaaggcaaaaaaaaagcgcaaaataggcatcaaataggcacaaaaatccgcaaataggcaaaaaaaattttaattaacgctttttaggtattagaacacgtaaaaatttaaatattttaattgtaaatgaaattataaaataatttaaagttttttccagatacggacaaatttttaaaacaaataatttttattgagaaaaaaataaataaatttttggaattattttttttgaaaattttttcaattcctatggggtgtattttctgaaaattttttttt

SEQ ID NO: 40187 - DNA, 1230 bp, Heterodera glycines
  misc_feature (91)..(91): n is a, c, g, or t
aaagagaacatgatatgatgatcagaaaagttaaagactaagaaggtgaaataataataaaggtagttaagcaatattaagagtgaaaccngacaaaaatgatcaagaaaaaagaaatattgtgagaaagagtaaagcttgctcaaggcgtctgacaatgagaaagagatttgtgatcaaaatgattgttgaagaaaaatgattgttgatcaaaatgaatctgatcaacaatcatgtgggaaagaagggaagaaactgttcagaaatgatcagctaagagagcgatcggaacaaaaggaattgagagatggtgaaagaatgtagagggaacccaatcataaaactgatcaaatatgacctgttaggagaatgatcaaaaaagtggaatttgactgatcggggtgatggaatgatggccaatgatgtgagattggggggggggttagagtagtcgttggccaaatagcgcagcgatgtgatgacgacgagtgtttgtcgtcgtgatggtggcggcggtggtggcggcggtaaatgaaattgtttgccgacgactgattggtgttggcgttggggtggggacagtggtgctgctgcgctcgctttctgctgttgatctgtctgatgagtgtgtgcgcgtgttgcgggcggtcgctgcgtcttttcatcccaccgccgcctccccctccccggcgcaaaagtgcgtacaaattgtgtccaaattggccccttttaatgcaatcaaaaaaaaaagtggaagggaaagtgcgcaaaacattggggagaaaaagtgatcggcaaaagcaacaaacattgacaataaatgtgcaaataatcagcatgaaaatgagatttactgatttggtgggggaagtgaaaaaacaacaaaaaaagcagtaaaagtaaacaaaaaataatttaatttaaaaaccatttgatcaaaatttagaatttcataccctgtaaaaatttttacgccaaaatagaaaatgcggacgtaatttcgaaaatcgcatttaaaatttaaggttttcagataagagaaagcttgggggctttattcgtgctttgttggcgtcgctttatgtaataagcggcattggtcttctctgatcggcacctttttgcatttattttcctaataataaacagctgatcggaaatggaatcatttttaatgcacatggacaaaacaatgatcaccagaacccgttggttctgtggcgcgatcta

SEQ ID NO: 40188 - DNA, 1515 bp, Heterodera glycines
ttcccgttttttgcccataggctaacatttgttagcacaattctttttagtttcacaaattatttcaatttttcttacttttccttcgcaatatcattcattggttactttttctctttcagagagtggttgtctgtctggaggacaccatccacattcacaacatcagggacatgaaagtgtgtggtttgtaatgttgtactggctttttttgaaaaaaaagattaaatcgttcacgattactagtaaatgccaaattccccccccccctctcccccagtgaatattgtattgatgctgcctaattttatgcacattagctttctcccttgggccaaacctttttcaaatgttttagatatcccttcgttcagataatgcacatgctgaaagacacaccgccaaatccgaacggaatcgtcgacctgtccatcgcggacagcaactgttttctcgcttttccgtgttcgtccagcacgggccatgtgtaagcgtgcacattttgggaaactattttaatatttaaaagtgatttgcccttttttaagtttttttttaaatttttaattccaaacaatgcaactgggctaactaatgatagggcgtgaaaagaattcgagagcagccagttagagacagacaagacaattactatagtagcgacccttttgagttttcagcgccatgtccctggtgtcctagtgtattgcattgattttgcttcttttcaggcatatattcgacgctgagaatttgaacacagtgtgccaaatcactgcgcacgacggagtgctcgcagcaattcgtttcaatcccgagggtaacaaaatggcgacggcatcggagaaggcactttttcacccgaatatgtctcttgtttcagggttttctaatttttagggcactgtcatccgcgtcttttctattcccgacggagagcgtctgtacgaattcacgcggggcgtcacccgctacgctcagatcaattcattggcattttcacaggactcgcgtttcctttgcctgtcctccaacactgaaacggtcggttcaatcaaaaaaagggaatttgacgggaaacaatttgaatttttattcccattttttttttgtttttttaaggtgcatttgttcgctctccttacgccgtttgaacagcagcaggcgtaccaccaccactcgcatcaccaccagtgccaaaagtggggcggcttccaagcatttcttttagcttttcatgggctatttaaaaataatttgtttttctcccccataaataattggctgttaaacttttaaaaaattccaatgtaaatgtttttcaggtccgatgaaacttcccaagagggtttaagcagttgggtcagttatttgtcgcagcaggcaagcgcatatttgccccaacatgtcaatgagctgatgcttcgcgaaaagaagacggcgccggcgcgtctgcccattctcggcactcttagtagaggtggcaattccacgcattcaggtgcagcaatggcg

SEQ ID NO: 40189 - DNA, 728 bp, Heterodera glycines
tcccctttttcttcactacacaatgagatccttgcgaaatttgcagcttcctgctcattgagtcggttatgaattgtatgttcgaacatttcttcgaagtcgaattgtcgtgcttttttgttggcatttcgactttgtgccaaattggctgactgtttcgctggttttgtcgccgattctgcttcgtcctgttgttggttttcgttttcctgcttttgcattttttatttttgcctttgttatttttttctgttcttttcataaaagcaaaagagcttagaataacaaaaataataatctgtgaaaataaagtgaaaagaaaaggcttttgcatgaaaaaaagaaaagaacaaaacaaaaagaaaaaacagattaatcatttttaaattatacaaaataattagtttggcataatgtgcaaaggaccattcgtttctttcattcactccgtctgttgaaacaaaagcaaaaacatttaaatgaaatgtttttttcataacatatttatttttcataaattttcccatttcgaccaattcttttctttggtccctttgcttttattgcctttaaatttagatgtgatttattgttttaaattttggtaaatcgatggtgaaatttgtgtaaagccgaaaatgttcgattttggcttaggccgcaaaatacaacgaaaattgagccgcaaaggtccgaaaatagcccttaagaaatgggccgcaaatgtc

SEQ ID NO: 40190 - DNA, 1403 bp, Heterodera glycines
  misc_feature (1318)..(1318): n is a, c, g, or t
  misc_feature (1363)..(1363): n is a, c, g, or t
  misc_feature (1384)..(1384): n is a, c, g, or t
attaagaattttgaccctattttcattaaaaaaattatttattttgcggtttttctcaaaaaaccacaaaaagcctcaaagccccattttgaaaatgtagcctcattgacctatcaaaaaaccacaaaatgaggctaaagcctcagatataccatccctgctttaatggtttaatcaatgtttatttgaaaaggcattttaattgtttaaaattcatttttaccattatatcctcctcataatattcgattgctacatacgttggggtggccacgtaaaactcacgtggcacaactttatttgccagttttctcgggttttcgaaaagccccaccggtatgaaagtggcaccgtcataatcgatcaatttcagagtttcctcttcgtccatttttttgacatacataaaattattcggttttatgtcgccatggattgcgactaaacacatgaaatagggttttattatcagtaaatttaatgaaaaaaaaaagcgaaaagtacacacaaaggatcgggtttttggaaattttaaaaaaacaccaccttaaaagaagagatttttttcgaaattttggcaaatttttaagtattttgtttgcttccgaaaaattttcgctgacaacagaatgagaaatttcaaaaaaccttgagaaatgtatgtatttcgtttgcaattgtgaagctagaatttgattaaaaatatgacatttttaagatattttgcctatttttatccatattttggtccatatttggccatttttggcctttttagtccatatttcgggcttttttagtccatatttcgcgttttttagtccatataatttacaaccctagttatgattgttatttttgatattttatttataattttttttctaaaaaagcgcccttttttatgcaacgacctagtaataagatttgattttcttgtcaaaaatatttttcctaatgagctttatgaactccgttattaaatttgagcaatggttcagttttaaattttaatgccaaccaatcaacacgtacagacacccattggaatacggaataggagagaaatatatataaaatatgtgtgataatcatcaaatgaattatttgataggggttataaagaacaaagaattcaattaaaagtcaaaggtcatttcacattctgctggggaacttttctacgacgcctccggaagcagcagcacctgaaacagtctctggaagtctcatcaatagaaaatgtccatacttccaaggggcaataaaaagggaaaaagagcaacactcacttcacttcgctgtgctcttcctcctngtgacgatttgggggctgggggcctcgcgctttcctcatctctcntgcgtttgagtttacacctanaatcccagcattaatcatc

SEQ ID NO: 40191 - DNA, 890 bp, Heterodera glycines
taatcccgaattttatccaaaaatacgggatttcggacagatatcagcagcaaaatcccgcgcgcatacgtttcccgtcacttttctgtggttttacgtataaatcaacccctacccccagcaaaaaactgatcgcttttcttctctgtaaaaaattcaaaataataataaaaaaatcggttaccgtaactaatccactcatcccaaccaaaagaaccaagcccactttttactgtaaaaatcaattacagttagattatgcttccttcctaagcaaaagaagcaaatccgtttcaatctacagtaagcttatgctccttcccatacaggggtgtgaaaaacggacccattttctactgactgtaaaaattacagtaagtaatcccccattcattccaagcaaaagaacaaagtcaccttttgtactgtaaaaattaactacagtaagcctatgcttctttcccaaacccacttttgcgtgctcggtcatagtcttcctgcagcatttctttgttacaatacaagtcaccgtagcacaccaatgttacggttggacttaggtacggtatcgcaggtggcggaacatcgacccatttgggaaggtcaaaagcagacttaaaagcgcagaattaagaacggaacagaaagaatgggaaacccgcgccaggatcagtcttgccaaggacaacaacccagcaaggaaaaaaacaatttaaataggctacacctcgtttttcaaacaaacaaaaaaaaacgaatttttcgagaattaaaaattgtgttttttttaattttaaaaaactttttttttaaaaaactaaaaaatcccctcttaataacattcgaaaaaaagattcttttcgtcgaaaaataaatgttatatttttatt

SEQ ID NO: 40192 - DNA, 232 bp, Heterodera glycines
aaataataaaatagtacatatatctataaaccagataaatggaaaatgtacattgacaaaacgtaaaaataatttttttttttgaaaaaaaattttgtttttttgaaaaattgagtcctaggcctatgctggtgggtgcctcgtgctcatctccgggtttaattatctgctgctggttatgctcgttaacccggatttagcgctaaaccctgagacgacgagcacgaggcac

SEQ ID NO: 40193 - DNA, 1434 bp, Heterodera glycines
  misc_feature (31)..(32): n is a, c, g, or t
  misc_feature (58)..(58): n is a, c, g, or t
  misc_feature (87)..(87): n is a, c, g, or t
  misc_feature (1252)..(1252): n is a, c, g, or t
  misc_feature (1257)..(1257): n is a, c, g, or t
  misc_feature (1291)..(1291): n is a, c, g, or t
  misc_feature (1298)..(1298): n is a, c, g, or t
  misc_feature (1387)..(1387): n is a, c, g, or t
aataattattattattattttaaaatttaannttggttaatttaatttaaaataagcnttattatttgttgggctatctttttatgntaagaaaaaataatttgccttgggcaatttaaatttttgtcaaataaaaataaaatgcttttcttatgaagtttcattcagatttattcgcttttatttcaaagtccatactcaaattcggttattttactgatttacccgtaaaattggaaaagtacctaattataatctaaaattttttttaattttgaaagggtttctcaaaaatttgtaccatttataaggaggatttcgaatttaaatacatacaataactattttattggacaaaaaacaaaatttatgaaattcttttctggcattgatttgtttcgatttttccactgttcatcacagttaacagaacgtgaaaaattgaacaaaaagtgatataaaaaaatgtttattgtatttgtaaatcatcgtaaattattactttttaaagtaataaactcttaaataaatttttaaataatcattaaagcaaaaataaaaataataaaaaaaatgatcggaaattgtcagttatttttaaaatattaatatatgggaaaaaacaattctgctataattcatttttgaaacaaccatttttgatagaaaataattataaaaatatattttattttttataaataatacccagattttagtgaccgaatgagaacttttaagatgataatttaaaaatccttaaatcaaaaataaatataaaattacataaattattaaaaattgcgattttcaactgtttgtccaggtaagcagtcaaaaaacatgagtttaaagtaaataaaaaagcgatattacaaacctaaaataataaaagtaaaaaataaatgtaaaaataaaaaataaaacagaaataaattttctagtgaacaaaaacgaaaattttgtaaattttcgaagttatttatataaaccaaattaaatcatttcaatcactccaaaacattaattttgaaattatttccgggttttgataataaatttttttactaaaaataaatcaaaaagtaaaattatttaaaaacaaattacttatttgaaattgttagggatgcaatttggccaccctttggtggcatttgaaaaaaaattatgaaatccaaatcccttttatggcattgatttgctttgatttttccacttttcaaaaattgattgcaaaatataaaataanataanaatgtaactattgaaaaaagaagccgtacatcanaaagtanaagaagccgtcgtacaagaccaagtttacgattacttgggacatgagaatattaaaaaaataaaaataaaataaacataataattttgntttacaaatataaaacaaaacccaataaaagaaaatatatatttttt

SEQ ID NO: 40194 - DNA, 777 bp, Heterodera glycines
tttttttagatatcaaatttgttcagtttagttggaaatgacgcgagttgtggttgatcaaaatcaatgaaaaaaaaggcattgaccagtgtaaattttgaattagcgcgcaaaaaacgaaatgcaaggaaaaaagcaaaatttgtggagtttgaaaatgattcacgcattaaaattttggcgtatttatacgctcagaaaaaaattcggaaaatctgaccatttattttatttttctgcgtataaaaggtgctgcatttttcaatccgcaccattgtccttattcctaaatattcaacaccggcagcgtgaccattctgcgccagccacaaattgcacagcgacacatcccatcctgcgccttcgccacggaccgcaacacatcgctggccaacatcaagcgcaatggagacggacgaacagatgtgggacatgccctactaccacggactggtgcgttttggtggttaatgcaattttgaccactaattcttttgcttgtttagctgccgcgagaggacgtcaacgatatgcttgtcagagagggcgacttcctgatccgcatgagcgaggagacttcaggacaggaccgcatctacgttctctctgttaacagcgatggacggcaccacctcatctttcgttccaagcgtggaatggttgcggtggacttcaacagttggacggcagaaatgggagctcgcacattcgaccatcacgcagggcgctgaactgggcaagggcgcgttcggcgttgtcaagcgtggcgtcttccgt

SEQ ID NO: 40195 - DNA, 277 bp, Heterodera glycines
ttgtttaaaaaattgttaaatacgctttggccaaaaaattaaaaatttcccatgggcacgcaaaaatgcgattaaattggcagagtgaatagcaaaatcgaatttgctcaatttccaacggcactctttttggcatttcggatggaaattggcattttaattcttttttaaatttcccaatttcagaataaatttttgttcatcattaaaaagcttttcgaaattaatttttaaatcactccgattgccccgcccctttccctctccccctttctcc

SEQ ID NO: 40196 - DNA, 1310 bp, Heterodera glycines
aattccttttgcaaagcgttaatttcacaattaaagaatttggaccttcgggtgatatgtgaaaatggatatttacagggaattactgaaattgaagaaatgcgttcaaagcttttggctggacttgaggaaagattcggtcatttggagaatgagaagtgtgtacatatttttaaatttcttttaaatttcttttttagattacatgctctttcaacattcttggaccctcggcgaacaactgagtattaatggctctgagcgtattacatctgaacatgttgaaactgtgtcgctttttgttgttccacctcctcccaaacaacgacgtacattacttgattccttgtcagaaatggcctcaaccagcaaatcttttggtaatttttaaaagatttcttttattatgcatataaaatttaaagtgcaaatcgaatcgacatttgacgatgaactcaaaaaatattgttcggttgatttgattgggcaggaattggaccctttggattggtggaaaataaacgaaggactatttcccattatcgctgcgcttgcaaaacgatatatttcggccccggcaacaacgattggaagcgagcaacttttcagtgttgcgcgtgatgtgtttgactatcgtcgatcaaaattgaaggctgaacatgccgaaatgctcatttttttgaacaaatcaattccgaaaattcgattttattgatttaaaattttgcttttttattttttctttaataaacgtattgccgctcaaaatttgtgcattaaaaatatttttgtgttataattaaatttttgaattactcccgctcccgcccgggaatcccgttaaaaatggacgggataagaacgggatcgggagtataacgggaatcccgttcgggactacctttcccggcaaattttggactaccgatcgcgctcccgctccggaaatttttttttaccggactctatggctaacatcccggagcacactattttagccatattcatgttaacttgtattggtacttaaatcagtagaaagcaatcaaatatgttatcaatctatgttttcctcttatttattggtacgagacttaaattccgtagaattcgtgtacatccgcgatttgacaggccataccgtaaaagatttgggtaaatagtaattgttttggtgttgataaagttcagataattactaataaaaaatctcaatcttatcattttacgagaaaaagcatgcgacgagggaaacaatggaatatttcaaagaatagcgacaagattgtacacgtgaaatcaaggcaaaa

SEQ ID NO: 40197 - DNA, 1485 bp, Heterodera glycines
  misc_feature (1422)..(1422): n is a, c, g, or t
cagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccnaatgacttgcgcatacgctaaacacgttggtccgtgtttcaagacgggtcgaacagatgaccg

SEQ ID NO: 40198 - DNA, 1658 bp, Heterodera glycines
tttttgcattagaatatggccactgagctcggcacggctcatttcgcgcaacttttttggaatttcatcgccccaaaaattgtttccaccgccctcacggcttggcttcatcacgtaattatcaggatgagcaatggcatcctaaagaaaattagatcccgtattgaggattttcgggtttttgttggattttgcctagttttcgagactttcacattcctaatccagactcccaagttttaaaaggtggtaagtcattgaaaaataataaatttcacagcaattaaatgaacattctgtccaatccaaaaattcccttaattttctaaaattccgcctatacatttcttattttgattcaaaatctattaagaaatcaaatagaaattctgttaaaagtcaggcccaagcatcaacaatattacccaatttttgggtaaaaatattaaaaaatcgtcccaaaatttttcaaataaaaatttaatttcaaagacatttgttctgaatttgaaaaccatcatgatgcttatgataattacctgaatcacacgcttggtgttctcattatccgggtcatctaagccatacaatccggtgaatgttttgtgaattgcagtcactttgtacgcttcatttgggtgcgggaaaaagcgttccaccatcccgggctttgcgagaatctgcggagaaatgaagcaatttgcaacagcatataatcatcttatttaataattataaataatttatattttaatgtgttatttatatcaaaattcataaaatcacctgctgaatcttcttttgacttgcaagtgcatttgccacagttggtattttctacaaatgaattaaatatgattttaaattatctttttttcattagaaaattgcttttgattttttaatacaaaaattagttaaatttggattttttggtgttatttttacaaaataaacaattttaaacgaatataagttgataatttttaaattttgtagctttaaaactgttaaatttaacttttacagtcgttttacataattaaaatttttttttatgcaacataaaatcttacaattgctgttgatcgttcgatcataagccgagcgttgaaaatgcgttcatctctcagggaagaaattgatcggtagaaagcaattgcaactttttgtgtgccataaagcaatgaatggtcattgccttgcgttagcctgaaaaagagtgctattttacgatttttttaaaacaaattagcacacattttggattggctaattaattagcgtactcaaataaattaaaagaattaattatgcttaaattattatttgtaaaatgcctacttactcttcagcggcttctgttaatgacatttgaacaatttttattttattttttgaaacattttccatcaaataattcagctgatattgttcatagtttcggtataatttaccagcgacaattaaaataattgcgtctttgtcatcaaactttttcctttaatttgattaagaaattaaacaatcaataaatatataaactaataataagccttatataaccaaagaataattattgtatttaattttcattttaaattaattttaaatgtttaaaaaattaattaatccataacttttttttccattttata

SEQ ID NO: 40199 - DNA, 824 bp, Heterodera glycines
ccccccccctctcccctccccctgagaaaccggaaatgaaatatttgttattttggtagaatttttggcaatttttccataatttatggattcaacaaattgttcacgtgccattcgtaggtacctttagcagtttgacacccattcaaatgatcaaaaaaaaaagcattgcgtcccttcaggggtcattttccctttttcggccatttttttattccaacaaatttgttgcattggaatgctgtatatgtatgtttagaaagctccctttaacaaaccgaccaaaacataaataaataattaaaaagtttattttttaaataaaagaaacaaaattttaaaaaaatatctaaatttcttaatgattttaaatgttctattttgaaaaaaaaaatttatttttaaataaatttctgtttacaattttttgcatatttttttgacattctgcttttgtacgttatgccatgaatccaaatttggagtcttaaagttggtcggtacgttttggtgcgcacaattcaatttgacccgcttcactttatctccgcctcagcttatcacagcttatcagcaccattataaaaaaaaattgtgtaaaaatgcttttttaggaccaccaccaacacaaatccatcccccgccccgttttttcccacaagcaaagcaggggacagacatatgacaaagcaaaagcatgggaatggggtggcgatggcttcttcttttccttatgtcccctccctccgccgcgccgcgccgcgccgcgccgatttttcattttttacaactttttccaaactcctcgcgaagaacgacgtccc

SEQ ID NO: 40200 - DNA, 1017 bp, Heterodera glycines
aaaaaaaaaaaaaaaaaaaaaaaaaaaaaaaaaaaaaaaaaaaaaaaaaaaaaaaaaaaattttttttttttttttttttttttttttttttttgttggggggtcgcaaaaaaaaaaaaaaaaaaaaaaaaaaaaaaaaaaaaaaaaaaaaaaaaaaaaaaaaaagggggggggggggggggggggggggggttgttctttttttttttttttccccttcctccgggggggggggggggggggggggggggggggggaaaaaaaaaaaaaaaaaaaaaaaaaaaaaaaaaaaatattattttttttttttttttttttttgtttgtggccgcccccggaaaagagaaaaaagaaaaaaacaaaaaaaaaaaaaaaaaaaaaaaaaaaaaggggggtgggggggggtggggcgggggggggggggggtttgttgttttcttctctttttttctcttccccacaagggggcgggcgggggggggggggggggggggggggggagaaaaaaaaaaaaaaaaaaaaaaaaaaaaaataaaaaaatattttattttttgtttgtggggggggggggggcggcccgccccccccccggggggggggggaggaaaaaaaaaacaaaaaaacaaaaacaaaaaaaaaaaaaagcgtgggggggggggggggggtggggggttttttggggggggtgtgtttttttccacaaaaaaaaaaaaaaagggggcggggggggggggggggggggggggggcccaaaaaaaaaaaaaaaaaaaaaaataaatttttttttttttgggggggggggggggggggaaaaaaaaacaaaaaaggggggttgtttgggataaaaaaaaaaaaacccccccctcccccttttttaaaaaaaaaaaaagaatacaacaaaaaaataaaataaaagggggggggggggagcggggggggggggggggggcgcctttctcttttttttttttttttttttttctcccccccccccccacacaaaaaaaaaaaaaaaaa

SEQ ID NO: 40201 - DNA, 820 bp, Heterodera glycines
ttacctgtaaattttgcaaaaaagaaaagacaattcctttcttttgtttgtgtaaagtggaaaatcatgtgagcatattttaaaaatatttacattttttaaattttgtgcttaattagtcattcattcatttcctcgtcactcagtccatcgttaatgcgtttggctctgtccgccactttttttgcaattcgtttgttcaatggcattgctttgtcacataaatggcaccgtttgcggcacactttggccatttcctcgtaatagggctgaaatgtgcaaatttgaattcgaattttgaatcaattgtgattaaatctgaacaaatcacacacattcacttccaagtgatcgggcggtggcggttcgcacgaactttcatcggcgatctgacaatcgttggtcagatcagcacattttgctgtggggaagggtgatcacttcaatcatttccaaattaaaaattaaatatttatttcctacgtgtgcagaatttgcaagtgcgtgcgcacttttgcatgtcctcctcgaactccttctggtcgcacatgtgccttagtccgatgcatccgtcctgagtgtccgcgcacgcgcccgtcgcgcacagaccgcacgtggacgcacaagtcgtagacatcggaaagaaactgatcagaaaagagagagtgtgatcggaaatccaccggcgggggttagctccgcacgaccaacaccgactctcacagcgattagccccccccccccgacgttttcgattcgatcagtccaataaaaaaagcaaaattactttaccaatcacttaccattgccgtcatatttt

SEQ ID NO: 40202 - DNA, 1402 bp, Heterodera glycines
caagttttcggcacggaacaacacatcaatgcatggcacgggaggaacatttaataacaatgccgtacaacaatatcaacaacagtcatactgtatggagatgaattacagtaggcagaagatggaacgaagacgggctgaccgtgtggtaccaatggcaccgggacaacctcagccggcacaaatcctcatccgccaagttacgccagttgagaatgtaaacggcaggcctagaacatcgatggcacgcttttgagaagagtcgagaaattttttgaaataaattacgattcaacgaagtgtgtgatttgtcatttttttctgaatttgtcctaattcggagtgagtcatatcttaattttatttttatttcattgattgtaattatttgaagaagacaaaaacccttgattccaagttttgtctattaaattaatttaaaatctcattacatcattattttaagtgaaataatgaaattttaaaatatttcaaaaatattcattataaatatactcaaaaactcaaaagttagcagatttttgaaacgaaatctattttttagttttacaaaattcttgattattgaaatctaatttttgctataatcaaaatttttaatccattagagatgagagattacaattgataaaatatctcttttttgcattggatattattttgggaaagaaaaaatagcttggaaaatgcccatccaaaaggagccgtattggagccaaaatcgttttgtgctcggatcaacaaacaaattagggtcgatggcattgaagttgtctttttcgttagattcaagtatctgaaggatttctgagtcaggcagggtctggaaatctagattttttggcttataattggatcagaatttgcattcagtaaaaatccatgaaaatggttaaattcggaaaatagattccaatgttattcactagattagagtgaaacttttttggtattctgaaccgcctaaaatcagtttgagatcatgatatccagtaattttcatgcaaataaacttaattctaattcgggagacaagattgaattccatgatacgttattttcaagggatcattctctggatctatactaatctaaacaggatgttgccactttgtacgacttacccatcctaaatcttgccaagtgcccggccgaccactgctactcactgcccgtccaatcaccgcggtatgagtgagcttttgctgaggattcattaatgtgccgtcaactggcacgcagtagaaaagccaatatttcttatccttgccctcgccgtacggccccgaaacgtcgggtgcccaaaattcgttgtttcttgccaaccttaacaaattcgttcatgatgatttgaatgaagggatttcggattgtgccaact

SEQ ID NO: 40203 - DNA, 60 bp, Heterodera glycines
gcccataagtaacaagccaggataattttgacattgttacttctaagccctagatctcgc

SEQ ID NO: 40204 - DNA, 1536 bp, Heterodera glycines
cgtatcgatcgtcaaatttgcacttttcgtcgatcgccaaccacggttttttgactaatgacccgcaccgatgggacaatgaaatggaaattcgggaaaatatttacctgaaaaggggaaaatttaggaataattcaacaaatttataaaatttaattatttgagaaattttcattgttcctccacaggattagcttatttctttcctccgggctgtctgtctacctttgtccgctcgtcaagtcgcttccggtgacaaaagcataaatatttctgcattcatagtttagatcagggcctgtcagatgaaaattttcaaaatcattatttttctaacaaaaaataagcattttgaaaattttattactatcaaaaaaatacaataaaaagtttttttgcggcgcgcttttcccaaaaaaactttttggggacaagttttcagcggttccgaaggcgtcgccgggcaaaattttgaaaagttgagtgcaatttgttaacagattttcacaaaaaaatagtttcaatgaaagaataaaactaatgaggcaatgtaaaaagcatttaaaaatgaaagaattagtttttataattataaaggagttataaaataaatgttttaatttgatatcgaaaacggattataattagaattaaaaagtgaaaaaacaaacttattacacatcaaattattacacaataaaagcaaattaaaagaaaaaaatatataaaatgactctaaaagatttaattacgtcaacggcccaaaagaatatataaagtaacgaagattaaaatttcgtaaagaaataaaaaaataatttaaaaaaacattaattactaacaatattttctaataaataaaatgataaaaaatgattaaaaatatatataaataaatattaaaaatcgatatatgcaattaatagtattactattaaattatttaatgcacaaaagaatataatttaaataaaaaaaattcaattaatgagaaatattcgttcaagggtatacagaacagatcgccatgataatatgcgctaaatcagaaaaatgattattcaaagcattaaaactaaattatatttagtcaaatttattttaaaataattaatttgtttatttaattaaattaaatattaatttatttaattttcaacataaaatacattttgattaattctttaataaattttcaagtgtaaaattttgggatctctttttaaattaaattttgcatattcgaattctttattttaatctaaaaataatttttattaaacctttttattgagccaatttagataataaaaaatatttaataagtttaaaaaatttttcgactcgtaaaaatgtatgttaaagcttaagccaatcaatcataaacacatttgttaaagtgcaattattttaatatttagtaaattaaaaagtaaagcgcgcgggttcaattaatattataataaaagtgctaaaaatagacttcgaaaaaaaaaatgattcaaatttcaatagtttataaattaaatatttcaa

SEQ ID NO: 40205 - DNA, 681 bp, Heterodera glycines
ccctctctccctctctctctctctccttcttcctcttcccccactccctcttttccatctctctcatttctcctcatctttcgcttcacatctctctttctctccctcttcctctaccccaagtcccctttttccacttcctatgggaaaaattttaattttgaactaatattttgtttattttatctgataaaattttccaagaaattcactcccattgatcgaaacatttgatattcctattaagattaaggttaaaattatttttctcaacgagaatgaaaattcttttctcaaattaataatttgacacattaaatagaattttatttattatttttcgtgaattataaatttagttttaaaattgaatgggttaaatttttcaaaaattttaataattttatgaaaaacgttttgtctttattttggcaatttgtaaccggattttttcttttatttcctccattcttttggaatttttagtccatattattttgggttttgaccatataaatcggctctggtattaatttggatatagcttgtttttgcaaataacagaagctttatgccaaataattattttctgtaaatttaaatcatttcaaaatataaataatttaattaattggccttttgtttccaagcttttttcccattgattttttctcatttata

SEQ ID NO: 40206 - DNA, 991 bp, Heterodera glycines
  misc_feature (5)..(5): n is a, c, g, or t
tttcntggcgtagaatagccatttgaaaattctctgtgaattaaaatggtcattgctctccggcccttgactcgctttttggagcatttttgaacacaaaattactcagaaaaagaggtagccatttttctggcgtagaatagccatttgaaattctctgtgaattaaaatggtcattgctctccggcccttggctcgctttttggagcatttgttgaacacaaaattactcagaaaaagaggtagccatttttctggcgtagaatagccatttgaaaattctctgtgaattaaaatggtcattgctctccggcccttggctcgctttttggagcatttgttgaacataaaattactcagaaaaagaggtagccatttttctggcgtagaatagccatttgaaaattctctgtgaattaaaatggtcattgctctccggcccttgactcgctttttggagcatttgttgaacacaaaattactcagaaaaagaggtagccatttttctggcgtagaatagacatttgaaaattctctgtgaattaaaatggtcattgctctccggcccttggctcgctttttggagcatttgttgaacacaaaattactcagaaaaagagatagccattttctggcgtagaatagccatttgaaaattctctgtgaaataaaatggtcattgctctccggcccttggctcgctttttggagcatttgttgaacacaaaattactcagaaaaagaggtagccatttttctggcgtagaatagccatttgaaaattctctgtgaattaaaatggtcattgctctccgtcccttggctcgctttttggagcatttgttgaatataaaattactcagaaaaagaggtagccatttttctggcgtagatagacatttgaaaattctctgtgaataaaatggtcattgctctccggcccctggctcgctttttggagcatttggtgaacacaaaattactcagaaaa

SEQ ID NO: 40207 - DNA, 1017 bp, Heterodera glycines
  misc_feature (27)..(27): n is a, c, g, or t
tgtgtcaatatggaagacgaagacgcncctgcttcggaagaggtcaaaatgttccgaagacgcgaatttgcttcgcgtttttgtttccgctcttgaccggtcgttaaatatctctttctaggcataaaatagtaataaatttaatctgaaaaaagaaatgcctaattataacagatttgtttccaagtaaaaccaaaataaaataatttcaaaatttatcgaattaaaaatatgatttatcgtcagttaaggaaaaacggtattgtgaattaacaaatgaatagtgaagacactaaggaaatgtggagaagaatagattgcttttatgctggtagaagagacgaggtcaaagatcatagtgagtaggatacgcatcaacaaaagagaaaataaaacacaatcaattctcattgagaccatagacaacaaaattaacctttttctctttttttactcattaaacttcattagaatgaaaaatagaatttgaaaattttaaaaataaaatagctataaatgaacattggggactcgaacccatgacatcacatctataagggcaggcacactaaccacttgaccaccaagttacttgctcacatcccttttaataaccttttccctttctttctttttttgaaaaaatcctgatcaaaagtgcttgagctccctttttagggcacttcccggacccggacccaaacaattttggtatcattcgaaagcccagactttgtagactgaggcaaattgtttcgattttcgatttgactatttttaaggtatgcaaaaaacgttcaaaaatggaacatctcaaaaaagtgcaaattttgactcgtttttcgaacacagttcgaacaattcttaaccgattgggatgccgataatttttccttatagcccttaaaattccacgtcgattgaccccactctcgccccgtaaaactcgctagaaagccttaaattagtttttaagtgagttagagggggtagattcttcttatatagggaatatat

SEQ ID NO: 40208 - DNA, 85 bp, Heterodera glycines
gcggcgtggaagcaaggcaactcgatccagctggatcctgcagcgctggcgttcgtgtttacgaccacgccgcagccggcgtcgg

SEQ ID NO: 40209 - DNA, 82 bp, Heterodera glycines
cctcaaggggccgagggtagcggctccactggtcccccgccgcccgccattggtcaccttggcggtaccggcgggcccagcg

SEQ ID NO: 40210 - DNA, 867 bp, Heterodera glycines
  misc_feature (741)..(742): n is a, c, g, or t
  misc_feature (807)..(807): n is a, c, g, or t
tttcatagtgaggaacggccccgtgggttcgaatcccaccgggcgtgttacctttaaatacccaaaccctggctttaacacaaagcaaccaccagcagggcacgggtttgggtggatgaagaatgccgaagaacaacataaaaataggcgaaaagtctccgccaaaaaagagttaaaaaagtgccaaataccgtacccattcacttgctgaacacagtatttgcttaattaaatgtatgattctcggaaattatttcccatgcacaaaaaaacattaacacgcaacaattatgtgaaaaggcaattaggtattttccgagaaaattaaggtaatgccgtgacagtgaataaaagcataaaattgcatttttattggtatggcactcattttttttatacataaaaacttactcaaaacacttaattttggttatatttcaattataaataaaattattcaaaattttatagtttttttttcgaataaggacaatttttaaaccaaaatttttttatgaaaaaaaaaattaaattatggcgatcaatttttgaaaaatttttcaatttatagggggtttattttcagaaaaattttcgggacgtttcttaggggttatcttttctttaattgcatttttgttaggatttttccaaaaaacctgaaaattggcacattaagcacagaaaaacgaaataggcaaaaataggcattagaaaagtcagcgtttaatgcccaaaccnngcgcaaaacgcgtctttcgtgcttatttgctgagcgtatgaaaagaaagctacttataattattnaaatttattcagaaacaaaaatttcatttgatttttaataaattaaccggttttgaattc

SEQ ID NO: 40211 - DNA, 1072 bp, Heterodera glycines
ggtgctaggtcgaaccgaaaatagtctcagtgtgggcgaaccgaaaaattgtctcagtgtggtcgaaccgcaaatagtctcagtgtgaataaaaatatttaaatttaattatacgatttactaaatcatgtaattatataaaaaaataatagcgtgtgaatcaattttgaagtcattttgacattctaatctaattgaatttttaaaatttattttgggaaatttcatcaggtttcttttaagcgtttttcatttttcatttggtacacttatctttgacccataaattttattctttcgaattattcaagttaattcaagcataatgtaatcttatgatatttgtggaaaatttaaaaaaaacgtttataaaattattttttatataattatatgatttagtgaatcgtataattaaatttaaatatttttattcacactgagactattttcggttcgtctcagcacgtgtaaaatttaaggaaattatattcccaattgtttttgcctgcgcattgctcccactgattttgtacaattgcgttcggatcggatagaccaagtcgaatgtgcgttcgaattggcccatttgaaatgccacaatgccatcgcacaacgatttgcccagcagacgcgtaatccgcgcattgtccccggtaccgaaactgaacaaataattaattgttaccatttcaaatgcaaaaaatgcctgtcaaactgtgaaacattctccgagtgttccgtggccaattcgctcagtttttcgtttttctcaggacggttcaacaccaaagcgatgtgcgcgtcgctgaatgccagcagctgatcggcgatgtgccgttccgtgagtcctattagcgcgtgccatcgttcatttccaacttcgacgccttccaattcgagacgagctaacaaagaagcggcatccgtcagactgagccaagcgccacccgaaagggcacggtcgagcacctcactaagagagagagaaagagagacagaggaataatttcacagaacattggcgaatttgcgatttattaaatgaatagccaccaacttgtcataaact

SEQ ID NO: 40212 - DNA, 1491 bp, Heterodera glycines
  misc_feature (94)..(96): n is a, c, g, or t
  misc_feature (1424)..(1424): n is a, c, g, or t
cctttcactcacattgtcttttcgttcgtggcatcaaactgaatggacaccaaaaattatcattgtacaccaccgtttgcgtttgccattgggnnnggcattcattcttttctttacctgtccatttcgatgtccgcttcactaaagctgacaatgaacagcaaagtgatcaaagagaaaaggctgagggggatcaaaagggacgtgcgcattttgggagaaattttgtggttcaattgccggcgaagttttgcgggaggcccttttaaagcgcgggggggggggcgagcgaagaccgacgaacaacgattcttcgagagaattgcgcgattggctgccaaacacataacgaaatgagtgtaacaggccaatgatcggccatttcatttgcaatatcttccgcccgcatagcaaacaaggcgaggtccgaacaatctttggttttaaaatgcacaaaactggttcaactcagcggattaaatgtcaaattaagaattgatcggaagatgggacttttctttttgtgttttatagctcggtttccaaaccaaagaaaaaagtatgggcgaagagttgtaaaaagtatggatgaacaggctttggggggaagggccgtttcagctcgaataatcaaatttaattagttagatttcagggctccgaatccgtattcaggaacttttccgggtccacctttttaccccgggtgaaacttcaataattcacgtgccccccggatttacccattatgtttttacaaatatcgaatattaaataataaaataaatcagttagtgatattaaatttatcaatcaatatactaaaataattaaatttaattgagaaacggcacttcccttcagaaccctcacatccattcttttttcgcttcgtcatagcacctaaccggtaaagatgtgcgagaatttttatgaaaatcaagatgagaaatttttactaccgaaaaccccgatccgactcattgttaacaaacaccacatgaaaatggcatttatatgagggaaaaggttttttttcaattttgttatttctgctgactcaaaatagctttgaaatggctttaaaaatacggctttgtttaagcttctaacatgcatttttatttgacttttttctactttttgggatttttatgatttttttgcaccaatcaaccctcccccattttcagtggtgcaaaacagggatggaattccgaggcaccaaaaaatttcggaagtcggaagtccgaggcccaaaaacttttcggaagtcggaattccgaccccaaaaatgtcggaagtcggaatttttcaaaaaataaaagaatataattaaaattttttaaatatttagtaggctaaattttaatgatttcaaactgtttttaatatatttatttgaaaattttttaatgattttncaaatatttttatgtaattttacattattttggaattttttttgggacccgtacacccatttttttt

SEQ ID NO: 40213 - DNA, 1062 bp, Heterodera glycines
  misc_feature (42)..(42): n is a, c, g, or t
  misc_feature (803)..(803): n is a, c, g, or t
  misc_feature (806)..(806): n is a, c, g, or t
  misc_feature (828)..(828): n is a, c, g, or t
  misc_feature (830)..(830): n is a, c, g, or t
  misc_feature (832)..(832): n is a, c, g, or t
  misc_feature (835)..(835): n is a, c, g, or t
  misc_feature (850)..(850): n is a, c, g, or t
  misc_feature (864)..(864): n is a, c, g, or t
  misc_feature (881)..(881): n is a, c, g, or t
  misc_feature (894)..(894): n is a, c, g, or t
  misc_feature (1015)..(1015): n is a, c, g, or t
  misc_feature (1025)..(1025): n is a, c, g, or t
aaaacactattttaaaaaaaaaagtaatctaaaaaaaatttnataaaaagccgtaatccatgagaagagctgagacgcaagactttttaaaaatttttattgttcacctaaaaatcgattaagactttctattaatttaaaagccaatttcttgacgcttttcctaacaaatttttgcttttattttaattttattcaattagcaccaatttataaatccaaaaaactcaagttttcattatttaaggactttcatgtgataatttttgaactgcttcaattttgcggatattttattttttttaaaggattccaaatttctgtgacgtcttctaactgtgtaattattataaaagtgatttgaaaattgagaaagcccttcattaaatttgtaatatttttctccttaaattttgaatctctaaacagattgttttaatttaccaaatgaaataaaaaaagaaaatcatataaaataaattaataagctcaaaataatttttttagcaaaatttaaaataataaataaacaagatctaattatattttatgaaatcacatatcaaacacaataaaacaagactgaacttttaaaaaattttaatttaatattttattatataagactaattttttagccttaattaaaataaataaacaaaataaaagataaaattttgtttgttagaataaaaaaacatcatattccaaaagggagattataaaattaatttaactgattaaaaattaattaaattaaatacaaatttaaaattaaaaaaataaaagaaatcaataaaggnatnataataaaaaataataataatntnanatnattgataaataaatnaagataagaaaagnagggtaaattttatttngatttgggtgtgnaaattagaatataaattaaggaattaaatattatatatattttaataatataaaatatttaatgaaaataatttatatttgaatatgaatttttaattatatttaattttattaatgtttnattaatattnattaaagaaaatttaatagttatgttataataaattt

SEQ ID NO: 40214 - DNA, 1179 bp, Heterodera glycines
aaaaaagaataataattatatacttcaaaaaacagaagatttaacatcttaatattttataacaaggagttaccattgagaaaataaataactttaaaaaacataaataaattttatctatgagtgaattatcaaaataactcaaatgtgtactatttgttcccgtttatctctaatccttattgacacaattgtggtttgatattcattaagctataaacgataagatttattttcgtaaaaatattaataaatgaaatattaaaaaatgaattatgataaaggttttcaacatacttaaataaagaataaacaaaaatgaaatgataccagcattaataattgaattcttgtggaatgaatgacattcaacaattgaaaaatttagccaaaaaataataaaaatatttttatttaaattttaatatttattttcaaaccatttagacgaaaatcattttttattataatttataaaactaaaatataaaaaatttttgtttgttaattttaaatataataaagaccaactaaaaaattaccaaaattactagtaaatcaaattcaaatttataagtacaacaattttagcaataatgatatagtttaatgcagtttaaaagaataagggtacattttaaaataaaattgaatatgtttatcattctaatagaaacgatttaaataaaataattaatacaatcaattttaaaattaatcgaggaaatattaatagagaaaataaatattctataataatctcaaaataattttttaataaaaaagttttaaataattttaataaatcttataataaaaaaatgaataattatttaaataaacaaaaaattttttaatacgatattgattttaaatactaagaaattcatcatttacttcccaaattttcagacttcgtgcagcaggaaagttattcaaaaatttgaattttaaagggtacttgactactaattatgtttgttctatttattacaaaaattttgtaatttgagagagaatatgtcaaacaaaatcagcagaaagtttaaaaagcttaaaatatttcgaatggtataaataaaataaaataataaaaaaaatttaaagaaatataaaaatgaaaataaataaatgaataatatataaaatattctaaataacagctaaatgcatagataa

SEQ ID NO: 40215 - DNA, 906 bp, Heterodera glycines
  misc_feature (874)..(874): n is a, c, g, or t
tctttgaagaaaacaaaaaaacggaagaaaggcggtaatttcattttttgattaatttttattctctttgtttttaattaatttaattaattttgggtttttattttattacgctaattacttttcttattaatgatcttgatttacaaattgacaattgatttatttgccatagtaaaaatttgtttaaaaacagtttacgaatggaatgatacagatcgtcatatttaaatgttttttaaatatactttgaaacgaatccaaaagtgtgatattttttgccattgatgatagctcagaatgatttctgacttgagtttttctccactaaattttgcggctctgaattaaattacctcaaaacaaagattctttattttatatattcatccgtttaattcgttgaagacaaattaagaaagataaagaaatatttcaaaatccaagaaagaaatccgaaaattagcgacaaaaataattgataataaattgcaaattggctatggaacgctaagaatttggaaaaagaaattttcttaagttttggagagtaattctcgagggtgttaatttaactttcctggttttcttttaacacctataacttgaacgaaaattacttcagcaaatctcttaaaattaaaagatataacatttaataacaaattttaatttaaaaaaatataaaatattttgaagaattgatttaattgttcggtttacgtggcagattaatatttgtaaagataaataaaatgagatacttttctgttttggggcccaaagttgatttttttttaatcaacagcaagctaatagaattgcagatccattcgaagagatattaactcaaattatggcatttatgcctcangaaataatttggtgtgtagctttagcaattct

SEQ ID NO: 40216 - DNA, 1056 bp, Heterodera glycines
attacttttggactaattaatgccaattaacgaacatttaagagaagcgaagtgccttttcctttctgaaacggtcgtcggccattcgaagggattaaatgccgaaaaataaaagaacgaaatgcaaatccaacagcagacactttttgcttgatattcacatattttgcaattctcaaattcgttccaataaattatttccgaaatgccccaaaaaaaattggccaattaatcattcattaaataaacaatttatccattatatttggattcacatgttcaacataaagttcaaatgagttaaataggcaattgccccgcgaagaatttcaattttggacattttccggcccttcccctggcggtggtgggccgacggcggcaacaactcgcgcacatggccaaatgcgcgattgaacgcctcgactctctgccgttctctgttcgcgtgtaaactccgatattttggagtcgccctaaaatgttaaaataatcccaaaatttgttgaaattaacggcaaaaccttctcagtcggcgtctttccgcccgtgccaatgcctttttctgctgatcacatgccatttgacccatatttggaggaaatgaacacaaatgaaatgaattcgccaaagcggcaaattcattttgcatttttcccccgcggccaaattaaattctctcataattttccctaagggaataaaaacccaaagcgccacaaattgaatccaattagccaattcaatccggcgaagctcttcccccatggaaaaaattggggggggggggggtgggggaattcatccatctcttttcgtagtttattcctttgcctcttcctccgcctcaccgcctcatcatccatcatttatttgtcatcattaacttcgtaatcatcatcatcattcatcgttttgatcatcattcccccccccctctccgccgcttttctctctcatcgcagccgaattgtccccgtgccgtcagcctttttctgacagattgttgccgcacatcgtccgacaacagcttaaagcattggtcaatgtttttgt

SEQ ID NO: 40217 - DNA, 1015 bp, Heterodera glycines
tctagagtcttatggcaaatatgccttaatattttttaattctgagattttaatcggaatgaattggaaaatgagcatggaaaagtcatggtaatcgggccaatgaattttaggaatcgtaaatcttttggcattttttgttttattaaaaaaaagtttgatcatataaatgaaggtcgaacaaagaagacattcaaatatagtaaaagtagaaacaatgaattttcgtaatttgtttttttatcaaatatttaaaaaatattgaaaaactctcaacaatttataaaattaatgtcccgccggcgtttccatccgatgcctttggccaaccgttcattgcccattttttgctttcttttcaaacgaatgcttttcctacgtttgtgtgctgtgcgtgagtgagtgtttgctgtactgcaaatttttatttaattataaattatcatcggcagatgacttaattaccaattattattgtccatccctttttctttttttgttcgggagggtaaaatttatgttttatgtaaattaaattactgaaaatggtcgaaagaccgtcaaacgaagatgaagatgaatgggttcattcatacgacattttcacattttatcaataaacaaatgaatttttgatttttaaaaatgactaatttagtatattatttaaattatgaatgacagatttttatatccgaattttagcaaaaggaaaattaaataaaaggagttgcctaaaaagaggtagaaacataagtggcattttataataaaatgacaaaaattttgaactgctctgttccacaatgatgcgcgctttactcagcatgtttttttgttttgtttttaataaaatcaaataataaattgcgcctgttaattataaattaatttaaattaaaacatttttaaatgctgacgaatgaatggaatgtttcagtgaatgccaatttgtttattatcatccatccgtcattcctttctcgcccatttaccgcactcattgtcagtccat

SEQ ID NO: 40218 - DNA, 1112 bp, Heterodera glycines
  misc_feature (36)..(36): n is a, c, g, or t
  misc_feature (932)..(932): n is a, c, g, or t
aatcgattgggctgactagactgcatatttgcaganatagcaatggcagtctattcttaaaggcctgacgagttatgttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagtagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgattttcaaatttagtcgaactatataaatttttcaaaaaatgattcatcttttttatggttagcgcatatgtctctagctttatagaaacggtccccgaatctgcgaggaactacttttttgataatttctatagattattattctgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatntttttttacattgaagcatttggatggcttgctgtttacagttggctaagtcttctttgcaagaagcagcacaacttttgtttgggccaacgacccaaaccattcgaatagcatcgattgggctgactagactccatatttgcaggaatagcaatggcaggtctatcttaaaggcctgac

SEQ ID NO: 40219 - DNA, 857 bp, Heterodera glycines
tatcgaaaaatgtaagtgctaccagaatgcaagcaaagtgtgtctacattgtcgcatgggcatgaaaaaacactagaatgtagcaaaaatatggaacaaaaataattaaaattttaaaaattaaattaaaaataatattcgttcaaaattgcgacagtgatatgagaccattggtgaaaaattaaaataatctttgatttacgtaaaagatataaaaaaatgaataaaaagcaaattcataaaaaataacattttttacggtaaaaaatataataaatatttttttataataaaatttaaaaaaatatataaaagagacctgaaagaaaatttttgatatggatgtcgagcagcatgaattttatgaaagcaatcatcaaagtttattattatactaatttaaaaaatacgaaattaaattatttttaaagaaatattcatgccaaaattgttaaacatgcatggcataagaatccagtaatttattttatatgtatatattttttattcaagttcctcaaagaaataacacaaattagaattaatttgatttaaattaagaatccaacaaaatatttccaaaaaaaagaaaataataatatcattcctttaaatgcgacagcaatctattaattgaattctcaaaaattttagatatataagacaaatcatggattatcccgcaatgtaaaagaacacacaatgtttcgaaaacgaggaaataaattattaaaagatatagacaaaaatataaattcaacattaaattattttaaaaattaaactgacaaagtcagaaaatttgagatgtttgtttattaattttattgaaaataaataaagaagaaaaccttaaa

SEQ ID NO: 40220 - DNA, 1319 bp, Heterodera glycines
ccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccctcataaatctgggcgcatcggttctaggggactgccccgaaaacaaaaaaatctatttttt

SEQ ID NO: 40221 - DNA, 1260 bp, Heterodera glycines
  misc_feature (1227)..(1227): n is a, c, g, or t
gggggggcgcacccccaccaggaggccgcgaagaggccgagtgagtaccttcggcgcaggaaaattattaaattataaaatttttttaattgctttataaataccccaaaaaatgtaggcttatctttttgagagaaacttcgacccctcatattttttgataagggagcagaagcgtaacaaccttcgcagggatcctccccggtaaaggactaacttccactgaaatgagcgccgagctagctggctcaaaaaatttttcgaaaatctgagtctttcgtttttatttatttttcgcaaaattaattcttaaatatttttcagaaagggttctgaaccgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttctggagtagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcccccataattgtttgaaaagcccanaacggacacttgaaaaaatcgatttttttgttt

SEQ ID NO: 40222 - DNA, 277 bp, Heterodera glycines
tataataacgctgcggacatctacatttttgaattgaaaaaaaattggtaattactctttctttttctccatattgaccatcatactcatactccccccacccttttcttcttccgccacccacctcccccgctacgcgccgctcccctccctctcttgatagtttaaactggaggcgggaaacgacaatctgatccccgtcaagctagcttctgcaggtcctgctcgagcggccgcccggggatcgatccccgatctagtaacatagatgacaccg

SEQ ID NO: 40223 - DNA, 923 bp, Heterodera glycines
tgttgggcaaatctatgacatttaaaaaaaattaatttttttagataaattcgattaattttgttgcaattcccatttctttcttgctcacctgtttgtcactttgctgcacaaatttgacgggtttctgattctaaaaaaaaaaaaaattttttttttaatacatgcaaggtaatataaaaaaattcgttgacctgcaacagcttgaacatgccggtaccaatgcccatcggtgtgccaataatgatgcactcgctgacacccgaaattcggtcctgttggccaaagaaggcggcctcgtaactacaaaaattgtgtgggaattttgcggtgcagctcagcgccccccccccccccgactcttccgccctccccgaaaataaaaaataattctaacttaaaacttttttaaaagaaaatttctagaaaaatatttcatcataaaatttgacaaaaatcccaagaattttaataaatttattaagaaattagtccctaaatttgaatgaaaaatagtaaaccgagcaaaatcctcctgaaaaatcaggcacgaacccccccaaaatcgggcaaataaaataattcccggtttccaaggcccaaaaaaaggtctgaatgtcaaactcacaggtggtcaatggtccgctcaaatgaggccaacagcagcacggactccttcattttgaccagcccatcacgcgtaatgcccaacacttggccactgaaaaatttcaaaatttttctttaatttttaatgctccccgtgctcaccggtaagtcatcaaatcggccaacaattgcacgtgccgtctgtccaactcaatgccgtgttcgcccattgtggtcaaaatttcggaaatgattgagccgcgtgccgcctcaatgcccagcacttcggcaatcaccagggcattgttgaacct

SEQ ID NO: 40224 - DNA, 724 bp, Heterodera glycines
ccgccgggggaaaaattgagcattttgaccatatttttagcagattttcattaaaaaattctttattttgtggttttttggaaaatttaacaaaaaaccacaaaaagcctcaaaatttctgaaaaaaccacaaaaagcctcaaagcctcattgtgtgtgagagagagtgagaggagagaggaaaaaaatatagaagcgatataataaatttaataattttttttattaaacaatttatgtaaaaaaaaagtccaacattgaccccttgaaaacagcaaaatgatgataaatcagcagaattggcaactctgatttaatatacatatctatttcagttagaccttcaaaacattcaaagcaacactaaaatgatgcgatctattgctgaagagaaaggcggtttactttcttcgacattccaatttcttgtacaaagtgattcgagtgaattaaggtactttcgttagttaaaaaagtaatatttgcttgaagttaattgccaattaaaagatcattggcgcttttagaaaaatgattatgtttcaagttcctattcatgaaaaacttattcttttgcttctaggagtccctgatcacgaatctgaacatctattttgacctattactatttcctaaaacttaaatcgaaactaagtttatttggctcttattcagtttgtccccgcataaatttttttttaaatttctaagtaaaaaagtcaaa

SEQ ID NO: 40225 - DNA, 1082 bp, Heterodera glycines
catttgcttaaggtttgaccggctatgtgacggtggaaactgatcagaacacgcgggtgttcgttttgtccaatcgcaattatggccaaggaaatgcgctgcagattttcatgcaattcgcatgggtcgatggcaaattggtgggcttgacaaattagcaacgttctaaattaaaatattttctctcaatcgtcagaatgtgacgttgcgaaatgccagttctgtgatgtgggatacccgtggtggggtcattccccaggcggtgcccccgtgcggcttcgatggcaacggttgtaccgtatcggtgtttgagttgtacaaagtacgatatattaattactgtaacgttaacaattttatttgctattcaaaaggggtacttcataagcggaattgttctcttcgtgctaatcataggcagcagtttgcttatcatggtctatttaatacagtaagaaaaaaattgctgaagtattactgtagcctaaatgtttaaatttcagttcgaaaattgttgaaaaccgtaaaaccaacttactgtggcaaattccatttgcgatgatgaagcgagtgaagcaacgggtgagttttataattcatcccaaatcattttctaatttttatccccccccctatttaagcatggcgccgagcggagtcaccactccctccgttccaaccaaacgaacgtttccgcgctgacccattcgacgatggacagtttggcccagtccaaaaacttctctctgtacacttacaacggggacaagtgcattgtttgcacgtttgggtcaatgacagccgccgcgccattgtctgtcgctgaaatggccgagtgccgagcggtgattggcgagggggggggggggaaaggatactttggcaaagggcagggaccatccaagggggtaatggggtacgtatccccagcaaggataaagctcttaaaaaaaaacaaaaaatgccatttcaatttaaaattttaaataaaattttcaatgcccctattccaccacaaaaaaggacccggtttttggggctgattttggacgggcccaatgggttgggcggggggaactttt

SEQ ID NO: 40226 - DNA, 1250 bp, Heterodera glycines
gcagtccgttgcatgccaaaacggtgatctgtccaagtttgaataatggtaagcaaatgcctaattaggagcaaccgaatttaattaagggacgaaaaatttgcggatgagtcacacaaaagaggggctcgataaatgacaatttgtaagggatcgtccgtcattttcattaaagccggattatttggcaaaattctggcacaattaacttctcttaatgaccctcatttgataattctcagggaagtgatgtatgatcaaaacacaaattttgtttgtttacgatttaattaagtaaacagccaattgcttaaagtgttcggctccattggcactccgtgccaatcacccgccctttgtcccccggagatgtcggcttgtcgcccttttctcattgcccgccaaaacctaattaacctttttatactcattataaattgttgtaaaacacggagtgagcccaaaaaggtggtgttgtttatccccttctctgctctaatatcatttgctcatttgtccacctgtaatgccaaattggccggctcgtaagccatttgcagggacacgctgcccctggcgccgtccgggcccaactccaattcgggcacccccgtcgtgcccatcagtgcggcctctgctgctgcagtcgtgttgatgctgtgtcgtttacgctcgttgctgttcatcatcatcattttgttgttgtggttggcattatgccgttcttcgatgccctcgggcggtgcggcaccgtaagggatgaagttgagcgcggcgaacggactctgttgttgctgctgctgctgctgctgataccccgcggcgacggttccgtgcccataaggcgacatgggcgacaaggaatgtgccgatgcggccgacgacgagtaggaggaggacagcgagtagtcggagccgccgggcgacgagcacttgcgcagcgattggttggagcagcgcaagtactggcggggcgggcggcggtggaatcgcctgactcagccgcccgccggtgctgtgcccgccgtaggagcgcttgtgaataagcggcgagcggaaggagcccaccgagccgctgctgcggcgacgcttgcggtgctgaacggcggcgaacaacgccagaagcattatgaacatgcagaaacccgcgccgattgccaacatttggaagccttggaaattgtggcatttttaaagaccgatctaaataccctaatcaaaccgtggatggatgtcgagttcggtctgac

SEQ ID NO: 40227 - DNA, 1228 bp, Heterodera glycines
ataaatattttttagaacgtgctctgaaacgcaccaaatgttaattaaaagttaaataaggctctctgatgctttttctatcaaaagggagatgaataaaatttttaaaaatttttaattcctttttaaacaggccaaaaagtttaggcgtatattttaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataacatctttttaaaatattttccttatattttggttatttcgttctactttcggtggggtgcttggaaaattggaatcatgcgtacccgtccgatctgacaagttaagcaacgctggctgactagtcaaaaggatgggggccgtgatgaaacgaaaccagcactgcttaccccgcggcacccggcacggatccccgaaggaatggaattaattaaattctctccttcggggatttttttccattaggtcgaccgttagctttcgattggtctagtcaaatttttttatttaaaaaaaattaattaaggcactctgatgctttttctatcaaaagggagatgaataaatattttaaaaatgtttaattcctttttaaacaggccaaaaagtttaggcttatattttaaaaagtttcatcgaacttagcgcactaaaatcgatataactctccaaattttgcaggccttctccattgtaaaggactaacttaacctgaaaaaatgccaacgcttgttgtttttaaaatttttcgaaattctgactttttcatcaattatatattattttgcaaaattaattcataaatattctttagaacgtgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacttagcgcactaaaatcgatataatctcttcaaattttgcaggc

SEQ ID NO: 40228 - DNA, 941 bp, Heterodera glycines
  misc_feature (10)..(11): n is a, c, g, or t
aaaatctacnntttcttggcaaaaatttttaattaaaaaaatttttttaggtaattattttgggtttttggtcttacaaatcccagtcctactcatttgcaactgcaatcagtgaataaaaattattttggcttattttttggctgaaaattatgtcactatttcggactttttgtcactattttggcatttttactcactattttagttaactatttcgagatttttcgtcactaaaagttgcggccctagtaataaatgcattctctttttggtcatataacaaatgttgttgttccatttgtcatccatttttcgttggcaatttcccccatgtctcttcgtctcttcaactgatgcgtttcatcaatttcttggcccacatttggctgttgtgaaacattggcatatagcattggcacatggcactgaattggtcctcaatgtcgttgtaattggtcttccgcaaattggtcgtcacctccggcggcggctcgcacaaatttgtgtagcgtccccattcgctgaaagtgtcgccaaagcccctgcttaactcttcttaaatgggaaacaaaaacattaaatgatcatttttttgcatcgttcaccattacccatcaattcgtatgttttgtgcacttcgtggccacactggcgacatttgtacttcacctgcagcgcgctgtgtgtcaattcttaaaaattgtaaaaaatataagttatgttcagattcaccaagggtttttgacacttttagagttgcctcccgccctcctgaaaaatttcatttttttataaccacagagtgcaagccaaaagccccctcccccgtagttttttttaggagaccaaacgtaaagaatatccatttttttaatttgattcttctgaaaagttatgaagcatcaaagcagtatgaataaataatatgtgctttcgtg

SEQ ID NO: 40229 - DNA, 902 bp, Heterodera glycines
gcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagttgaaaaaaacgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaattcggggcagtccccccgaaccgatgcgcccagatttatggggagaccgaatccttccggaatagcttccctatagcctgcactttaattctgcgttggatttttgctccccataattgtttgagtacccccaaacggacacttgaaaaaaatcgattttttttgttttcggg

SEQ ID NO: 40230 - DNA, 581 bp, Heterodera glycines
ttgttaccatttttaatttcttcctcaaatggccatcgtccaattgcgacaatcttgatcgccggttcagtagtcctccttaacaggctgaaattgctaaggaaatgggcacaaacaagctgagtgagacagaccatggagaacagcgatttgcttcaaggaattggacgaaaaaagcaaacaacgaccacaatttgtgccgatgagcaaaaatggcattttcgaggtgccgaaatgttcgaaatttaatgcaaaaaaggcatgcgcttcctcatcaaagccaatgtaatgggagaaaaaaggtcgaatattcgtcgtcatcggaaattcttatttgtgcatttgattggaggatgattctgaaatctgaaagccgctttcattttaattccggctttcttggtccctgattttcggaaaaaacccgtttacgcgcaaaaaaaaattttgaaatttgcatattggcattatgtataatgctgctttttgaatggtgaaacattcaaatccatcgagaaaatgggtggcaagacgtttcgtcactgaaataatttttttttaaatgccaaatttccagggtc

SEQ ID NO: 40231 - DNA, 702 bp, Heterodera glycines
tcgttgtggccattcatgaaaatcgtctcaaaaatttaaattaattttaaaatataaatttaaatttcagttggatgagacagtggccgagagtttctacggcggtgtgctcgcattatattcaatttcgcaaataattgcttcaccgctgctcggctattggtcaaatcgtgttcaaagtcataaattacctctgtaagttgtcataattttaaattacaaataaataaaatataaaatattcacagtaattttaaatatttaattttcgcaaccgaaaatttgtctcaaataaataatacaaaataaatatgcacacacactgattaatgcaaaataacaccaaattcttttcaaaacttggagaccagtttacaggaaacgtacaaaaaaagcattgcttttttctttttaatatggtttttaacacgattatttccataaaaaggattttttgcaatttgatgctgctgttgagcaacattctgtacatggttttcgagctgttccccacccaaatttatcgtcgtttcgccctttgcacgtcgcgttttattgccggcattggctgggcccagctggggctgcttaagtcgtacgttgccgctgccagcctggtcgctgatcgttcccgggccaccgctttcatcaccggcggacgacgcccaacttgtttttttaagtttttattctaacatcctt

SEQ ID NO: 40232 - DNA, 1314 bp, Heterodera glycines
catggcaattcactgaattcggacaaagaggaggagcagggaattgggtcgggaccgaacagcggcggtgaacagtcggcgaccgccgtcgccaccgccccaaaaagcgcttcgctttcaatggatttcgatcactcaccgactttgttcagtgaaactggatcagaaacagaaaaaagtgaaggaaatgaagaaggcaccaaaagggagcagaaggagaaagacgcatcaacaaaacaaagtgagaggggaaaagcacaaaaagtaacgaacttaattggaaaggtgacgacgaggaagaggaggaggagacggacgagtcatcaacagcagaagagaaaggaggagaagcattgtcagaaagggaagaatgttggaagagaatggaagaagaggaggaggatggggaagaggagggtgaggaggaggaagaggaggagggggaaaaggaggaagttggaagagaaaagggacagagaggaagagggaaagaaaaaggaaacggaagagatggaagaataaagacagcagagaatggaagaggaggaggaggaaaaccaggaggggaaaacagaccaacgactgtccgttcaatgaaaaggaaatgcgccaacacttcggccggtggtcctctgttccaatatccttccgaggtcagtcgaagggccgaaaaacgaccgaccgaattcgattcacagatgtacgccgctggagaacaattttccagagaagtgaaaactaaaaatgaaaagagttacaacaaaattttaggaggaagacgcacagcaaaaaacacacggaaacaaacggagagggccacggacgacaatcagccaaaaacaggtgggggaggggagggcgagggaggagaagcgggcggacggacggacggacggacaattaagctggacattctgaaccgaatgttcgacaacacattcaaaccaacgaagcacgaaagggcccaattggcacaagactcgggactgagcatgagagtcattcaggtgaagcgaaatgggaaaagtgcgaaggaatgaacgcattgtttaggtgtggttccaaaacaggcggtcagttgaaaaggggggggcagaagaagaagcaaagaccaatcgcaggtcaaaggaacgacggcttaaacatttgtgcaattttctgcgccattacgaagaccaaaggcaaaggacagacggagaaaaaaaaagagaaaatgaggcgatttttgaaacaatggcacaatgaaaaaaggagaggagaagccatgggacaccaaagggggggggattttgtgctgtcgagtcaattaagtaa

SEQ ID NO: 40233 - DNA, 1130 bp, Heterodera glycines
  misc_feature (1080)..(1080): n is a, c, g, or t
ccagcaactggaatttattatagtcgggaaacaaaccatttttttatgtattaaggctctcccaacagtcaagaactggttggttcatcaaaggaaaaagcaacaacaatttcccgcacaattagtggggcggcggcgaatgcacaaagcgcccgccccaaaccgccaacaatcactttactaaataagcagaacacatccccaaacgtgaggaggagcccaaatgagaaacccaaattctcgttcagcttgttctgcggttgatgctaatgagattgattagtggcaccggtgattaatttgtgccgtgccggcgccgcggaaattgcctttatttaagcttcaattttttgtgcatttcatcattatcattttccactcgggttgtggatataatgcaatttaaaaatataggagaagccgcgcgttacaccgttacaatatagtatataatgcctcgttaattaggtaatttgtaattattccgccttaatctaagtaaaactgaccgtgaataaataaaacgatcctgttttagacaacactataaacatgtcatagtctctctgccctcagagatttttgtcacaattgtggacacaataacacaactactaacgcaataatatcttttcatttccctattaaacgatttaataaaaaaataaaatatttttaccgtattgaagggagttggtgaaatagaggaaaagagggggcgggactatatagtagagaccggacaactcggttcggagggatcccgagtttttaattatttaataaaattgtcgaagatgatatataaataaataaataattattttttaaaaattaaatacatttaatgatagcaaataattttgagtaaaaaatttaaaaaacctttgtttattgttaaagaaatttttgccctggtttaacctaagccgtactgacgtgtttatcagtgtaaaaattaacattgttcgtccggccaatgtcaaccgactgttctgctcaacccatggtcgtgatgccattgacttcaaagacaagttccattccgtttccgattatgcacatttttgtgtggaccanatctgtggagcaatttgaggggtttaatttatttatttgaaaataaaaat

SEQ ID NO: 40234 - DNA, 1506 bp, Heterodera glycines
  misc_feature (123)..(123): n is a, c, g, or t
ggcggtacatcatccgccaaagcaaatgttgacgagtggcgggccaatgtacgaattttgagtccggaaggcgacgggcgggcaccgacaatgttgtccgacaattggtccctccgagctgtngcaaaatggacaagggaatgtcgccgcagatccctggtgccccatcagtgccgaagtaaatttgaggtcggcacagaggagcctgaaaattacaattggcattcctgttatttttatttcacatttggactgaaatggtccgctagtcccggaaaaatgaacagatttttggggaattgggtggccaacattaccgatgaccatcgtaattttatcgttgcagccacctacctcatcgcctcccttatcgcccgccaacaccaacacaatttgggaggcaaattgctgctgcagtttcagatcgccttaatttatcaaaaaaaaatcactttgactgccattttcccaacgctgttcgtcccgcctgaacctgaagtcggcctcgagcatggcacgagcattgatgcaaacaagttcacacgtctgtccgtcccccatccgttgacagtccgcccacttacaagttcccaccttcagacgcttcaccgctctcgtcggtccccaaacgtcaagtccctggccggcgaacgaccgcttcacgggctttgaacaaaattccgtcgtccaaagtgatcatcaaatcgtttgccgtatccatcctgttgttctcctgccggttattggtcactcgaaaaggaacttgagctggtgacatgccgtaaccggtcgcacgaggttcgtcaaacggtcacggagggcctttagctgtcaccgcagaaagggacgttcgatcgtcgctgttgctgtagttcttcctcgagccaaatgtagctcgtcaacatatggaaggattaataatttaaaaaatcaaaattttaatggaattttttctcacaatcgtcgagaccgaagccaccggcgctttttgaagtcgatggcgtcaccatcaggtcgcagcgtgccgttgatattgacgacatggattcagtggtcgtcagcatgtgtcgaaagaatcagcacatcgatgtccacaatgtgaagtacgaagtacgccaaagtcagagaaattacaaagaaaaaaagaaacgacgagatagtagaaaaaaattccataaatgggcctttttcattcatctgtaaaatactattttctatacaatcttggaaatgtgcagttaaaatttcccaagcatgaaagcctaaagccacgcacttacttggcaattttgtttaaattatgttgtcccttcttaattttgtctaattgtctgttatgagttcttttttcatcgatatttgttactcgcttttccacaacagcagaaaatgttccccaatcgtatttggtcagtattttccacagactttcctgctttttgttgtgctgagtttaaatataagtgaattgtcccagtcattgaaaaaatttggacaacgaaaaaa

SEQ ID NO: 40235 - DNA, 1066 bp, Heterodera glycines
tttttccccccccccttttcccagggggtttttttttaaaatttttttttccccaaaaactttttcaaacccccattttttcccccgggaagttttttttttttaatttttgaaccgttttgagtagattagactagaaaaaaattgaaaattttgaaatcatgtttcccactcccttctcccaggggtattattttgtaaagtctttttttccccaataaacttgtcaaaccccatttttcgcaccgtgaatgttatttttattgaattctgacccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcccccaataaacttttcataccccatttttcgcaccgtgaatgttatttttattgaa

SEQ ID NO: 40236 - DNA, 1513 bp, Heterodera glycines
gaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattgggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactacaaaataatacccctgggagaagggagtgggaaacatgacttcaaaattttcaattttttctagtctaatctactcaaaacggttcagaattcaataaaaataacattcacggtgcgaaaaaaggggtttgaaaagtttattttgaaaaaaaaactttacaaaataatacccctgggagaagggagtgggaaacatgatttcaaaaatttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacattgatttcaaaattttcaattttttatagtctaatctactcaaaacggttcaggaattcaataaaaataacattcacggtgcgaaaaatggggtttgtcaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgagtccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaactttcactgagatgagcgccgagctagctggctcaaaaaaaattttcgaaaatctgagtctttcgtttttatttattttttgcaaaattaattcataaatattttttcagaaagggttctgaaacgcgccaaattttatttacaagttaataaggctctctgatgctttttctatcaataatggaggtgaataaaattttaaaaattttttaattgctttttaaatatgccacaaaaatataggcatatctttttagagaaagtctgatcactcttatttt

SEQ ID NO: 40237 - DNA, 1619 bp, Heterodera glycines
ctaaaatatcgattaaaaaaaaaatttgttttttttggatttcggtttgttttaggttctgaaggttactttaaaaaattaggggttgttttaaaccaaaattttgataacacacatctggaaatttggcttattcttttgaaaattttaaattttttcagttgctttgcaatttcccgagggcctcacaatgttcgcctgcgtaatcgtcgacattctcaagaagcactacttgcgctgattgtgagtttattgttaatattaaaaaaaatttcttgaataaattttaagtagagtgttgctgctccccaaaatttttaaaaaattaataaaaattaaaaaaacaccttgtcgtttaaaaattataaaaaatttatggctctcaaattttagcccgccgggtgtgcaatttgcgctgcgacgggtgccactatcgcatttggcttgcactgcgcatcggcttctccatcgcgttggccatctttggcattgtgattttggcacaggtgtcttcttttttaaaagatagtaggcgcagaaaacactgcattcttttctaaaattcgataaattttgccccagcacccacctatcgccaccgcaaatcccccaaaatcctgatttctctaaaaattggctcaaaatagctaaaacctgcttttttattgaaaactgttaacaattcagaacaaattttcaaaaaatgtttcttttttcattaaagcgcaacagattaaacactgctaaaaatcgaaaattttttatcgatttacaaggtcagacgccttcgcaaactttttgtttaccctaattatttatcatgtatgtaatccaaggcaaatataatgcattggatttgcataaattttgcttatatgggttgtaattaagagactttaccttttggttcctggcggtgtttgattttcttgcaccttctcagctcggtcttggtattgcactgatcagtcatcatcttggactagcaatttcaaaacgcagttggtgggttatgacgtgcacgaaagtgtctcaatcccccagtgcgatgaacccggtgacgcggacgtaccgcaccacccctccctctcagtgcgatgaacccggtgacgcggatgtaccgcaacacccctccctctcagtgcgatgaacccggtgacgcggacgtgccgcaccacccctccctctcagtgcgatgaacccggtgacgcggatgtaccgcaacacccctccctcagtgcgatgaacccggtgacgcggatgtaccgcaacacccctccctctcagtgcgatgaacccggtgacgcggatgtaccgcaacacccctccctctcagtgcgatgaacccgttgacgcggatgtaccgcaacaccctccctctcagtgcgattaacccggtgacgcggacgtaccgcaccacccctccctctcagtgcgatgaacccggtgacgcggatgtaccgcaacacccctccctctcagtgcgatgaacccggtgacgcggatgtgccgcacactacattcaaaagtaaaaaaaattcaattcatgtgttactcccaaaacagctcttttaaaaaatttagtttgaaaatgaatgttttcagttcattgaagggac

SEQ ID NO: 40238 - DNA, 692 bp, Heterodera glycines
  misc_feature (10)..(10): n is a, c, g, or t
ataaatatantttctgttaagtaactacgcatatatatgcgtgctgacgcgttttataaattccgccacccatgcgcgtttataaatccgccaaaatgggtttgcgcgttttataaatccgccaccatgcgcacccccaccatgcgcgttttacaaatccgccagcgcgttttataaatccgtcaatataaatcaatatgctttatataaatttattatttgttgtgaggacccttgtaagcaaaatatagcaattatttaccaactttaatactggataaatccttatataatattttatctgaataaagcatccgaaaatttttttaattgaatttgtacgacattagctatcacaaaaccttaataactatgataattaataaagtgttctatgtaattaatttaaaaaatttatatcaggtgatggtgcaaaaattttaggagatcagatctcaaaaaagaaataaataccctgaagagctgctggaaaaatttgataaaattggattgtaattaccctattgactttattttagacattttgtataaaatatagctgaaattattgcataaaattttaatattattaaagatatatgcaaaaaaatgtgctggcggatttataaaacgcgctggcggatttaaaaaacgcgcatgggtggcggaatttataaaacgcactagcacct

SEQ ID NO: 40239 - DNA, 1664 bp, Heterodera glycines
catcttcctttttgatactaaagcatcagagtgctaaaattaagttgtaaataaaattttggtgcactttagagcactttctgaaaaaaatatttatgaaacaaaaaaatcgattttttcaagtgtccgtttggggtacttaaacatttatggggagcaaaaatccaacgcagaattaaagtacaggctatagggaagctattcccgagggattcggtctccccataaatctgggcgcatcggttcggggggaatgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgaccgaaaacaaaaaaatcgattttttcaagtgtccgtttggggtactcaaacaattatggggagcaaaaatccaacgcagaattaaagtacaggctatagggaagctattcccgagggattcggtctccccataaatctgggcgcatcggttcggggggactgaccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaagtttaaaaacaacaagcgtggcattttcaggttaa

SEQ ID NO: 40240 - DNA, 1055 bp, Heterodera glycines
  misc_feature (34)..(34): n is a, c, g, or t
  misc_feature (80)..(80): n is a, c, g, or t
ccttttgagccaacctttttttatgaatgtgtcnccattttactttgtggtctgcggcctatggacgcttcagagccatntacgccttcttttcaatattcgtatgtaaaaacgactatctctttttttcggaacacttttttgaaaatttttttaggaaagagattttgtgacacgcaatataactaacattcgaggcttctgtcatttcctttttataatgcgtatataatttaggctatttgattttatcagcaaattccgaaattagcttgggaatgggcccttttgaggccaacctttttttatgaatgttgtcccattttactttgtggtctgcggcctatggacgcttcagagccatttacgccttcttttcaatattcgtatgtaaaaacgactatctctttttttcggaacacttttttgaaaattttttcaggaagagattttgtgacacgcaatataactaacattcgaggcttctgtcatttcctttttataatgcgtatataatttaggctatttgattttatcagcaaattccgaaattagcttgggaatgggcccttttgaggccaacctttttttatgaatgttgtcccattttacgttgtggtctccggcctatggacgcttcagagccatttacgccttcttttcaataatcgtatgtaaaaacgattcagcgctttttttcggaacacttttttgaaaattttttcaataatcgtatgtaaaaacgactataactatcattcgaggcttctgtcatttcctttttataatgcgtatataatttaggctatttgattttatcagcaaattccgaaattagcttgggaatgtgcccttttgaggccaacctttttttatgaatgttgtcccattttaacgtgtggccgccggcctatggacgcttcagagccatttacgccttcttttcaataatcctatgtaaaaacgattcaaaaccctttaccccttcttttccataaacgtatgtaaaaacgactatctccttttttccggaacattttttttaaaaagttttt

SEQ ID NO: 40241 - DNA, 568 bp, Heterodera glycines
  misc_feature (329)..(329): n is a, c, g, or t
atattttggataggaaaaaacaaatttagaagtgatacaaatcttttggtgattttaagctaattttaaagaaaataaaggatttttagcatccggcggtgccgataggctccggcggggtgaattaaatttttaaaaatgttttaagaaaggacaagaaatttggtttttgggagtattttttaatttttcaaaattttattctatcaaataaaataaaaattaaaaaatattaagtccaaaattattatgttaaaacgatattaaaatttattttgcaaatgtaaaaaacaaaaaacaattatttgcagggtgggggaattgaactntagaagaagaaaaaaaaaaattgaaggcatacccactgggcaatcgccgctcacattggctttacattctttgaaaatgatattgatatgtcaaaaaggaaaaacttcatatctcggccagaagcttcatttagcaaaaataaaaaaatttttataatacaaagggggggggtaatctacctaccctgtaagtttcattcggaagtcccaccgtcacttgggtacctctcctttgtgag

SEQ ID NO: 40242 - DNA, 1308 bp, Heterodera glycines
  misc_feature (1231)..(1231): n is a, c, g, or t
  misc_feature (1293)..(1293): n is a, c, g, or t
tgacatacggagtggcaaggcggattggctcagactgaaccggtgctggtgccttaagcaaaaaaaaaaagatttttcagaccagtccattaacggctggtccattaacggcaaaagtgccagccggaccccactaatggaccagtccattaacggcaaagtgccagccgggccccactaatggaccagtccattagcggccggtccattacggcaaaagtgccagtcgagcccctctaatggaccagtccattagcggcaaaagtgccagccggacctcactaatggaccagtccattaacggctggtccattaacggcacaagtgccagccggaccccactaatggaccagtccattagcggccggttcattagtcagaagaccaaaaaaattcttcgcaacaaattccaaaatgatttagagctgctattctcagaccgaaatagcgagttcgaacaaaaggtctaaaagtcgaactttgttcgaactgctcccataatgttcaggagacaatttcagacaggagtttaccccaaaggggtaaaaatgcttgtatttttgttcaaaaatgacgttcagacccacttttcacagttcgaaaaattttcggccatcatttcggggccctagagtagccagaagaccaaaaaaattcttcgcagcaaattacaaaatgatttcaagccattctcagaccaaaatagcgagttcgaacaaaaggtctaaaagtcgaacatttttagaatttgtctaaaaatgtcaggagacaattttaggcaggaaaatagatcaagtgacctaaattttgataattaatatatgttttaatcccgactcagtactttaaacttttttagccttttttaattctattttgcttttggagccgttttcccgccaaaacattgacaaaataagcgacaaacttaggtgttttcaatttttgccttcatcaaatcaaaaagcggatgaatttcccgcacagcttaagtaattaagtgaaattctaaagttcaattctcccggtaccttctttgtacgcgcggtcgttgacaacattcaatactgtctttaccaagtgattatctctctctctctctctttctctctctttctttctctctcatttcaaccaaaacctaggcgtgtccaattaagaccggtggcctcgtttgtaaaaaaaactcaacgacgagctgtactgtgaatcatgtgatcaacacgctacncaaccacgagcaacctctacttacgcatcgacttgcgcgattgtcatgacattaagacgatncagcaaataactgcc

SEQ ID NO: 40243 - DNA, 980 bp, Heterodera glycines
cccagatttatgggggagaccgaatccttcgggagtagcttctctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtaatttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatctatttatttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtaatttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaatcgatttttttgttttcggggcagtccccc

SEQ ID NO: 40244 - DNA, 177 bp, Heterodera glycines
cgtcagtgatcacgtagttaatggtcacttctgccgcagtacctgctgtggtaggaattgccagaatcggtacactgggtttattggtcggggaaagcccttccaggctacgcacatcggcaaactccgggttgttgctgataatgccaatcgctttacaagtatcctgtggagaac

SEQ ID NO: 40245 - DNA, 1144 bp, Heterodera glycines
  misc_feature (1115)..(1115): n is a, c, g, or t
ggtgggaacgctttcagtccgccaaaattacgatggcatataatgtaagagagagagagagagagagcatcagaataagaaagtgagtgagtgaatactttttgaatgagctgacggaagggagcactcattcccagcgaggttttttataaaatagaaatttgtttgaaaaatctaattttttgcagtttaggcgataaaaattgtcttttacacgtccaatcaatgggccatcctcggtttcttaagccataacatttttttcatatttggtcaaagcccaaattcatggtcttaaaagcgctttaagtctatagactttttggtataaataattttcgggctaaaagcaacaggaaaaaattaagaatggtcattgaatgtacgcctaaagtatgcaaagatccaaaaaactttcattttcttgtaagaaatttggtattctgtttaaaatgaacatttcccattaatcgcaggagtacatggactacaagcagcaaatgctgagctccgaatcggcataaccactggccgcgcactgacgacgaacgattgattgatttttatcaattttggttggggtcaaaaaaaagaattaaaaaatcatcatttttaaacaatattattgtaattaaatacaaatccaacaaagttctgcccccctccccctcattctgctgctgatgctggctttttttctatttttaatatatgtattatatgttcaaatttgtcatttttatggtgaaggaaaaataaacattttaattttggtaaattttgaaattaaaaattacatttattgtgcaatttcaaattgcctgtttacgccccaaaaaaagtaaactttgttggaagtgccgtagcaaaaacgacgcttgctgagagaaatttaaattatgccaaaaacattatgccatcaattttaaataattttaccgtactactgggtagagaccggaaatttcaaatttgcggatcccgctgcgggactggaactcaaaattttttgcgggacgggatcccgcgggattaatcccgcaaatcccgcatttaaaatttgcgggatcccgtgcgggattgcgggattttggaaattcgaaaaatttcaattnattcaaaaaattacaaaatcaaaatgcta

SEQ ID NO: 40246 - DNA, 977 bp, Heterodera glycines
attagatggccaagcctctccctcccccgtcgggatgggtgggggggggggggggataaagccaacgcatcagaaaaatccgtccaaaaattggtcggagatagctaacctccccccccccccctcggaatgggtgggggggggggataaagcctaaaacccagccaaatattgatcaagagatagccaagcgccgcccctccccctcggggcatgtggggataaaacctcagaaaaagcctggccaaaatcgcttgagagtgatcctatatgtcgtgaagagtgggtgcaaaactgagatgaaagttggtgggcatttcaccaacagaggtatatgcgattaaatttcatttttcataagtgtggaaagtcctaaggaataaaagtgccaaaattctcacattttttgaattaaaaaggataatcaactttactaaaatttttaaattttccaaatttcaatattttggcccacttaaaaaaatacgcgatgcaaattttttgcatagttaattttgttaaaatttcgaaattttgccctcctccaattggcccatgaatgctgtgaccttttgtttaattgattttctttaattgggccataaatgaattgtttgctttccccaataaaaaaactcgtgacaaagaatgtgaaggttgagagactttggccagcagttgttgcagggaaaaattttctgacaaaacaatggtaaataaaatttaaaaaattttttttggaatgaatcaatcctataacccttttgatataataaatatgccaagaaaaaagatttaaaaactaaattttaaaaaattctaaatcattggacttcctacattcggcaaaaaaattttcattaaaatatgtaaaaattaatttttaatttttaaattaaatttaccactacttttaaatccgggggccaaaacgcagaattttttcaaggaaactgatttttaatttttaaaaaaaa

SEQ ID NO: 40247 - DNA, 1409 bp, Heterodera glycines
aaataaaaaaatgggataaatattgaagtagtttgtcccccttagtcgccttcagcgcacatttgtagtgggattttgggcggacaatccaaaacttttgagccgcaaattgagggggcccgtcgattttggtgaatttgcttaaaagcgaaacttgataatgagccagtttttcattgtttcacctgctgattgtccaatattggtctcccttgcccttcctcttcaacaaatccgatagttttgttgaggactgagcgccaaaactcagatgaccgaaatgacttttggcgatttggttgttttctggacaaaagagcaacggcagaagcgacggaaatgccgaaaagcaacgattgaaaatggggaaaaggtggcggagaacggcaaatccatcggcgattttgggcctggcgaaaaagtgcttcggaggcctaagacagggtaaattttaaaaagaaaaagcggagtgaccaaattgagcagatacggcaccaaaatgccacggcgcgctttgctttcaatccaaacggacattgaacaggcggcgaaagcattgagcacggaaacggtgggccaagtggcgaagccgagcaaacgtataaaacggaatttaagttggaaaaaattggaaggaaaagcggaaccgaaagatgcacagccaaaccaagaacagaatctcggtggtagtcaaaaagaaggaggagcggagagtgttgaacagaacgcggagccaattgacgcgatggactcggccccgccggtccaccaacgctttgagctaatagggattaattggacaattaaaaagacgattaccaaaataagaggaatgcctcaccgcgtacaatgtgccataagtcctcagacagaacaaccacgcgggaaggaaagggtcgcggagagaccagaaacagtgggggtgccatgtgtggctgaactcgtggcattcggccgtcagaattcgcagcccaaaagtgttggcggcaagccgcgacaacacattggtcattatgaaaagcaattaagaaagagaggtcattccgaataaaaagaatggcactaattctgccgaaccattaaaactaaaatatatggaaaatcggaccaaatcgacagttatggcaaaaaaaaaagcattggggaagaataaaagcattttctttgagatcagcaaaaataatgaaatttttattatacatgcttcacacggaatgaagaagacacaaaggcgtattcactcattgttaatatgatagaaaaacaggccgaccgatcatttatttgcccaaaatcattcgaaccaataccaccaatcgaacaccttcagcaagcgcatccgtttgcgcagaatgtaaaaacagacgccgaagtaaaggagcaaacagagaacaatgagaatctgaaaa

SEQ ID NO: 40248 - DNA, 850 bp, Heterodera glycines
cgcatgcccattcgccaagccctcgggttccaactgagcacgggtgccacgcatgccctcgggttccaactgctcacaggtgccacgcatgcccattccaactgagcacgggtgccacgcatgcccattcgccaagccctcgctttccgactgctcacgggtgccacgcatacccattccaactgctcacgggtgccacgcatgcccattcgccaagccctcgggttccaactgttcacgggtgccacgcatgcccattcgccaagccctcgggttccaactgagcacgggtgccacgcatgcccattccaactgagcacgggtgccacgcatgcccattccaactgctcacgggtgccacgcatgcccataaaccaagccctcgggttccaactgctcacgggtgccacgcatgcccattccaactgagcacgggtgccacgcatgcccattcgccaagccctcgctttccgactgctcacgggtgccacgcatacccattccaactgctcacgggtgccacgcatgcccattcgccaagccctcgggttccaactgttcacgggtgcacgcatgcccattccaactgctcacgggtgccacgcatacccattccaactgctcacgggtgccacgcatgcccattcgccaagccctcgggttccaactgttcacgggtgccacgcatgcccattcgccaagcctcgggttccaactgttcacgggtgcacgcatgcccattccaactgctcacgggtgccacacatgcccattccaactgctcacgggtgccacgcatgcccattcgccaagccctcgcgttccaactgttcacgggtgccacgcatgc

SEQ ID NO: 40249 - DNA, 1049 bp, Heterodera glycines
aaatgttgtgatcagaaagagcatggacgacagcttgcccttctgtttgattttgcgctgcaaaatttgaatggtcagtccaatgggatggatgtggtcggcactattttgtaaattatgtcgtttgtgccaaaacccaaaattaatgggtgcaattaattaattaattaatttttggcttaaatttgcccatttaaatcctaattatttttttgctatacaaaaatcataaattattgtaaaaagtattttaaattaagaccaaaattcttatttgattttgatcaaaaaattacaataaaaaaaaactgaaaactaatgaagcttaattatttttagtaattaatatattaattagttaatttttaaataaaaatttattttttcagctccttcacgactaatacaggtaacactgttcaatttatttacccacattcttaattcgagccaatttcggatttttttttcttcagtcataattcaggataaaaaaatttgaaaaaaaaaattaaaatttcttccgattaaattaggaattaaattcttgaaaaatttaaatttttaaaattatgactaatttattccatcaatgtttgtcaaggatcgctgttatcgaatgggcgaacagcacttcacggtgtttgggtcgggcaacgaggcacagctgtgggacgatttgggcgagtcaatcagccaagcattggcaaaagtaattaaaaaaaccaatttaaaatcagtaaatggccgataaacaaagtgccaatggactaaaaatagagaatttaaaaattgaaaaattaattgctatgatgggaagtttttggctataaattttttctttgccaaccaactccaacaatcttggtatcattcgattgcatttcagtcgtgctggtgcatttcgtaaaaccgccacccatgcgcgtttcgtaaatccgccagcgcgtttcgtaaatccgccagcgcgtttcgtaaatccgtcagcgcgtttcgtaaatccgtcagcgcgtttcgtaaatccgccagcgcgtttcgtaaaaccgcca

SEQ ID NO: 40250 - DNA, 1096 bp, Heterodera glycines
  misc_feature (46)..(46): n is a, c, g, or t
  misc_feature (75)..(75): n is a, c, g, or t
cgcgaaaagttgaaaaatttcaaaacggcagacaacagatgcattncaaacaattcaacaatataatataaaatntaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttatttttgtcacgaaacaacccgctgatggccacgtcgaagaaaagtcccaaaatttgacatccataaaactccattttttcatcggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagtttttttt

SEQ ID NO: 40251 - DNA, 1204 bp, Heterodera glycines
gcgctccagccctggtaaatattatatattttttattttttctgcattttttgaaatattttaaaaaagtgtccaagacagtacaggcagggcgcggcgcggcgtccattgataaatttatgccaagaaaaacacttacctatttctttatttatcattggctattgctcggcatttttttttgaatttgaatttttaacattatttaattttaggtaattaaatttttcaatttaaaaatatcaattttttttacatatcctttcggctctttttgctggccactcgcatgcttcgccgctttccaaatcttgacaaaaatgagcccaacaattgttgttgttgctttttgtcagcttcagaaatcaatgaatgatcaggggaaagcttccttttctttataccggcagtgggcgaagacattaaaaatgaaaatttaaataaattcacctaaaatttggaacaaaaaaattagccatcgccaaatttaataaaattaatatatgcacatattttgctcaaaaagtgccaatttgagagttttgttcgttcagatttatgagcagattttggggccggcagtgccaggaattttattaaagaatataaaattgtccatctttggcaaaaaggagattttttaaattttctatgacaaaaaacctaaaagttgacatgagattcgataagaaaagcagcagggcatttgggaagacactccgttaattatggagttaatgaacactataattggctaattaattaaagggcgaccaccactaaataataatgaaaaaaaaatcaattttttctgacccaacaaaaatgaaaatgagcgaatggagtgaaaaaagaaacagcagaagaagaaccatttttataaaacaaatttcttctcccaacgcacaaagtgcctatatctccaataaaatcatcggcgtcgtgcggtggggggggggggggggggacggacgatgggcggcgtacgttcgcggccaaaaattaaaacattcgaatttataggcttcctgtaccaataatactctcatgggcaatatgcccatgagggtaccatccatacaaatttagaattttatgattcctgtaccaaggttaccctcattggcaagatgccaatgaggatatcatccatacaaattttctaatgttatttttgttcgagtccgggtcaggagttcgaaat

SEQ ID NO: 40252 - DNA, 1258 bp, Heterodera glycines
ttctgttcaactcttccacttttaaactgagtgaattgtcaaataatgctgtaaaaacattcggttaattaattaattcattagttaattacccccccccccccgcccccctcttaccatttccattgttcgtcgatggttcgaaattgccttttgcctttggcgtcgcttcggtgccctccattatcatttgccgtcgctccaattccgctatttttgcgtcaagtgcttttcgctggccctgcaaccgatccaaatcattttcatcgtcggacagtgcaaaagagggccaaagatgatctgaaaagggagaaggatttttggaattgtatcgtatttagtgattttgaagaatattacattttaaattataactttcaaatttttgtgccttctttcaaatggcaaagcatttgaatggttttaaattaattatgtatatcccttttttaatttcaaaattcttttcctctctctatgaatggcaacttttgtaattttttaaattgtgatgccattttgccgttactttgatctgaagtgatgtcgccgaatgttgtgagtgatatgtttggtgtgcttgtgctcattttaatgcgctttgagacaataaaataaatgttaaatgaaaatcgaaatatataaaaaattacttttaattgaataattaattaatttattttttcactggtttaatgtccagcaccatcttcacatccctttagcaccgcctgagagtgacgccattgattttttcgataattttttttaaaaccaaaacattttcaaagggttatcaaaatcggtaatctgatattattttggcaattcaaaattttaattcaaaatttgttacttttttaaatttgtgttaaagaattgtataaaatggattattgttgaccatcgaccgaccgcaaatacatttcacaaacattttaggacacacattttgtcaaaagaaatcaataggctccattttttaccaacattttcctcaaaaacaaaaattctatgttgctaaaactgccaaaataattagtttttaggttataaaaaaccccaaaaataattgctaaaaatgggaaaatagttgctaaaaactcaaatttatttagtggtgcaaaatgacaaaatttattcaaaaaagtaaaaaaataggccaaaatcagtattgagctaaataatttttaaaacaaaaattcttgttaagaaaataaataaattattttggagatgaattttttgataaattttt

SEQ ID NO: 40253 - DNA, 257 bp, Heterodera glycines
aagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttatgaattaattatgcaaaaaacaaataaataatgaactcttccttaataattttcctgcaccgaaggtactcactcggccgcttcgcggcctcgtggtgggccttc

SEQ ID NO: 40254 - DNA, 1053 bp, Heterodera glycines
atgtaaactaagatttttttgttgatattttattggtaaataattgtcttgaattcttcataacaatacaatgggcagagacgacagaacgacttggaaagccaattatttcactcgcattattgtacattctttcataaatttctttatcaatttttaattttttaagtcgcttttcgaagaatacccaaaatgtcttttggtcggtgtcgacaatgttgggtcgaaacaaatgcaggaaattcgcggggcaatgcgaggtttataaattcaaatactgaatcattgactcccaataaaacaccgttagggcatggtgaaatattgatgggaaagaacacaatgattcgcaaagccatccgtggaaatcttcaaaaattcccgttgcttgagaagctgttgccttacattgtcggcaacgtcggattcgttttcaccaacgaggatttgggtgatgtgcgcaaaaaactgttggagaacaaacgagtaacttttaaaatttaatgttccttcgagtcaatggatcagggttctgccagagttccctgttcgtccgtttgaaaaaatgtcggactcagttttagacaaaataactttttttcccaaaagccgtgttttagtcctatttttaactgttccttttgttggaaagtcagagagttccagccatagcattcctggttccgaaatttacaaaatcctttccaaattttacaaaaaaaagttaaataaagacaactaaatgtagggcgcgcctgcaaaggctggtgccattgcgccatgtgacgtgcgattgccgcctcaaaacagtggaatgggtccagagaagacgtccttcttccaagccttgcaaattccgaccaaaatttcgcgtggtaccatcgaaattctcaacgaggtccatctgatcaagactggggagaaagtcggcgcttccgagtcagccttgcttaacatgttgggcattcaaccgttttcctacggactggtcgttgagcaggttattttatcaacaatatttttacatttaatttattatattatgtacatgag

SEQ ID NO: 40255 - DNA, 317 bp, Heterodera glycines
tatcagtctctttctcattaaccccccccccccgccctctctctctcttttttcgtttttagcatttccaaaattttctttggcattattgtttggcttcagcgtttttcgccaatggcacttttccttagggcattattttcatttataataatttccggggggacacaaggggaagagaacacccacattattcttcctttccttctcacttgtaataattaccagtagcatcattgctgtatcaaattgttctatcttattgcccccggggggcacaaaacgacgggcggtggagggggggggggggggggaca

SEQ ID NO: 40256 - DNA, 1099 bp, Heterodera glycines
  misc_feature (65)..(65): n is a, c, g, or t
  misc_feature (1001)..(1001): n is a, c, g, or t
cgggctctagtgcactttatgagtccaatcgacttttatgagtccaatcaattgaaaatactcgngtttttatacaatacacggcgagtcaattttagggctccaagtacaaataagtttattatttatttagtaatcagaacgccaaaactttgcaaaacttaaaattttccggagattttcccttgcaaaaaaagaagagccgatctcgagttaaaaactagacagctaaaaaataaactgtgattcgatagaggaggtcaaaatatgggcctatgcaaaattttaagaaaattggtcaataggaaattttttttttcaaggacaacaaaatcaaatttattataaatttaaggcacaacccctgtcgccacgggatttggacgaattggaaacgtcaattgatcaatttcgaacattcctcaacgatcagccgcggatgcgcactttgctagccttaaaaccaaaggtccacttgctgttgaaccattttgtgccgttcgccagacaacaccaatttttggcacttttagacgagcagggtcaaaaagcattttgaaatttaagccctggattttctaggtgatgaagcattgcattcggtgtggaggcgattggaacagctgtggaagacaatgcctgatgaagaacaaatgcgacaattgttggaacaccattttgtgtcaaattggcttctcgacacaggaaaaatcgacgaaatgaagcgggtcagtttggtgaaaatttggttccaaaacaaattccatggttgaccgtgaagaacaaaaacaagaaattggtgaccgacgtgagacggacgaagaaagcgatggagaagaacaattcgattttgaataaacacagttggatatgaggttcttctttgtttttacaggaaataaaattttaaaaaatttttgagcttctttaaaaactgtgttaccatttcacatatatttatttgcttcaaaaacctcaaaatacagttatagcctgcatgngactcgaacctgagactccccttttggtgactaacaaacagaccactaagacgaaaaacccaactaattgtacttggagcccaaattgactcgccgtg

SEQ ID NO: 40257 - DNA, 935 bp, Heterodera glycines
ttttgacgcctaaaagttgattaaatgttaaagttcatagaataggtgcaccgtcccacgcctcattttccaaaattcagagcaatattaaacaataaatttgtcactgacaaatgccataacttcaaccaaacccagccatcgtttttctcactgccattggcattttacctttgtgtatgagtttcattgtgccattttcgtaaccggtctccgcacaaattcgctctctcaattcccccaaatttgttggcatttgctgcttcgcttcgcttggcttcgccgcttcacaatcagtgccattctcttcgttttttcctccgccctccatttcttccttttctgcaacctttgtctgtttttcgtcggcatttttttgttcctctactttttcctctcctccctcattcgactgtttttgttggtcaccgtccgtttcgccgccaatatcaacctcaattttgcactccttggcaccatatctgattgtcaaccacattttgataaatctctaaaaaagaatgtgtcaaaaaagtggggataagacttgccggaaccagaaaaacctgaccgggacttttattggttcctggattttcaaaaactgggacctggaccttggaaaaccgtgattcccgggttcgatcccggtcaagttttaccttataataaaaaagactaaaataaataagtcaaaaagtaaagataaaattttaaaaaagcgccaaaaagccatagaaataagcgccgaaatcaaaaaatgagaaccaattatttattgcttttttttttcttaagcttaggctcaatttatttctgtacaaaaaatgatcaaaagttgcccgaatgcataactaacatttaatttttcaaaaaaaaatgtgaatattttaatttgctttcttaagcgaaactacgctgttttcttacatatt

SEQ ID NO: 40258 - DNA, 591 bp, Heterodera glycines
ggatgggagtttaagtcacaaaaaatctcaaaaaagtcgacttaaaaagtcataaaaaaatgccaaaaaaaaagtcatgaaaaaataaccaaaaagtcacataaaaaatgccaaaaaagcactaaataaacccaaaaaaagtcctgaaaaattagacaaatgtaattaaatccaaaaaccatttttaaacattcttcgaagaaagtaatttaaaaacgactaattttaatggcaaaaaaatattcaaaattgttacaccgccaaatttttattttattttttatttttcagccccgtcatttgagtccttatggtataagaaatttaagttccgtcccgaagattggtttatttttcggaattttcatcacaaaaagtcaaattttgccttaaaaagtcatgaaaaaagtcaaaaaaacgcaaaaaagtcataaaaatcccaaaaagtgtaaaaaagtcaaaaaaaagtcacaaaaaatgtatgttagaagcttcaaacaaagtgtagaacatttttgaactcattttaaggtcatttagagtcagcaaacaaaaagtcatttgacttaaattcccatccctagtcatcat

SEQ ID NO: 40259 - DNA, 1238 bp, Heterodera glycines
ggggaactgacaccaaaaatgtcccttaaaaattctaaaattcttcaaaaaaaacataaaattgactagtattagtaccctgacttccgaattccaatgctcatccagcaaatcccggtttttgttcaaaattccccattccgtgcaactctaatagaatatcttcatcactttttaggcattctcaacaaatgactgctcactcatcattctttgtcttttttattgtcattctttggctttgcttcgattgtttgaatggaaatgagccaaaaaacaatggcaagtcttctcaaaatttacgtaaaataatattttcttataaatttttggtatttctccagcagagagagagtttcacaaacaaattttaacaaattttcaaattcattaaaattttgtggagcgaaacacacacatacttaagtagcaaaatatgaagtagacaaatatattaaatgttttcccatttttaattaaaatttctttgtgcttaagctaatgttggacatctctcaaagtcacaaaatgatcagaaggaaattatggcggacagaaatagtgaattagagaaacaaaaaaaggtgaaaaaagggaaagattttaatattaattttatggaataaaaagaatattcaaaaacttaaaatgattttattaaaaataaattaaaagatgaattattttaggtgcttttagacttccgacaaaattcttgggatgctaaagcatgtcacgaggacctcgaaatttctagtgacaattctttgactgtcaaacgaaagggaactaatttgggtacttattgggaattaatttaattacttattaaatctgtcttattaaacatctaatttatttattatttattttcttcaacagctcagtatcgttccgtctttgctaatcatccaatttcgctgagcattcgtttccccgacattttttactttaaaatttcaatcaaacaaatgaaacggtaaaattaaatttgcagtagaaagttgaataataataaaatattgtatttctatttttaattattattttcttcacttttaagtcatttgtttctcggatttgccgacaaacagcagaaaaaattggatgaaaatattttcgagcaaaagggcacttatgccattggaaatgttggcgcgatttgtattaacggatcattttcgtttctttgtttgacatggacgaccaaattgaggccagctttgaggccacttgaa

SEQ ID NO: 40260 - DNA, 1025 bp, Heterodera glycines
ttttctgttgttgcgtcattgtttttttgaaggcatccatgacaaaaccattcggcaagtgctcttcttcaagcagctcagctggcgattgctcaaaattgaggcgagtgcccacccgaagtgcggcgccgacgagcaaagggaaccgttgagaagcaaaacaaattcaccccttcgtttgctcaccgtcgacggaaaatgtcgcatttctatcaaaaaaagcagtcaaagtgcgttgcttttttgcgattgtattacgttgtgttctatagattgttctcttttggccggtaaaatcgaactgattctgaaggagatccattggctggcgacgatgctccacctgaggatggccatcgactttcacaaacacttggtggacctggccaactgtcagaagaaagcagattccgtcacaccttttttgggacaacgacagaacccgttcacggtagctgatttggcaaactgtttatggtcatggttagcaaatagaaaagccccctccactggtgatcgaaatgatatccgtcattccctccaccccccccccccaaggacgcctcttcgatgggttcgtctaccaactcggcagtgccttgtgctgcgttccgtcgcttcaacattccccactcttcgtaccatttgttcatttccaaagttgacctgcttctactcgatgactccgaatccaacagttcgcccatccctttttccattgcctttccatttaccctttagtgcttccgtctgactgggaattgaagcagggtgccatgcaggcatttctccaccggcttcgaattgacttttaccccgaacatcgcgtgttcgattctgctggagaaatgtctcaccgccaccattggacattttaccagtgcccgaactcctttacagatctgaccaaattgcagttggaccaattctttcgggtgaccagcacgaaattgggtaacgatttggctgaacagatcagtaattatggtgacactttcagcttcaagcaaaagggaacgatttag

SEQ ID NO: 40261 - DNA, 1066 bp, Heterodera glycines
  misc_feature (24)..(24): n is a, c, g, or t
tttttatatttagaggttatcccnagaaaaatggctatctctttttttgataaatttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtagagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctttcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttgttcggtgtcccagaaaaatggctatctctttttttgataaat

SEQ ID NO: 40262 - DNA, 803 bp, Heterodera glycines
  misc_feature (790)..(790): n is a, c, g, or t
ttttttgggagacgttcggcagctttgcggcttcaggacgagcgcttcgcgcccgttttttaattttttgggggacattcggcgcttcgcggcctcagactggcgcttcgcgcccgttttttaattttgtgggagggatccggccgcttcgcggcctcaggacgggcgcttcgcgcccgttttgtaatttttttgggtgacattcggccgcttcgcggcctcaggacgggcgcttcgcgcccgttttttaattttgtaggagggatccggccgcttcgcggcctcagactggcgcttcgcgcccgttttttaattttttggcggatattcggccgcttcgcggcctcaggacgggcgctcccactcctcagaatcccaaatcacacagggattctgaggtcttaaccatgctaaagtaaaaactgattacatattcgtgatcagcggcccaaataaccctaaaaatcatatttttggaagatttttggtgaaaaaaattttccactcagaaatcatggtcacacccctttggtcccgaatgccaaaatcacttttatttctataacttttttcaaaaaagtgataaaaagctaaaataaaatttataaaatagagcaaaaaattgcggatttttttgagtatattatttttataaaatactttttcagaagggagttctgaatttttttctgaaaaatcgaatttttccagaaattctggaataacttttttattttggaagatagaaattctaaataaatgccataaaattctccccaatttttctctnatttttaaagctt

SEQ ID NO: 40263 - DNA, 1559 bp, Heterodera glycines
  misc_feature (1473)..(1473): n is a, c, g, or t
ttagaatgttttcaaataagcacaaatgttctttcaatcccgattgggaaaagcaatatccggaaagggaatgctttttttattgtacattttgccaaattcccaagtttttcccggcggcgcctatcggcaaagtgcatatgcggtggaatgagcaaaattaccaacagaaacaaaaaatattggtaaaaatttcattccggcgtaaaataaaaaccatttggataaaatttattaattttcattgtataaataaaaattttaaatgtccttgaatttcatgaattttccccattatgtccttgcaaatcggcatacccgtccttggaagccgtctttgggcgataccaaccctgttttaattttatatgcccatagcaaaatccacctagttaagttgtctcaaaaatcgtaagtgcctgagggccttattttcagctttattatccattttaaatgattttcccaactttgttcaatttattgtttttttcatattttcactaaaaagaaaaattaataattctttttttttaatcaaaagttggctttttcagctgtttttttttcttatgtaacgatataaagttatgttgggtttgaacccagacacccaaaattaaccaaattattaccgttccattttcaagcaggaaaaagattgcagcgttaccatcagattgcgaccagttttgtgcattaattttcacacattgtttcccgttgtatgtttgaacagcacgtgtatcataattacgcttaaagacatgccccaaataagctttagctgtgaacggttcaccatatccgaagcacactgtcactttaggagcagcatgaacaaattggagaaaatgtgccagaaaaatgcaggaaaatgaaatcagaaagatgatgatggtattcatatctgtaaaaatgagacagacattaagtgtccaggcctggctgctggagctggatattttggaaatttattttataaagcaaacaaattcctaaaaatttaaaataaaccgacctggacctgaatttatccagaaattttatgcttagacctggagttcaagattaacctggacctggataaaaatccataaaaatcaacgtccaggaaaaacctaggtagccgaaaaatggcctgggcgattttgactcaggaaaaacccaggcctgtatcaacttccaagtcgaactctattagttatcttgctggttcagaacagaaaccaaaattttaattaataataaattcattagttattaggataattttttgaatgccttttgcctaagagtttatttttgtaatttcataaatacacaaaccggcgcaggatcccgcaaattttaatatggaatttgcgggaaaaaaaggattctgcggaattaatcccgaaaacaaatttccgtctctagttgaaattttggaaatgtcaaaaaaaagagggatgtttcggaaaagaaattcanatttttgatatggcatttataataaaaaaaagcaataatatttttttaaattttgtatattgctctttgactggttatcactattt

SEQ ID NO: 40264 - DNA, 1100 bp, Heterodera glycines
ataaaaaaaaagttaagcctaaaatttttcgcatatttaaaaagcaattaaaaatttttagatttttattcatctccctttttatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttctttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgtaaataaaatttggtgcgtttcagagcagtttgtgaaaattccaaatccctcgcccaccttcgctccccccccccaatcgccccatttacaaacgctgcaattcacaattcatttgacccctaaaagcgttctttccccgcgtttcttccaaatttcgtcgattccaacgatcagcagcagtttcgctggagagacttttcacattttacactttgaacaaatcgaaattgcatctgttcatctccgcccccccccaatttgtcgatatttgcttcgaaattaataattaattaattaattagtggaagaatgggcgtaagagcttagctatgaaaagtcattactttgctttaagcacttttatcgtaaaaactttcctttctctccgatcgatcgcttttatttttcccattactaaactttacataaaaaatgtcactttctcccaatcattttttatgttcaaaaaatctttaaccaccaataattggaatgttttctgtgtaaaatttaagagaatttggggactgttggatgaatgaatgaataaatgggcgacggatgagtcacaacgaatgtcatgggaattgagcgaacatttggcccctatttaaaatttaaatggtaaaattttaggaatttttattttgccgtctgtcaaaaaat

SEQ ID NO: 40265 - DNA, 615 bp, Heterodera glycines
aaaaaacgatagcaaaacaatcattccaattttgttttttttattttcaaaaccaaaaataagcacgaaataagcacgtaatgctgaaataagcacaaaatcttagaaataagtacacttgggagccctcttgtaagcagtatactcagggtagccagatgaaaattttcaaaagcctcattttgagtcaaaaagcctcatttttacaaatttattcaaaacacatttaaaatgttcaaatgttatatttttgattgtccaagtccatgatcaatttgagcattttttttagggttgcaaccccgacgtcggggttggaaaattcggggttcggggttggaagtgtcggggttcggggtcggggttgccaaatcgttcggggttcggggtcggggtcggggtttttcaatttttgccttatgccaaatagtcaaaatttttttaatattttttcggaaataatatttattaatttccataataatatttgtattgtttttatatttttttatttctttttatcagaaattttgtatagaattaatttttttttcttgaaattctaaaatttttattacttttttgatttccaaaacatcttttttcacataactc

SEQ ID NO: 40266 - DNA, 807 bp, Heterodera glycines
caatcgctggaactcaacccaccaacatttcaatctctgggactcaaatctccgacattccaaacactgggactcaacccaccaactttcaatgcccttccaatctctgggactcaacccaccaactttcaatggccttccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccaaacaatgggactcaaatctccggcattccaaaacactgggactcaaatctgcggcattctaaacattgggactcaacccaccaactttcaatgacattccaatcactgaaactcaacccaccagcattccaatactgggactcaattctccggcattctaatctctgggactaaaatctccggcattccaaacactgggactcaacccaccaactttcaatgacattccaatcactgaaaatcaggccaccagcattccaatactgggactcaattctccggcattccaatctctgggactaaaatctccggcattccaaacaatgggagtcaacccaccaactttcaatgacattccaatctctgggactcaacccaccagcatttcaatctctgagactcaattctcaggctttccaatcgctgggactcaacccaccagcatttcaatctctgggactcaaatctctggcattccaaacact

SEQ ID NO: 40267 - DNA, 998 bp, Heterodera glycines
aattagggcaaaaggaatgactgaccagggtgtctgtcgatgaactgctccaccttgaagaaggacagaagagataatgttgaaggaccaatcagagagaccaatcaaatcacctcagtgggataaacgttctctccccctcggacgatcatatctttggaacggccaacaattgagacggtgccggaggaatgcatcagcccaatgtcactggagagggaaggcaatgccaaagaaagtgtgctctcatcaaaagacccacggacaaaagacacaaaattaaattaaaaatatataaagggtttttcgggaaaaaccataaaaatttctgctcaccccgtcctataccaacggtcctttgttacttcggacgagccgtgcgtgaccgagtcccaatagccgtacattaccgaatagcctctgacaaacactcaaacaaagggaaaagtaatgccaaaatgggcaaaatggggggggggtgggattggcacgtacagtcgcctctttgcccgcggggggtcactcgtccttctttgtctacaattaccgcctgaaaagggaatgggcaaaagggggaggggtcaaagcgagagtttgagcctaatcacctctaaatggtccataatatggccaacattgcgaattctctgctccggcggatcctccctaattgacataaacgaaacgggcgaagtttcggtggtcccatagcacacttgaagatccttcatgcccaactcattgaccaatcttgaatttacaaataaaagtcaaagaaaacaattcggaggaggtcattttattgcctggagcagagagtgacggggcacggcgcgcctaaggaaaagccaattaattagccaattaaaaccagcagattgttggtggcgttagcacgtgtcgtcctatgtcctccctcacctgctacaatccctgaacggatggatgagtagtcgaacgaagggtactcagcatgactcatcatgtcgatgtactga

SEQ ID NO: 40268 - DNA, 736 bp, Heterodera glycines
  misc_feature (640)..(640): n is a, c, g, or t
  misc_feature (670)..(670): n is a, c, g, or t
  misc_feature (700)..(700): n is a, c, g, or t
ggaatggtggtgggttgagtcccagtgattgaaatgttggtgggttgagtcccagtgattgaaatcctggtgggttgagtcccggcgattggaatgttggtgggttgagtcccagtgacttgaatgtggtggattgagtcccagtgattggaatgctggtggattgagtcccgttgattggaatgttggtggattgagtcccagtgattgaaatgttggtgggttgagtcccagtgattggaatgctggtgggttgagtcccagtgattgaaatactggtgggttgagtcccggcgattggaatgttggtgggttgagtcccagtgattgaatgctggtggattgagtcccgttgattggaatgttggtggattgagtcccagtgattgaaatgttggtgggttgagtcccagtgattggaatgctggtgggttgagtcccagtgattgaaatactggtgggttgagtcccggcgattggaatgttggtgggttgagtcccagtgattgaatgctggtggattgagtcccgttgattggaatgttggtggattgagtcccagtgattgaaatgttggtgggttgagtcccagtgattgaaatactggtggattgagtcccagtgattgcaatactggtgngttgagtcccagtgattggaatgctggtgngttgagtcccagtgattgaaatactggtgngttgagtccccgccgattggaatgttggtgggttga

SEQ ID NO: 40269 - DNA, 1674 bp, Heterodera glycines
  misc_feature (1538)..(1538): n is a, c, g, or t
aaaacagggatggtatccgtccttggatgccaaggacgtccttggaaattgactcttttccttggaaataaaaaatgtcctcggatgccaaggacgtccttggaaaccagcatttggaaaaaatttaataaatcaacgaaatttgagaaatttttgaaaaaaatcaaagaaatttgagaaatcttttgtattttttaacaatactttgattaattatggcattatgtcaataaaaatgtaaatttttttctcatgtttgagaatttttgaaatttatgacacaaagttactaatttttcttaaaaaattagcctaaaatcgtaaatgtggaagcgcttcgcaaaaaaaacatttttaaagcagaaaaaaagtcgtcgcaaatgaggaaaatgatcagtgaaaacaaaaaactattggaaaaaatccattctgacgaaaaatataaggcatataataaaaattttaaatgtccttggatttcatgtgttttccccactatgtccttgcaaatcggcatgcccgtagttggaagccgactttggacgataccaactttggcgtaaaagaataaaaaattagaaaaaaaaatattttaaatttttcgcattaaaagtaaaataaatttaaataatgaaaatttactaggttaataaaattgcggatattaataataaaatgaacatttataacttaaattcgcactaatgaaaaggacgtcattagtttcgaatggatgaataatcgaaattcttaaagaaaaatgtagattaaaataaatataagaataagattaataaaataaaattcatttaacaaattttatggattgaattcctcttgcacacctcaaatagttacaaaactggaaataaattacaaaaaagctacagaaagtctgttctttacaaacatagacaacaaaattaacataatatccactaaaaagatagaataattatactttgaaaaaataattaaaaaatacattaaaagataaaaaccactaataagcatttatttattataatcatatccataggataaaaatgttaataaacatcaaattttgtctttactaccttaaaacataataattgaattaagaaagaattgcatcttttaagtcgcaagattggtacaccgtaaaatgcatgtttaggctaaaatctgtaaattatgtaaaggcttggtcatttccgcgaatcagaagacgattaaaagaattaaaaccataaagaaatgttctaacttatttcgttatacattagttaaacaaaaaaaaaaaccaaaattgtatgaaattagagatttatggccaaaagtacgtgaatatataatgatatattagattaatatgaaatatattgtttaactttaattttatatcttaaatttacattaaaaagacattgaaaaaattctgaacgaattttaattaattgtaataactaatatgattaaaattccttttctttgatccgatcattacaataaaattactcaaagattttgattttatttagttaaaaaaattttanattaagtttaaattgaatactaaatttgtaaatatttgaaaaataaaataaatgatataatgacaatactttataatctattgtttaagatttttgttttaattaatttcgtaaattgtatatatgcgcatatact

SEQ ID NO: 40270 - DNA, 1046 bp, Heterodera glycines
  misc_feature (12)..(12): n is a, c, g, or t
  misc_feature (52)..(52): n is a, c, g, or t
ggcaaaaatttngttccctcctctttggaaatggtcagaaattttgcttgtnaatattcagatacaaagtttttttactgaaaattttttacacactacaggatgaacgcaaataaataatgtttgtagacaaaagaaaattggcgaaaaaaattgcctcaacaatcagtggtgaaactgaaagaaaaaaacttccccaaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcagaaattttgcttgtaaatattcagataacaagttttttttactgaaaattttttacacactacagga

SEQ ID NO: 40271 - DNA, 948 bp, Heterodera glycines
  misc_feature (885)..(885): n is a, c, g, or t
  misc_feature (900)..(900): n is a, c, g, or t
aacttaacaagacaaattttttttgaatatttattgaaatttcattacccgaaaaattcgtattttacgatggcatttaaaaaaaaaaaattttagcatttgaagcagaaaaccaagttatgataaaaaaaatttacaaataattttggtcaactttttcttttctgcaccaaaatggtcaatttgggcaattaaaaatggaattaaaaagcatacctattagggacaatttcattttcttagaattctattttgtctaaaattactcaaaaattttcaactatttactctaattatgaccaaatataaaaaatatggttttttcaaattgattttaatccaaaataaattcatttttcattgatagttttaaaaattttgaattatttactgtcttagtagaataatttatagagaattgtttagcataattttattctttttacaccaaaaatgctaaataactcatcaagacattaagaaaatctcatgaagtttgaagtatttaaagaagaaattgtatatttatatgtttcattcattaataattacaaaatataattatatatattatcatacatttagccctatttatgctaaatgatttttaattatttggtaaaaaattgtcaatccgagttggcgattgattttgattgttcattttcattatcatcggctgcaaaggttgtacagttgttgcaaaaattgtgtttgacggttgaagcccgacgaacaaagcacgtaatcgtgcccattcttttgtaaaagcattgtgatattcagtgctaaaaattggcattttaatattataattaataaaataaagtaattaaataaattaataaggccttttaatttttttagttgattattttaatttanaactaattattgttntaagaaaattattaataacatttctgtctatcatcaatttttaattaa

SEQ ID NO: 40272 - DNA, 913 bp, Heterodera glycines
tattcaaaacgagacaaacaattaatttaatgcaaaatgattgagagtcagcgactccatctcccactccgtcctatccaattccgtccctgctaactccgtcccataaattattaattattttgtcatattttttgatttttacaaatcgtttaaatttttagtgaaattatataaaaaattaacattataattaatcttggcggtgcttatcttttcggaggacaaaatattttttctataaaaaaatttaaattcactcaaaataactcccaatttacacaaataaatagagccgtcggggaccggatcccaccggggtttttcttggggtcccgatcctggactttttttagaaaaaagccgggacaggtcacggcaatcttatcccgcccgattccaatcccgagtcccaaacctgcgaattgagttcgggattcaaaaaaatttccgggcggtgcctaaggcaaaatgcctaaaattatttctcattattttgattgatagtgagtctaataataatttttattaaatccaatttaagttcaaaacatttttagaaatttttccattgatgactcttatcggcactttttgctttgcaaaataatattagataaaatattgtattactatgttggtaaccatttttagaaaatttacttaaattttttcaattttttgaaaatcgagaagcccggctgggatcccggcccaaaatgacgctcgggatcaggacccgacaaaagcagatgtaaatccccccggggtttggtccttacaaaaatcttttcaaagtctgaaattcaagccttgatatgtctgaaaatcaggagacattggattggccagctcttcttactagggttcggacccagtgggcgggggtggcttttcgcgggggcgggggttg

SEQ ID NO: 40273 - DNA, 1332 bp, Heterodera glycines
tttctttttccatctgatcagtgttgctctttcaattcccaatttctttgcaattattctgtcgctgattgttggatttctttctttaattttgaaatattgcttcatctttcgtagtttttcatctttggaatatttcttatgtgcttaaaataaaattaattaaaaaattataaaatttcacttacttttatgaggcaccaattcttttttccatctccaaaatgttttttcagaaatgcccaattccttcacaaattctttctgtttgcgttggccatataaacttttaaattcatcaaatcgttcaatgaattctttctttttttgttcataaaaactcttttccatccttttaattttatttaaatttaattcttttttccatttttgtattttgtcgcgatttgtgcctaataattgtccaatttttgtctcaattttaactctgtttttccattgttattttccgttttccttcagcttttctttaattcgttcaaatttttgaattgtttcaattttttcatttggactttttaaattttctccatccatttgatcaacaaaatgaatattttctattttgactttattcaaatttaattcttttttacgacttgcacctaaaacacttccaattttgaattcaattttggttctgtgtttgttttggtattttccttttgctctcaaattttctttaattgcttcaaattttttattatttctcttttttgttgatcatttggatagtttcccatttcttcacccatttgatcaactgttgctgagttttcattttgctctttttggtcaatttgttccgtttttacgactatttcttctctttcattttgtcccattcttcgccaaatatttcctcaaaatttgattgcattttgccggtttcaatttttttatcgtcaatttagaaaaaatatttaggcattttttaaagttttatatgcatatttaacatttcttagtctatttagcgcatatatttttattccctaaaaaattttgtcagatttaatttcaaaagaattctttaaataagttcccgcttttttctctaaaactctttttcattttctttttattcaaattcaattctttttccattttatttattgtgactttatttacttaagtgaattgctaatttaaattaagctttttaaaaaattaatttttcgttatttaaatttatctcgtttttcaggaaaatttttgtacaaaaatttcaatttttggaaacaaaaaataaaattagcaaacaaaatttcatgttttcttgcaattaaattcattttttctattttattt

SEQ ID NO: 40274 - DNA, 1431 bp, Heterodera glycines
ttttaattgcatttttaattgtgctaattgaaattggagcagaaaagaaaaaattggaacaatcatttgaagaaatatttaggagaaaaatgggaagaaaaagaagaagaaaatttagaagaagaaaataaccaaaatgaaaatgatcagaaaaaacgagaaattattgagaaattttacaaaattaaagaaaaaattaaacaaaacgaaaaaatatataccagaaaagaatggaataaaattgaacagaaaatagggaaaaaattggggacaaatcgccaatacatttacaaatggatcaaagaattgggaatatataaatggcacaacaaatcaaaaacggatgaacaaaaaattgaaattattcaaaaatttaattcaatgaaaaatgagtattaacaaaaaggaagaaaatattcaaaaaaagaatggaagaaaaatttgcagaaatttataagaaaattggaattaacgaaagaagaattaacaaatggaagaaacaatttggaatgaaaggaaaaataacggaaaagaaaagatagaaaaaataaaaatttattggcaaatgaaaaatgaaaatccaaaatgagtgatggaaaaattgcaaaaatattgaaaattaatcgaaagaacattttcgaatgggaagaaacattttagagaagaaaatgttcaagcataaaaatgggatgaattgagtttttcaagaaccaatgacccaaaattcaattattttacagagaactctttttttatgtttgatgtataaactgttttaatgactgcacatttaaattgtttacgtaggctctttttttaattgattcattaaaaaaaaattttttatgacatatgaaaattgacagtgtcaaaatttaccgaatttttcatgaaaaaaagaatttttttgcgaggcagtacatcaccctttcgccgcccacctggtactgatgcagttggtgttccgcacttgggccaacatgtgttggaagtccaccgggcggccgtccttcgcctccatgtacgccgggtcgaggccgtcgtcgccaaacgtgaactggaccacctcgttggtggaggtgcgcaccgtgttgtcatagttgacagccaaatcctggcacaattgaagcgagcagaaataataatacgataggctaattgtaactgatttttaatgttagaaaataattttttgggaaaaaaaattttggtttaaaattcaaacaaatttttttattatcccctccaaaaaagccataaaaaaaatccgctcaacccaggggcagaaaattttttctctggaaaccggaaattccgaccacataaattttggaattccggtcgaaaaagaatttgaagaattcctgaatcggagtctgtgtcccatccgctgaggcattaaatttaaaaaaaaattgcgaaaaaaacgca

SEQ ID NO: 40275 - DNA, 1265 bp, Heterodera glycines
  misc_feature (16)..(16): n is a, c, g, or t
gggtggtaaaaaaatntttgaaaaatcaataatttttgcctcttgaaaattcaacctaaattttaaaaattcataactcgcctcaaaattgtccaattcagctcatttaaagcattaaaaatcgagaaaaatagggagaattttatgagatttatttgaaatttataccacaaaaacaaaaaaagttattccagaaattctggaaattttctatttttcagaaaaaaatttatatctcggttctgaaaagtcattagagaagagtaaaatactataaaaatccgcaattttttgctctattatataaattttatttgacctttttatcatcttttaaaataaagatacaaaaataaaagtgattttggcattcgagaccaaagggggtggacaggatttttgagtaataaatttttttcaacaaaaatcttccaaaaacatgtgtttatgggttatttgggccgttgatcacgaatacgtaatcagattttacttttgacattgttaagacctcagaatccctgtgtgattggggattctgaggcatcattttgagggggcggggggcaagttcggatccggacggtgtacattatttttctatttatttttacgttattttcaatgattttaattaatttaaaatattttgctgagttaataaataaaaaatgatatttaaattaatttttttttgatgaataaattttataagttaaaattaattattttttttaattgatagaatttcatgtattttttaattaaatttgttaaaaaatattttcattttaatttaatgaatttactaatcactgttgtatcaatttatatttaaagattttttgtaaattaataataaaagaatttatgtaaaaaataataattatctttaaataaagaatttcatattttttttaattgaatttataaaaattaatttcatattaatttaaatattcaattcttgtacatttcaaaattctctttttaattaataaaaggaatgactaatttattttttaaaatttataataaattgcattcaatttttgtactacttttaatcactgttgtacctcttttaatcattttggtacctcttttaatcactgttgtacttcttttaatcactttggtacctcttctaatcactgttacacctcttctatcacttttgtacctcttttatcactgttgtaccacttctaatcactgttgaacctcttctaatcactcttctaatcgctgttgtacctcttcta

SEQ ID NO: 40276 - DNA, 1187 bp, Heterodera glycines
taagaacgttcagtcacactatcatactttatgattatatgtagtcacattatgtattttggtctactttttttgatactgcaaatttccaaaattctaattgctttttttatttgagtgatatatgactttttagtcaatattaaaaataatactttataaaaagaaaattatatattgctttttaatttataaattatatattgtttttaatttaatctttttttaaatttgcatatgtacatatatgagtaatcgattaatacatatgataaaatttagcttaataataaaattatatttgttacgtaatacgtattaatttaaccataaatcattatgaattggtagtaccctatttaaattataaattatcattttatgaattatttatttttataattgtacaaaagccaaattaaaggcagtgttaatattgtaatgccttttcaagacaaaaatataagaaaatgccgaaacatttggctttcaaacatgacactcataaatatttttgttgcaaaacgctaaattagaggtcctattttttatgttttctcgattttttggcggcattattttttgagatataattttattaaaaaagactaacaattttttcatttagatatgccattaaatattatcactaatttattgtgtatttgcctcttttttggattggctcaacaaatttatgggacaaatccaaaagcattttgctgacaacggtaactgcgaactttttcgaattgcttaaatattttaattcaaataataaaaaattaatttttaccaatctgttaaataattattgtacaatgttgttataatttgaaaataatttttagaaagaaataagcaaaatgtttcttcatcttcaaacagcgtagtaaaaagtcaggaagaaaatattaaaagtcttatcaaggtaaatgcgaagaaagcaaaataatttttaaatcattataaatttaggcaattttaactaaaacattttctccaaaaatgctgaatattttgaaagggaaaggtaaagaaaaagtgcccgatgagtgcgttaaatgcccaatttgctatgaattagtaatgattgatcagctctgtttctgtgatcatttaattggtgatgcaatttttggtagcagttcaaacaatgcacaaaaaggcatagcaattaaaacgaa

SEQ ID NO: 40277 - DNA, 556 bp, Heterodera glycines
ttcgttcacctgtacaaatcgagatggagttggaagttgggtctactttttctagatacggaaaggtccaagcttttcttggccaatttggagcagcgtaaaaggagcgcaatgctacaatttaatttcactgatggagaagcgaagaaaacaaatgataatttaaatccataattttggagaaattttaatggaaattcaaatgaatgaaatttaaaaatcatttttttaaacttcagttaaaattttctcagcctttttatttcttcaattttccgaaggcttggctcaaattttgaagaaatcaagaaaattaaactaataaatgttaacgattgatcataatgatatttttctaattaatttttccttgtcttaatcaacaaacaaccctgcccctacccatggttgcagacctaaccaccaacttttaaaaatctgccaaaattcagagaaacaagataaaaatcccaaataagattcataaaatagagaaaagtcttagctttcgaaaaagtaaaattattattaaattttacttttaatataaaaaaaa

SEQ ID NO: 40278 - DNA, 233 bp, Heterodera glycines
  misc_feature (193)..(193): n is a, c, g, or t
cataatttagacgataaatctcaaaatcaaaaaattcgaactttcgactttttgttcgaaatcgggctcgggatccggaattggtcgaaatgaatatcggatcgtgatcagcgaccccgaaaaccctttgcagcatgtttttaaaagggtgaacacaaaaaaaacattttcaaaaaagccctctaaagggatngtaactattacccttattttccaccgtccaattttgacct

SEQ ID NO: 40279 - DNA, 974 bp, Heterodera glycines
tttccgggagcgggaatcccgtaaaactcccgctcccgtacaaatcccgtccatttttaacgggagtgccgggcgggagcgggagtaattcgaaaatttaattaaataatcacaaaaatatttttaatgcacaaatttgaaggacaatccttttattaaagaaaaaacatacagaaaaatttagtatgcataaattgaaataaaaaatctttttttctgtcgaaaatcagaaatttttttcaaattgctccaaataaattattttttataatttattcgaacaaaaaatttattaactttatcttttcgacttcatttataaattgtcagattttgtcaaaaatgaccaatttttggaattttagccagttttttaagaaaattttccgggagcgggagcgggaatcccgcaaaactcccgctcccgtaaaaatcccgttgggcaaaaaagtgcgggagtcgggagcgggactcccgtaaactcccgcgggagtcccgattcgccggtctctacttatattaaacaaaaataaaataaaatgtaattggaaaaacaaccgcttttttgggtggtaggcgtaaatccggcatttctctcggaacgttttgactctgtaaggcgctttgacaaaaactgcttttcttttgcttttgttttggcaataagtcggtcaacatttggaaattggtctagaattttttcggcaattctgtcaagcccatgcgccagacatgtgacattcaacaaattgggataaaagacattaaattttaatttcgtaatttcaataagggaatgaaacctttaaatctgtcgacattttcaacatatatgaggcggcatctgtgcttatcaacaaagcattttaacatttaattgtcaaaattgaaattggagcagaaaagaaaaaagtgcaacaaaaaacatttgacgaaatattggagaaaaatgggaagaaaaagaaaagaacaga

SEQ ID NO: 40280 - DNA, 1036 bp, Heterodera glycines
gcctatgtccaaaatcgggttcaaacttaaaatttttcactaactgatagcctaaaaagcattaaaattaagaaaacagagtcttttaatttatttggagcagtaattctgttgtttgaaaattgttatttttaaaaaatttgctgacaatcaaattatcagaaacaatcactttctatgacttatgtatatacataatgctgtttaagctattagtaaaattattacttaaaaattcagagccaattttagaaaaatgtaaaattagaaattaactgttgtgtacgaacaacagttaaaaaggaaaagtttgagttaggattacaaccaaacaaatgcacaagttagtaatgagaggtcaaatgagaattaattgtcagagaaattaaaaatgacaaatgaatggagagaagagcgaggaaagggaaaacattcccattttatgggcaatcggcgcaacgcctgatcactgatctgtagggtcgcaaatttcatgtatttttttctagattctcgatacaggctggttttagatcgtgtccagacgtttgcgaacatttgcgcctcgggcattttcgccccagacatttgcgcctatgtcccaaattaggttcaaacttatattttcaatcttagatgtcttaaatattattaaatttaagaaaatgttatttttagtttattaggagcagtaattctgttgtttgaaagattaattttttttttaaatttgctgacgatcaaatgttcggatacaataactttcaatcacctatttaaagctgtttagccaaaaagtgttgtgtccatacccaaactctggacttttcccggttacttttcagcaagtatcttttaagcacaatttattaaaatgaaaaagcaaaagtggacatgcaaaattaaatgaaagaataatcgctttttaaatagtaagaaaaacaaagcaaaatgttaagttagttgtatcgctttaggcagggaacctgagtcaaagaatgggtgagtgaactcctgaggataagtgaataagcaa

SEQ ID NO: 40281 - DNA, 890 bp, Heterodera glycines
tggccttttggaacataaaaacatatcgtacacatttcgggttttggcacatattttgcacatattttggcatttttgagaaaaatttgtaataaaaaatacaagaaaattgaaaaatacaccccctaaaaatcaactttcttgcttgccatttcctaaagtttttcaaaaattatctatttatttcgaatgcgaaaatagccaaatcgagttcttaattgtgtcattagatttcgaagttctctactgggaacttttaatttataaaaataatttatcagaaaaagaccaatattaccccaaacacttcgaaatgtatttgattttcaattgtgcggacgaaaatgataaaaatgagattttttggaatttttatgtaaaaatacacttgatttttccaatttttaacacatattttagcacatatttcaggatttttagcacataaaaatccgggctctagtgattatccttttatttattatttttcatgacgattgttttgcattattttccccatttgaacattttgttgttgtcatttattattaatagggttataagttgtatgcactaaaaaatgccaaatatgcgcataaaatatgcactaaaaatcccccaaatatgccctaaaaacccgaaaaatgcccaaatatgcactaaaatatgtcttaaaaaactgccaaattgcttttagccctcaaaaaatgccaaaaattgtgtataaattaagaattgacttttaaaacaccaaaacaagggctaaggagcattttttagacaattgcaaaaatattgaaatttccaaatttataaatttgattatattatatgataaaacaaaattacatttttatatacataaatttttttccaaaaattcttttttt

SEQ ID NO: 40282 - DNA, 809 bp, Heterodera glycines
attccattcgaaagaggtcgagagtggggagaaggcaaacggaggcgggggggggggggggcgtaatcatcgtaatactgggcaaacaccgccgaagaaagttgaaatgaaatgagagacggagcggaggacggtattttaaaaaataaattgcgcaccaactcacccgcgggggcggggggaaacgccgaaattttagcccggaatttcggcgaaatttcaaattgtaattttgtttaaagtcaccgtaatttacatacaatcggttgtgtcaaagggccgaatgtttttgggttacgaaatttgaaaatcttccgtcggatgtttttaatgtgtggcctcatgtttttccggctgagatgtgaagtttggtcaaattttgtctcacaaattttgtggcctcgtgactccctcccagcggtggcagggcaatgattcgggtcaaagtttttcctttccccgtgattttcatggaattagaaaattggtatctcatctacaccctcctaccctctcgttttggtggtaactctattcattctcctcttgaagatgtatcaaattgtgcatatacatcgggtatttgtaccatgagtgatacaatccaacttatttggaaaccgaaatcagggagcccgtgacaatttcggatctttggagtatttaatggtcgaatggtgaacaatacctggttagcagacgaaactcagcttgcgctaacagactcgcgggtaaaacctatggtaaagagctgtaacataacacttcgattaactgaacaaaatttagcttatcaaatcattaagaat

SEQ ID NO: 40283 - DNA, 1350 bp, Heterodera glycines
ttattgctgtttaactgttgtttggtctgaaacttgttttatcgagttgattttgattatttgcgtgtgttctgaggatttctctgctcgtaattgctctgtctcttattttcctgtttttttgtttatttatcctctcgatctgttttatttaaattccaaatgatgtaaatatgttggttttcccttttccttaaatgtgattttaaaataatgttacctcgttcttaactatgcataatttcaagtaaatttaggatgttaaaagcttaccgccgttgctgaaaaaagcacgcgcttccacggcctggaaatttgttttggctggcgcatccgccgacacgaactgttcccttttcctggacgaattcgcaaaattattggaccaactgccagaggtaaataaacttcaattattaaaatgggatgggaatgtttatgctgagccgaatgaatggatgatttgcggaatatttacaaaagaacgtttaggacgatcgccatgccggcgttgttggaaatgtggcagctgggccaggccaagccgcgggatacgatcccgattctcgtttgctgttggtgctggcgacgaaaaatcttttggaaatggaaggaagcaaaaagacggccagcggaggtggcactcttggcagcggcgtgccgccggaattcatctctgttggcatcatcataagacaatttcaaattaataattttcagggtttcatgcggcttgttgggttttatcaacaaattgttgtgtccgagtctgctgaagtgtggcggtgtgtgtcaaacacttaccacgacgactgcaaaaagttttttgcggaattgggcgctgtcttgcgcttagccaatgtaagttgtttaatgcgaattttcaaaaattagaggggtgaaaaattcggaaaaagcgggggattcccggtggttttcacctgcttttttgattttcatgattaatgttagttaatttagttttagtatgctggtggttctttgagtgttaaaggcactttgtttggactctcccgccaaaacgtttgccaaatcaacgtttacggttcgagcatcgccatgtgttccgttcatttatatgttttcagtttacggtgatatctccaatggctccgtcggtactcctttcgcagctgacgaacagaaggttttgttgggcgagaatgctgggaggggtggggttttgtctccgccgttccgccgcgagcccaactctggactatatttttttctttgtcatctaaatttaataatcttggtatcattccaaatctcttcacatgctccgttagccttacaaaaaacagacaagagctgctcgttgagttg

SEQ ID NO: 40284 - DNA, 194 bp, Heterodera glycines
cggtgtcattatgttactagatcggggatcgatccccgagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgttattatagacctgccaggc

SEQ ID NO: 40285 - DNA, 814 bp, Heterodera glycines
atctccgctccctttggttggctaaccggacttgcccctgtcgtcgccactggtggtgcttctcccgtcccccttggcgccccatggccctcgtctcttcccccgtgccgttttccctccccgtcctgcgacactttcgtccttccgtaatcattcttcctcagcagcagaatctgcttattcgttcccccgttttcctcattttcctcctttgctccctcttcctctgcttctctgccgttttcattctgttcacagtctctcatcaccggcaaaatgcaatcgaatccgagcagtgatgtgaagtctttgaccagcccgaaatcgccgttgacatcgccaattgtgctgagagcccccggctggtgatgttcagcatggacggagttggccatgctcggaatggccccttcgctcccggacgaacactgctgtggccgatagggcggaggaggggggaggaaggagcaagagccgcacagggaggagccaatggccgagtcggactgttggacgaggaaggccaagtgggggcgcgaggagggcgacgaagtgcttctgaaagtgagtcccttggcactctccgccgaccatttgatttttgagcttttccaaatttacatttttattttttcaatttcccccatttttcattttaattttttttcttcccccaacgtttgcttctgctttttctgctgttatccatcctcaaaattccacctttatttttatctttggaatttgcggaatttctccgtttttgtcaacaaaaaaaaaagggggcttttcgttttattgcaaaagcgtaaag

SEQ ID NO: 40286 - DNA, 1165 bp, Heterodera glycines
caacggtgtagaaaaaaagagatagccattttctgagaatatctattcttttgagaaagcattttcaaaccggacattttgtagggctcaacggcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagaaagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagaaagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgacccttttgtagggctcaaccgcagatagtaatgcgttttt

SEQ ID NO: 40287 - DNA, 790 bp, Heterodera glycines
  misc_feature (683)..(683): n is a, c, g, or t
tgaaagtggcacaaagcataactaattattaaaggcagtgagtcatatcactcacaacgaatccctgccattttttgcacgtttttgaaaggttcgcaagatctttaagtttggctttgaagacgccagcgtcggaagggtcgataaccgctctcattgtgatagggcacacgatgtcgaagaatttgcaattgggaatagattcagggcacggtcctcctccgtcattctgaaatgaaacaagttaaaacatctctttattagtcgatgcaaaatgcgagtctcaccggtttcttctcacaactgttatcaacggtgaattggacattcttgtcgaaggcatctttgcactcctcttccacagccatccgaatgctgagttttccttcgtttttctgctggaaataatacaacgatgcatccgggggaactccttctgagtccatgacactgaaaagttggaaagcaattaatccgtggcttcattggatattgtaactcacatcatcccgtccttctgagtgatgaagccgtgtttcgtgtccttctttgcacagacgaagttttccatgttcagcggcccgtcatcaccagcagccggtggctccgtcggcggcgggtctccctcggcgtgacagccccgacagatgatgagaagaataacggcaagatggaaatagcgnatcattgagattcggaaattaagagaatttctctcaaaagaaaaaagccctgttataagggcatgtgaatgggaagggtcgactccgtcgagcagagaccggcagcc

SEQ ID NO: 40288 - DNA, 1044 bp, Heterodera glycines
  misc_feature (1032)..(1032): n is a, c, g, or t
gggcgaaggcccaccacgaggccgcgaagaggccgagtgagtaccttcggtgcaggaaaattattaaatttaaaaaattttttaattgctttttaaatatgccaaaaaatgtaggcttaacttttttagtgaaaattcgatcactcatattttttgctaattgagcagaagcgtaccaaactttgcagggatactcacgcggtaaaggactaacttacactgaaatgagcgccgagctagctgactcaaaaaaattttcgaaaatctgagtctttcgtttttatttgttttttgcataattaattcataaatatttttttcacaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctacagcctgtactttaattctgcgttggatttttgctcccctataattgtttgagtaccccaaacggacacttgaaaaaatcgatttttttgttttcggggcggtccccccgaaccgatgcgcccagatttatggggagaccgaatccttcgggaatagcttcctctatagctctgtactattaattactgctgttggantttttgctcccc

SEQ ID NO: 40289 - DNA, 725 bp, Heterodera glycines
ttttggggagaaaaggggaaaatgggtgggggagggaccaactcaactcaactcaatcagtgattgcgatcagttgtgagtgtgttgcccgctgatcagtcggtgtttgttgtgtcacagcaacgacacaattgccgacaaagggagggaggacaaacattatcagaagaaaacaaattggagggaataaattgaaaattcaccgaacgatttgctttgagctgctctctcccccccccccccgccgtttctgtcatttgttttcgcctcgccccgctaattgccgttaattaccctttaagcaattaattaattaatcatcaaattttccacacatttccctccatttgcaatttctgtcccattgttttgtcggctttttgcttgttctgtctctgttcagaaagtgtgttcaattggacgaacgaaataaactttttcggggtcggcttcagtggcgtttcattttttcgtctttttcccctttttaaattatttttgctgcaatttgctgcttttccttttgcggcttattaattggaaaaaaacaaaaggagcctaaaatgggtaaaagaagtgatcaatcgttcaaaaaaccgctgcccgcccatttgaacgatgcgccgcgcgaagcgatgacaaatcgaatggacaggcgaaaaacgaagggatgggtggacaaagagtgagtgatcagtcggacgggacggggaaggggggggggg

SEQ ID NO: 40290 - DNA, 830 bp, Heterodera glycines
caccccccgttgaagcaacaaactgaaaaatgctgaagaatgtacgctgaggcaaaattggcttgggaaaatatgatggggtgtaaattgaggtagagaagtcagagaaaagtgtaatatttcttctttacttagcgacccaccgtggggcgggccggagctagttcctcctataggcgacccacccccaaaagggagaatcccaccccgtgggtcgcctggcgacccaccccccgttgaagcaacaaactgtgctgaagaatgtacgctgaggaaaaattggcttgggaaaatatgatggggtgtaaattgaggtagagtctgttacagggggtgagtcgttggacgactcttggagtgagtcgttagacgactcaaggagtgagtcgttagacgactaatggatgtttagggacagaaacgacccaccccgtgggttgggtccgagcaagttccggtttttgacgacccacggggtgggtcgttgacgactcatggggtgagtcgtataaggggcaagttgttgtcaaaagggggtgcatcgtaaaaagactcaccccgtaggtcagatcggagaaagttccttctattgacgacccatctttttaccgccgaagaatcataggaagcagctatctgcaaaatgctgaggaatgaacactgatccaaaatggctgctcttttatattcgggccatcagcatcgtggatttgccttaaggaaaaggggtggatcgtttaacacttatgtatttaacaaaaaatatttcattgtaaatatacataaaagtaaaaatagttaaataaaattctaatgcgcaagaaatttat

SEQ ID NO: 40291 - DNA, 843 bp, Heterodera glycines
ccggcgatacccggatccggtattttcccatactcgtacccgtaatcctaatttaatatacgattttgattgtttcgtttttgaataggagcctggcaatacttgtatttggactattataatttttaatattatgccttctattgttgctgtgccctctatttatgcacctccataagcgatcattatttggcaattatttatgtaataatcagagttagacagaagtgtatgcattccgtgattcattttgagggttgaattttcggtgatctaatggaaacaattctcacttttttcgattgaaaatttataaaattgtgaaggaaagtactgatagaataatttttcttttttttatgaagattatgaatttctagaaaaatttaagaattttaatgaatttgctaataatttttacaacattttcgattaaggtttttattattttttgtctttagtccccaaaaaatatggacatagatttcaaccgagaggcaagagcgtgaaaccgaatgaaatgtgatttttttcatttcaatgaaaaattaaataagtattttttcgaataaagccaaattttaaatcaaaatttttattaagaaaaaaactatatttatgaatcttttttgcgaatcttttttaggtatttttctaaaattcccatcccctatttattaataattaattttttattatttaaaatattttttgcattaaatttggttattttttgtaaaaattcttgttacttaaaataattcttattttacataaaagtatttcttttttcgttaaattatttagtttaggagaatttattactgctatgccggccgatgg

SEQ ID NO: 40292 - DNA, 953 bp, Heterodera glycines
  misc_feature (38)..(38): n is a, c, g, or t
catgattatccgaattgagtgcttttgctttcgacggncccgaggtattctcaatttccagtgcaaaattttattaattttaaaagattatgaacaaaaatgtttggaaaaccagtttataatacaacgaaatttttgaaatttcagtaaaataaatattttatgatatttaaattataaagccaaaaactgagctcgggccccaggtgaccaagtactgcctgtaggcgccgtctgggaaaaacgaaagttactaaaaaagctatttttttacatgacatttacaattggatttttgggaaattacaattgattaaaaataccaaggcttttaataaacatttcttattttcttgcataaaggttttctcaatgctttttaaatttatcatcttaaggacacacacattacgtgatgcaattggtgataaatccaaaagacaacaataccctttgccactgcatctctggacaaaacaatcaaagtttggcagttcggaagctcagtgcccaattttacgcttgagggtcgatgaaaaaggggtcagtccatggatctcactatcattcgaacttagggtaatggtttatcgaaataggtcaattgcgtcgattattatcacggaggtgagaagccctacttaatttcgggtgcggacgaccgactaatcaaaatttgggactaccaaaacaaaacttgtgttgtcacgttggatggtcagtcccacatggtgtcgcgacagtgctgtcttccgcctacgggatccgcatattcgtcggcggcttcgggtgacatggtcgtccgcagtggccacagtcggcaccagcggcgttacgccgtacgcgcagttgctgcccatgggtggtggcggtactggtgccatggttgactcggctacggctgcaaccaatacgcttatggcacaacagcaggcggccgctgccgcggcaat

SEQ ID NO: 40293 - DNA, 1139 bp, Heterodera glycines
tttttttttttttttttccccaaacccggttcaaaattaaaaaaaaaaacccttccccgggggaaaaaaaggggtttaaaaagttttttgggaaaaaaaaacctttcaaaaataaacccgggggaaaagggagggggaaacaagatttcaaaatttttcatttttttttagtttaatctctcaaaagcggtcaaaattccaaaaaaaatacccttcgcggtgcgaaaaagggggtataaaaagtttatggggaaaaaaagactttacaaaataatccccctgggagaaggggagtgggaaacatgattccaaaattttcaattttttttagtctaatctactcaaaacggttcagaattcaataaaaataccattcccggtgcgaaaaaaggggtatgacaagtttattggggaaaaaaagactttacaaaataatacccctgggagaagggagtgggaaacatgatttcaaaattttcaattttttctagtctaatctactcaaaccggttcagaattcaataaaaataccattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgacaagtttattggggaaaaaaagactacaaaataatacccctgggagaagggagtgggataaatgatttcaaaattttcaattttttctagtctaatctactca

SEQ ID NO: 40294 - DNA, 865 bp, Heterodera glycines
tgagcagttggaacccgagggcttggcttatgggcatgtttggcacccgtgagcagttggaatgggcatgcgtggcacccgtgctcagttggaacccgagggcttggcgaatgggcatgcgtggcacccgtgagcagttggaatgggcatgcgtggcacccgtgagcagttggaacccgagggcttggcttatgggcatgcgtggcacccgtgagcagttggaatgggcatgcgtggcacccgtgctcagttggaatgggcatgcgtggcacccgtgagcagttggaatgggcatgcgtgcacccgtgaacagttggaacccgagggcttggcgaatgggcatgcgtggcacccgtgaacagttggaacccgaggcttgcgaatgggcatgcgtggcacccgtgaacagttggaacccgagggcttggcgaatgggcatgcgtggcacccgtgagcagttggaatgggtatgcgtggcacccgtgagcagtcggaaagcgagggcttggcgaatgggcatgcgtggcacccgtgctcagttggaatgggcatgcgtggcacccgtgttcagttggaacccgagggcttggcgaatgggcatgcgtggcgcccgtgagcagttggaacccgagggcttggcgaatgggcaagcgtggcacccgtgagcagttggaatgggcatgcgtggcacccgtgagcagttggaacccgagggcttggcttatgggcatgcgtggcacccgtgagcagttggaatgggcatgcgtggcacccgtgctcagttggaatgagcatgcgtgcacccgtgaacagttggaacccgagggcttggcgaatgggcatgcgtggcacccgtgaacagttg

SEQ ID NO: 40295 - DNA, 465 bp, Heterodera glycines
ggaccgggatttttgacaaaaaccgggaccgggacttaccgggactagaaaagtctggaccgggaccgggacctcgattttcgtccgggaccgggaccgcaagaaaagccgggaccgggacctcgattttcgcccgggaccgggaccgcaagaaaagccgggaccgggaccaaccgggaattttcccaagagaaaaattttttgaaaaaattttgaaaatttgagtgcactttgttacgaaaatttcctaaattaaaaaatgtgccaagaaaattaattttcttttgggggaggaattcgaagaattttctattattctctggaaaatttttaaaaattttgatttcagggggggggtcttggaattttctgggtcccaaaattctggattttttaataaattaacaatttcttaaattttttgcttttaaatcgctgtttttgtggcgctgtttccctaagaaa

SEQ ID NO: 40296 - DNA, 731 bp, Heterodera glycines
atcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcttaaaaagagatagtcatttttctgagaattaattcacaatttctgcagctcttacggtaatggaaaaaattttgaagaggctctcaggaacggattagcatcggggttacgagatagaaaattgtcctaaaaagagataaccatttagcatcggggttacgagatagaaaattgtcttaaaaagagatagccatttttctgagaattaattcacaatttccgcagctcttacggtaatggaaaaaattttgaagaggctctcaggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttcgcagctcttagggtaatggaaaaaattttgaagaggctctccggaacagattagcatcggggttacgagatagaaaattgtcttaaaaagagataaccattt

SEQ ID NO: 40297 - DNA, 739 bp, Heterodera glycines
agttaaagaacaaattatatctgcaaaaattaacttaaccacgacacgaaatccaaaataaaatgccaaatgtaagaaaaaaaactcaaaaagaattgaaataaataaataaattatttgatacaaataaacacttcatgccataaattccacatacactcgagcatctaatatttatggggagcatgatgaaaaagccaaattggacgtgaaattttaatattcaattattttactatttaattattccaaaaaagtaaattttagcaaattattcaataaaaaataaaaccggtaaaataaagaatgaaaatttataaacatatcggcataaataaaataatacttaaaacaaaatgacttaactttatttcaaaaataagaaagcagaaaattaacgttaaaaacagataattgaattaaacattcatttttatatgagactgcgatttttaaaacatttgaaaaagtattaaaatattcaaaagaaattaaatataatactatcgataagaattatgataaagatataaaaaaatccaattaattcttaataaaacaatgagaaagataaccgtggaatttgaattaaggagccgatgaacatcctcgaaagcttatcatgtaaaaacataaaaaataaagtaataatgaataattcaaattcaattaaaaaattaatgaattattttagtgttgaatataatatttttgctggctttgtatgcgaagcgtaaac

SEQ ID NO: 40298 - DNA, 1196 bp, Heterodera glycines
  misc_feature (52)..(52): n is a, c, g, or t
ggagcgcaacggggccgtcttcatgaaatgcgtgattttttccgacctcatntaaaatacatgaagaagctagtcaagcagggcgaccctctctctgccggtgccatcaaatatttggtttttccttttcttccctattgttctcgattaataacattagttaaggtgaaactcggcaattacataactcagtatgtcatcaatctcatccaaacgtgagttgtccatttggttttgcggtaaattttttctttttctccagaaaagagcctgtcgccgtacagaagcaggtcagtttatttcatgtattcaaatagggagggactgccttttgcatttcgaaaaatattttcatcgattgccaataattaacgaaatacactaatatgattactgcaatagctttaattgatcaatttcgccccgtatttaataatttattttaagtggcacaactacctgtggatattcctctcacagtttctcaaaacacaccatgaccccgaattgttgttgagcacctacaaaacccacgcaaagcggcatcaccacgaaaacgcagaaagaaagtcggatgcccagcaaggggccggtgccgcggacgatgcgacgaggaatatggccaggaaaccgcaacattttgttaacgacagaaattcccaatagctttttataggattgaataggattgtcagatccagagaatttctgtctgaaattatactcatcaacaaacccttttttcgtaccggtcatgcatatttggatcttgcaatcccattgatcagacctttataacgttgttcgaattcgtggtacaccttttgtctattcatttttatatcctaagcgtaaaaaagaataaatccttttttagcagttagcatttaaaatagaaaataatttacataacgataatatctcttgtggtggagttggtggtttggctttttgtttgttaattgtcttctgcatatttacgattacgatttccctttccgcttgcggcgctcttctgtctcaattaccgattttccacctatccgccaccctttttcgtccacccaatcccttttacaatgtgcaatcgtcgattttcaagatggagatgtttgatttgtattttattcaatctttttggctttttccgctatttatggcccaatggcgtaggtccacttttgacctgccaggcc

SEQ ID NO: 40299 - DNA, 677 bp, Heterodera glycines
gacccttagaaattttttcaaaaaattaaaaccctaaagttcgtcatttttcagtttttttttgagttttcgaacatcccagaacggtaccatccgaaatgggctctgaaattcacccggatatttgaaaacagaacaatttaactattttcactaaaactgcaattattaataaatgtattaggaattttttttgtttgttatgggaggaaggaaaggctttactgccaatggctttattatacatatttcaaaaattggcatcttttctcactcatttttttgcctatcatggcttttcctcattttcccatttgccacagcagttgtaaggcattcgtggcaactgatatagctgaattatgaaataatttggcaaaaaaagtggcttcgagatggattgccaaaaatgcagagcatatattcatcgatttataattttttacaagaaaaaccaaaatttatttggcataaattcaaaaaatagtaaaaaagaagctttacgttatggttttggaatgcggtttttatgactagggttataagttatatgcactaaaaaaatgccaaatatgcgcataaaatatgcactaaaaatccctcaaatatgcactaaaaacccgaaaaatgcccaaatatgcactaaaatatgccttaaaaattacccaaaatgactt

SEQ ID NO: 40300 - DNA, 383 bp, Heterodera glycines
  misc_feature (46)..(46): n is a, c, g, or t
ttttttttttttttattttgggggggggggggggggggggggggtnttcccccgcgggggggggggggggggggggtttttatcttttttttttttgtgtttgtgtgtgtgggggggggggggggggggggggggggggggggggttttttttttttttttttttctttgggggggggggggggggggggtgttttaaaaaaaaaaggggtttttttttgttttttttattttttttttatttccccccccgggggggcgcggggcgggggggggcgttttttttttttttttttttttttttttggtgggggggagggggggagggggggttaaaataaaaaaaaaagattttttttttttttttttttttttttttttttt

SEQ ID NO: 40301 - DNA, 1496 bp, Heterodera glycines
cccgcccccccgggacgggaaggggccggccgggacccgagggggcgcccggggcagacggacaacctgggccttgcggggcctcctgggaccccccggcaccatccggagaaaagggaatctcccccaaatactgcgccatcgacggaggagtgtcttcgaggacggcacccggcggtaagatggcagtgtggcccgatcaacgatcagacgaccccagaaacatccggcgggtcgaatggggcggaggtggcggcgatgggagaggcggagaaatgtccatccgattttgggatcgattcgattttggcattcgattcttttttccgtccgtccttctccgattgtcccttcccttcccatttcatctcttttctttgtccctttgttgtcccttttcgctttcccctcaattaggcactcttttccttctccgttcgctcagtgtcctctaatgatgacacaccaaattaattgtgcaacacaactgaataaaattgctaataattaattcttaaattttggcatttgaaatcgcttaggagacgcacaatggcatttaaaaaggtacttttcggttgtgcggccacacctccacatttaaaaaaagtgtttgattcatatttgtgcgaattccttaggcgcgaagactgcaaagggcataacgatgatcatttcgatgacattttggctcaaattacgacttttgttccccctaaacaattgttatgctctatcacgggcgctttttttctcttttttagtatctttaaaaatgccaaagaaaatccgaaaaaaaaataaaatgaaagtgtgaacatttatttgattggtatcattaaacaaactttacataacgctaataattaatcttatcaattaaataaatgacacctttttctttcgacaaattcactttttttgtaatttaatgccttttgtttttttccataaaaatgccaaagcgaagaattccatcacaagaggaggtcaaaaagcgaagatataaccaattgagcaaagaagcgaagccgccaattgaaaatcattgacaaaaaagaacaactgataagccatcaattggccaaaccttcgccggtggtcaaaggcacccgccaaaaatttaaagttcgatagtttttggcaaaaaagaaacactgacggacggacccgcgggcgacagacagcgaacgcacagaacagcagaagcaaaaggggggggggtgaggctggggacgggctggagatgggtttgctacttaaccggtccgcgatcgagacagtgctggagggcatgagagagcagaaagaacgagttgatcggttgctgatcactcactccaggcgaagaatagccgaaattcacgcggacgatttgtccgacaaataatcactttatgcacttataacgggataatggatcacgctgatcagctgaagcacaaaagggaattataagggccaaaaaagggcaggggaaataatgggaaaatcaa

SEQ ID NO: 40302 - DNA, 940 bp, Heterodera glycines
cggaatttcttaaaaaagctaaaatttttgctcgtatttgatttatagttattaagttttttaaaatcttatttttgccacataaatatacataatctaaaggttgcactttttcttacttcgcgtagacgttttgaaattttcttgaattttgataaatattaaattatttaatttatagcaggaggtaaagtaaatttcaattaaaataattaaatttattatgtgcctaaagcataattcaaaaagttgttcaacaacgccattccaaggttgagaaaaacgctgtcagttttgctcatggttcgtacattggatgaattggcatatggtagtttatccgtattttgaacaatttttgggaaccgaatttgttagtatgattttgtggcgtttgtccatttttcttgcattcgatgagctaaatttactaatgaaaaattcttccatgaaaatgtaaaatttgggcggttgttctccatttttgtcattcgaattaaaacctaaaaggagctattaattaaaaacacattatattttggtctcatttctgatcattcgaattgggaataatattaataaaaataatttttttttttatttaattaaatattatcatttaagaagaattactatttttaattataattctcgaaaaatattccattttgttgacaaatttggtttttattttatttatttcgtttttttgtataaacttggtttttataaagaaaatatattcaaatgagagaaatagtataaaaaaattgtataagcagccaatggcggataaagcaaaaatgaaattttaaaaattttcgagctaggccctctaagaaattttctgaaattgttcaaaaattcgaattttagaaaagcattcagaaattgggctctgatctgatgccagaaggaacggagtatggaggactctaga

SEQ ID NO: 40303 - DNA, 1456 bp, Heterodera glycines
tttaatgccaaattatccgacctgaacttcaaatgattcaccgaacaatctgatcaattcctccattgtgctagtttgcatgttcgatcagtacatacactattccaactcagcttcaatggagtcctgtgtcggataataacaatggattattgagagattcgtggtcagtctctgtattttttgcgtgatgagtgatcgatataaacggataaagcggtcataacgatataataaacaatcataccgcacttggaaggtctgcatgaaccggcgcagttccacttgaatgcgcgggaagatggactgcatcgtctgctccataacccgggtcgactttatcctgagaccgccgtacacaatgtgcggtctgttgggcatcctaacgtcgttcgaaaagggagctaatatggactcggtgcatgtattagtcgtagtttgtgacccagcactcgaataaaagtaggaattttgaatttttcaaattatgattttttgttcaaatttagattaggaaatcggaattgatcaaaataattgaaggattcgtgatcggggaccccaaaaaccccagagaataaatttttatgactatcacaaaaaaaattttgcaaaacaaaagggtccccccttttgaaaaaattttcaaaacggccacttttagactagcgccgcaattttcatgtttttcatgtataacttttttggtaattgtctaatcgcgaagtgatacatagaattagattcgaaacatgttaagctttcgaatgataccaacaatcttggatttggatgtcaaagaaaaaagttatagcgaaaaacataaaattttttgaaaatctgcccacagatcccacacaagtacccatttatttatattttcaggaaaagtcattaatgctaaagaggtcgaaggaacaacaagtcttgctaactgtacgaccattaaaaacagcacaaatttttaaacaataaaaatgaccgatttggatgcgtttttcgcgaagaaggctagcaaaggaaaaaagaaaggagtgatcaaattggaggaaataagtgtgcaattggagcggagagcgatggtattttttaaaccctttattttgaaattatgcaaaataagagaaggtataaaataaacgatttcgaagaggctttttattggtttttgtttttgccaacaaaatggaacatttttgaattcacctgaagagagttcttaactctgaatcgtgattgcattttttgttttaaaaattaaaaattttaatattcatttaggtcgaatatgccttgatgtttaatttttaattgttccaggaacaaagagatgagactgatgataatgaaaataaatcgtcagttgaggacattagcaaaagccgacccgcgaatgagcacaacgaagactctgaaatggtggcatttgacgacaagccgaacgtacctgtggtga

SEQ ID NO: 40304 - DNA, 1336 bp, Heterodera glycines
  misc_feature (1249)..(1249): n is a, c, g, or t
catatgaccagtgatcgctttaatcggtggcccgggagcgccgtcgcaaatgcctcggaggaagcgaacacccaaaggggcaccgaaatgccatccacttccaattcgccgattgtgccgcggaagtgatttatggccaaatccaattgctgagtcagtcgcgcatcggaagagccgagagaaagaagtgtttggccgggaattgtgttgaaaatctaagaaaaaggagacagaattgggagaagaagaaaagagagagagagagagaaaagaggagagagagagagaaagggagagagagagagagaggaagagaaagagagagacgagggataaaaaacagactaatgagagagaagagagagagaaacacacagacagaccacgtctgaagaaacgtccgggtcgccgactgccacacggtcaatcgcgtcgacgtcgcgcgactcctccgagccaaggctctgccgaagcacaacgctcgccttcattgtgtttgcaattctaaagactagcttttattcattctttctcgaccccaaaaaatgaaagttcgggcgtcccgagagcatttagcaccttttcacttcgatttggtaccaactgtaacggtcggatgccgggatgtacacaatgttccggttgataatttgagcctgacaaaaaattgatcagaaaagcctcatccatctggttagccgcttggaattgtttcattagtgatcaaatggtaattccaatgttttaatcattggcttttcataagaaacttcacgaggaaccgatccaagagaaaacagccaaaaacgcggaagggaaccactcggccatcgaacacattgaaaacgccttcaattttctcccatctattttcctttttcttccctttttcatcttaaatacctcgtttttgttttctctttctttctttttacctaattcctttttctctctttctcttaaccccttttctcattatgtctctttgttctctctttcttatccctatgctcttctctctctctctctcgctctctccattttcactcgcctctctacgtccccctccgatgtcccatttcacgtggattttcttctgcttcagttcaattgccataaattcgctgctctgagtgcgtgtgccctgcacttgggtgaacagaatgagtgagtcgggagtgtccaaagcggggcgatatttaatggcgattgaattggaagaggagggacgcctggggaaagaaacganatgccaaagagaaatggcaaaagagcaaacattggggagagatagtggcgaacacagccactgccctggtcagaacggactccgact

SEQ ID NO: 40305 - DNA, 1100 bp, Heterodera glycines
  misc_feature (161)..(162): n is a, c, g, or t
gcggatttttagaggcgaaaaaatacaaaaatagatacctaataagggcaaaaaatcgcaaaaataggggtgtaataaaataatgaaaaataaaacaaaagaaataaatcaaaaattaaaaaatcttagccgcaaaaaaataagtgagacaaaatccgccnncctaatacaaaaataaccaaaataatgcatcacttttcgatgcatttaagcttcaataattgctgaagagttacggcctttttcttacagatgagaaaatgaagggcttacaatcaaaatggaatgcctgaaaatggcgacgcatgttaacctttgatgagaactttgtcttgcagtgtccgcatttgttgccaacaagttctttcaggaattatcttcagtgatgctgtcatcagcttcacgattgtcttcttcagtgattgtatcttcaccgagacggccatgttgagggatactgtcgtcaactccgcgattttccatcattgttggatggctcattccgagacggccatgtacagtgatactgtcgtcaactccgcgatttcccatcattgttgaatcaattccgcgattatcattgttgactcaattcctatgtcctgtagactcgcattatcataaagctcgtccggatttttgtcgaaagttggtaatccttcaaatgcgtcttctgggaggatttgccgaaagttggcacctgcttttatgtattggatcacacgggaccctagctccaaaatctggacaaccgtttgccagcaaagatacgttctaacttccgtttcaacgtcatcttcgttttcttttcgggcaggcatttggtcagttataaacggcacattatgtgcggccatgtatttttcggtatcagtgcctccgagttctttctcagaatcaatttgcgagcgttttccaatttcttcataagattatatggtaattccaaaaatgtctcaatttccgtttcaacgtcatcttcatctttttgggcatgcatttggtcaatgcggccatgtggttttcggttcagtgtctccggttctttcgatcacgattgtatcttcagtgtcagtgatgtctctcaccgtctggaaatg

SEQ ID NO: 40306 - DNA, 1134 bp, Heterodera glycines
tatttatttttatatatataaattttacataataccaaatattttcgcgttcatattcttacagataaaatcgcgtcttattctggagtttgtcacagttgagacagaaaaatgaattatttatgtataattttcattttcaaattgttttaaatcagttttttatattaatgtttatttattgtttttattgtattaggatgagtttgaaacaaaataaatattatttatttaattactaatttggtaattctatctttaaacatttattttatgtaattattaaatgatcttttaagtgttaaattcctttttttaaaacatttttttttttttttgtaaatggtttgcggtacactagaaattttattttatttctttttgtattagtacattagttcaattttgttaatttcttttaaatcattaaattatatttttattttatttgaaaattttatttcaacttttttttaggagattatattattttttaaattcaagatcaaattttataaatattttattttattcacgcgcttctgcgacaatttcccgagttgagattgagttaatgtaaaatatttttaataattataattataatatgtataatagataatttccttcaatatgttcaacatcgaaggcccaccgcgagaccgagaagcggccgagtgagtaccttcggtgcaggaaaattattaaggaagagagttcattatttatttattttttgcataattaattcataaatatctttttcagaaagggttctgaaacgcacctaattttatttacatgttagtttaggcactcttatgctttttctatcaaaaagggagatgaataaaatttttaaaaatttttaattcctttataatcaggccaaaaagtttaggcttaactttttagtgaaaattcaatcactcatttttcgagtagtgatcagaagcgagccagatcttgcaggggcctaaaaaggtcaaggaaaggcgtctttgcgttgatttagcagtagtacctatgaatttaaattttctatgaatttctaaagtcttttgaaatttttttaagtgcaataagtggtggtgtctgcaaaaaattatcaaccgggttaaaaaatctcggaaa

SEQ ID NO: 40307 - DNA, 906 bp, Heterodera glycines
  misc_feature (836)..(836): n is a, c, g, or t
  misc_feature (842)..(842): n is a, c, g, or t
accatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatggcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgttttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatcctaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtanatctgnaggtattggcgctttatcacctgatccgtctgcaacactttaacagtttatatttaaagcctaa

SEQ ID NO: 40308 - DNA, 757 bp, Heterodera glycines
  misc_feature (584)..(584): n is a, c, g, or t
  misc_feature (641)..(641): n is a, c, g, or t
  misc_feature (717)..(717): n is a, c, g, or t
ctccggctcttccatcgaattgccataaacgcgttccgtccactgcgcaatgtccgcccaattgtacatttcggccacctgtcgatgcttcttcaccgggcacggcaattcgccattctcacgccgacggatggcatccaaaagaccaactgcaattgctgtataaagtatttggattataaatgagtcaaataatgatcgaagaaccaaaaattattgttaaattcaatgggaacaacctaatttaaatttggctacggtaaacatgaaccaatctacaatagtatttgatactgtgtaatttcataaaaaattggacaataccttttggatttgggtcgaccaaagagatgaattccggcggcaaaacttcgggaattcctccaacgcgagtagacaccacatgaagacttaacacaaaagtaaatttagaatgaaaaagcaccagaaaaatttgatcagagagaattggggaattgtgcccaacgttttgacgcgttcgtgcaaccgacaccgttctcgcatttcctcaatgtccactcgttttggaccatcgccaccgatcagaaattggactgaaatgncaaggacggagataaagcattattgaaagtattcttggaatcccgatttccgataanattttgggtctcgaaatgccattcctgatatccgttatcgaatggttccatcgaaaataaaaatattgtttgattntaattatttttgcaaataacaaataatattttctaaaaat

SEQ ID NO: 40309 - DNA, 1651 bp, Heterodera glycines
  misc_feature (636)..(636): n is a, c, g, or t
tcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttnaagggtttaaattgtacccattccgatgaccggcctcataagagatcggtctcgttatttctcgtcactacctcctcgcgttgagagtgggtatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccgggtcaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcggcgaaggcgaccgagcaagtggtaatgacacagcgctggccaggcatccgagcttcccggacttgggaagaaccatctcgccgctggacacagctccgagggcagtgcacaggcactcacacgagcactccggatttcccggttaggacacttcctcaggccaaaggccttcgggcgcttatgtctcgtgttttttcgaatgcaagcacactggtccccaggcaaggagttccgatccacgaactcatagggcttgtcaaccatggcaatacgccactcactcgtataccaacaccaccaccaactttaggttcagcatccccagtgctgagttccaacagagcatttgtgccttaggcaacatttacacaagtcaat

SEQ ID NO: 40310 - DNA, 311 bp, Heterodera glycines
tagacagacagtcagacagtgcactatttcttctttctctccagtggctatgcggaagaaaagaaggaaataaaaaaaagtgaaaaaaaaattcaaaatgtaacgcttttaaagtagcgccaatatttttttcttggaaaaagcacctggagggctctaaagcaaagcttgaaacaccttcatgggactaaccctgaattgttggaaacaaatatttgtaccagtacgcatttcgtcgttaccactcaaacacaaaaatatttcaaaatattttagagcaaacgcgtcacaattatcctgtttgaaaatat

SEQ ID NO: 40311 - DNA, 440 bp, Heterodera glycines
  misc_feature (43)..(43): n is a, c, g, or t
cggtaaaggactaacttacactgaaatgagcgccgagctagcntggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatctttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaattttgaagggcggggggggggggg

SEQ ID NO: 40312 - DNA, 1022 bp, Heterodera glycines
ggagaacaccccaccccccaacaaccccccgaaggggtgggtgggcgaaatttggggggaggggggagaaatgcattcatttggaagagtggcgcgagtggtggtggcaccaaaaaagacggcgcgttcggatggtcaacagtcatcagtgagccaaaacatctttttttgattggttaatgagcagtaatcggcaaaaaaccattcaaaaaatcatttgttcatctctaaatgatgtgctgccgattgggtgccctctcggaaaagagcatcagtttatgagcagcagaaggacaattttgttgggtcttttgtgtcatgcgaacgaaattcagcagtttaagggcaataaaattggaaacctttaatgaaatttaatgaccctgttcaaatttgcgcgtggcctgggtcaattcggcgcgaatttttccgtgtcggcctcagagaatgcttcttaccaaaatttttcaaaaaaatacaagcttataaaggaaaaattcttattcaaccgggaaaaagcttagcattttcgtagagattagaatgtttactaagaaatgaatgttgtcccatcccatcagggaaatgagattttttgcatcagtattttcatccagataatataattaagtaaatgatagtaaaaaaaagccgatttcttgctcttaaaagggatacataaggattaaccaaggaatgaatgttaaacttttcattagtccatctccgccgggggggggcgggcgtacttttgggcgtcagttttattaaccaagcaataaacatgatgaaaatgatggtgataatgatgaatgtgttatgcgtttgaaccaatcacagctggatggatggatggatggatggatggtcgctgcgcgggaacaaaccgaagaatgtgcggagagatcagagacgaatcgccgagggtggcgccaatccaaccaaatttgccgattttgccaccattcttgaccccacccatgtcattagccagtaaagacagatagcagcagcacttcaac

SEQ ID NO: 40313 - DNA, 1279 bp, Heterodera glycines
  misc_feature (49)..(49): n is a, c, g, or t
  misc_feature (52)..(52): n is a, c, g, or t
  misc_feature (60)..(60): n is a, c, g, or t
  misc_feature (219)..(220): n is a, c, g, or t
  misc_feature (240)..(240): n is a, c, g, or t
  misc_feature (263)..(263): n is a, c, g, or t
aaatttgacgaaattttatagagcagatagattatcaaaggattatttnatntatttttnaatagggtcacattttctttcctgttcattaatgatgggctccttttttaaatattcgaattttcgttcggtcgtgagggggcattcttcgcagttcgcttcccccccccccccactttttgtgtttacgaagcgattgacgtgatcggtcggtccctnntcgcgtgatccatggccctntccgtcgttcttgagacgctttntgagaggggcaaaacgaattcggagaaaataaaatcaagcgaaagaaattgggcaaacaaaggctcaagaacggaattgagcgttggcaaggacaagctcaactttcaatggttgggttgggtcgggtgaagatcattccgctgcgaatttcgactttcaaaagttgggcacctttcgaaacaatttggcagacaatgacgcattggcatttgttctcaactcttttgatcgctgatcaaaaaagggaaccccgcggcggtgataaattttcattccctttaaatgtcagacattcgaagcatttgttgctgcaaaagattgatcgacacggcttaactgctgctgctgttggtattcccattgttcaaagtgttccgtttttagaatttgtccaataattaaagcggcggccaatctttgaacctttggcgagtgaatgaatgcttcatccgaattagcactgatcacacactctttgctcaatcagtcgccagtcccttagagccaatttccaattcaagtaaggcaaattaggcttcgttcttccttttgttcagcctcattttttcggcttaatttccaatttgttcttctcttctcacaaatattccaccgttttctgtctgatcagtgatcaagtgatcattcactgacttcccaaattctttgatcataaacattcctccaaaagaccaatgcattaattatgtctctcatgtttgggaggatgaatcactttgtgtcctttctctgttccccggggccattggtccaaaaggcgacggctaacatcatcacatcatcatcatcgtcctcgtcttcagccattctccggacgaacagcaaaatgaatgtccgtgacataacacaacgccaatctcttccctgtgggaaacagagaaagaggaaatgagagagaaagggaaaaagagagagaaacggcgagaaagagaggagagagagagaggagctaaagagtggccaggggcgcataaattaacgcccggcgggtgaa

SEQ ID NO: 40314 - DNA, 1642 bp, Heterodera glycines
ttttgtgcgatgctctacatcagcaaacgctatgcaattcctcattggtctcaagggaacgcctccacagaaaggacctttcgtacttttcacaacatattgtcaaagtacatctcaaaagaccaaccggactttgatgaacacttagaagcggcaaccttctgttataacactgctgttcatcaatcaacgggagaaacacctttctttctgatgtatggtagggacccaatattttgcgttgatcaaattttagacccaaggacagcagacccagttgcttttactgatttaacagaattcaaatatcgtctaatcaattctttaagaatggcatgggcggccactgctgaggaaatccgggagtcccaaatgagggctaaggcccaatatgataaacaaaaccgagttctggatatccaagtgggtgacagagttcttttgaagaattatatctctaaagtaggcacatcaaagaaattccacctaccatggagaggaatttttagagtagtgaacattgatggtgtaaaggtaacaataacaagctgtaatgccccgcaagcaaaccctagggttgtgcatatcaaccaattaaagaaatccttcgatggattaggtcctgcctgtactgttcccgaactcactgagaatgaaaaagatgcccttctcggtgcacaagctgaagaactccaaaatcagcctggctattctcacactcccaattctaatcctgattttgcctcatctgaaaacccacaaatgccaagtgatttcaatattgcccctgaaacctcagaaaatgcgacaaatccccaaccctcttacggactgcgaaatcgcatgtcccttcgtcgtcctcataaatttgattaaattttattctattgctaggctcaatacttttgaaggttctaaatcatttcttattttaagctaaatcgcattaaagctattattctgtgccttcaaatggagagcgtctctctcgaccctggtgaggagttccaggaggaattgacggaagaattagaagaggagttgttaggaaaagaagagaagtgggtcacggcccaaaattctgagaatgaggtggaaggagaggaaaagcagaaggatgagggtgaagaagttgagttaaatgaggacgctgagaagaagaaaaaggagtgggctacggcccagaactctacgaacaatgaaaaggaggttgagaagtgtggagagaaagaggttgaaaagagtaaaaagaaaatgaagtgggttacggcccaaaatcattctgaaggcttcggaaacggtggttttggagaacaaaccaaaaaagttgttgaagtgcttcttttggatctagagacatcggcgcagataagagaatatgtggtctgccaactccaaagcaaaggagttgtgttggtatacccaaatccttcggaaaaaaacaactttccgtacttcatctttcttccggatgtgtttgatggcaaatttgaacgtccattgttgcctggtgaccgtgtctttgttgaagattacgcttgggtggaaggaaaagagcatttggacaagtcaagatggatttatgccgaacaaattcgctgaaaagggacggtcacaaaaatgacaacgtcatttatgccaa

SEQ ID NO: 40315 - DNA, 1313 bp, Heterodera glycines
taattggaaattaataactttttgatttttaaatatttaaaatacatttagctactactgaaattggcattgaacgccgcacttcggcaacaaaaattgtgcaaaaaacgccacgatttttcttctggacattgagccaaaggtggtcaaaaaaacgaagtcttttaattattaattaatgaattaattataagacctaattagtaaaattataaaaatgcaaataattttaaataaaaattaagtgaaaagaagaaaagtgccaattctgtggattcatctccacgaacgcccgactcttcgcgcagtgtcagttttgaggttgaaaatttattatttttttattgaaatttaataaataattaaaattttagggagccgaagcttggccatggattgacgacgttgtggaagaagtggaatgtgaatgctttgaagaatgaatgagcttatgtgggttctctgtggataatggaagtaatccttgtacctaataatgcaacaatccgagtaaaatcttttttggaataaatgaatttggcaaaaaataaatttttgaagaatttctgcaatttgaatattttcaattgtgagggtgctcttttaggcttaaagcaattaaaattttttaaatataattattagggatgggaattttatgtaatacatatttttcctgattctccaaatgctctgaatagtaggaaaaacacacacattcttttttgtgtttgcgtataaaaattgggacttttatttatatatttttatatatttcggggtttttctacatatattacatacgtacatatttttatacatattttcgaatttttcgcatttttcgtacatattttgcgatatcaaaaattaatttttcaaacactaaaaagtgctttctaagcaagcctatttaggtaatttttattccattttgtgcctatttcacccttcacgaggaatttttttttccaaaaaataactatttaaaaaatttgatattacatatttcatacatatttcagcatttttttatacatattttatttacatatttcgcaatctttcttaaaaaaaaattcccatccctagtgattataaatcatattttcgtccaattaacaaacacacacattagcaagcagatgcctatttttacatttacttcgtacataatgacaggaattaattaaatatgaggcgggctatgattttgtattaataagcgttaatgtttccggtctctaataagcagtgtatctatcaatgtacaaacaaatcagagggtttatggagaaggggggggggggggg

SEQ ID NO: 40316 - DNA, 1098 bp, Heterodera glycines
tttaagaaaaaattcaacttttattttaaatttttgaaaatctaaaatttttcttcaattcaaaacatttatttttttcctcaaataatatttgaaaattcttgagaaattcccgatttttttttataaattaaaaataaaaattttgtatgaaatgtcgattatacgattttcctcggcatcggcactgaaattttccccttttgaaataggccagtgaagtgttacggtcggccgagatgaaagagcaccggcgcctggacggcatcgaaatgcaaacgcgcgtacgcggcacaacaccttcggacgcctattactaccacaacaagaaaaactttagctcaaaggcaagctaatttgtggagaatttatatgtcaacaaggatttcgaagaaccgattttcggactaaaaatccgggaataagccacaaattaaccagatttgattgcgaaatttattccaataaaatcctggcatggtttagtgtcatggatggtcggttgggtaaagtcattcccggcactgaccaatggtcaaagatagttcagggtttcatggaaaagaaaaaaaacacatttgtccaattacaaaataaaaattgtccaaaacaagaaatttaagaaaaattctggtctaaacttcaaaccataaaaatattttttttcacatttctaagcctgcccaaaaattacaaaatccgctccaatttattaaattatttatgagttaaaaaaaactaaaattttgcaaccaattataatcttgatcaaattcaatctaaaatgttcaagttgcggcctataaatttaaaaatgtttaattagtgaattaattattcccccatcaaatattttagctctccttcattcgaaaagcatttttcattgagaacactttgctctgcgtggacgcttcgctgtttctggtgctgctcattctcttacactgacactatttttcattttttggaatttaaaataaaataaatatccaattaaaaatattgcttgatttataattatatagtttaatttcgctaaaaggaatttattagcctttttcatgtctacataattttctacctaagaatgaataa

SEQ ID NO: 40317 - DNA, 1170 bp, Heterodera glycines
ccccccccccctttcccccaccgtcccccaatttttgggcttattcctccgccccgggggaaaggtttgtttatataggctcatcaaccgcagaaacccttccgactcactcaatcctttgggaaaggttaaggggacaaaatgccaacggaagaaaaggcattttaaaagtgtttgcggaagtgcacaaaatataatgggaaattgaatgcttttaatgggaaaattcaaagaaggtaaaagaagctgtgcagttttttaatgggaggaatgacaaattcaaaaaatgaatttgtaaaatgtgagagtgagtgatcctcactgatcagtagggaagcaacttttagtgaaaaaactttttttttgctcaattgttttgaagaaaggagctcaaaaaacgcatttctgcgtccaattttcccaattcaaatgtcaaaacggcgattgtcaacagtactctgcgatctgtctttacaaaacaaaataaaataatccagcacaatttctctccaaaattaatcagtgctgatcgactatgaaaattttggagaccaaaaactaaaacattggtactcgagatggagaagactttttcccgagagtcgaaaccgaaacaataaaaatgcctgagtttttcacgagacgaaacttaaacaccaatttacatatacggattgctcttaacatccgtggtctagcgggggcgccccccttttcccatttgcaaacccagtacaaatgataaaccttcaacttttttaagttcaaaaatgtaagggacggggaaggcaaattgatggggcacctttcaacaaattgcattttaccggcttaaaaatcattttaaattctttcattttttggggggggggtaagcccccccttaacatccccccctcacttaatttccccgttccaactgcagcggacggcttatgccattgtttgtgtgctgtgaccaccgcttcgccgccgggcacaaaacgcggcaaatgtcctttattctttgcatgttttaagctccccccccccctcgagaatggcttcttttcattcattcgtttttccgtcctcccctgggggatggtttttttgttgagtaaacttccttctttgccctccctccgctttgattttcatatgagtcgacccccgggggggggggggggg

SEQ ID NO: 40318 - DNA, 912 bp, Heterodera glycines
  misc_feature (120)..(120): n is a, c, g, or t
tcgacagcaactggaggagcagtacaattcgtttatgcaattactgatgaacgcgatgaacaatggtggtgctgctgcatctgctgctgatgagaatcagcaggacgacgacgacaatgnatgaggaagataacgataacgacagtgatgaagatgatgacgacattaatgatgatgattagtgatcgtaatgatgatattgtgataatgatgattagtgatcatgaacattaaatgaaacattcttggtattggtagaaagttggttgggaaacaaactcttgcattttagttttttggatggtgtataaaaaaaaagtggttttgaaaagcaaaaaatagttaaatttatgttccattaacagatttgattccagatcctctttttaccgtctgatacattcgaaaattctcagtcgcccccttttaatgcatcccgctatcccctaaaaatttcttttttaaaatatcattattttcttttttttggaaattttttggaatttaattgaaattttttcaaaattttcaaaatcccgcaatcccgcgcgggatcccgcaaattttaaatgcgggatttgcgggattaatcccgcgggatcccgtcccgcaaaaaattttggattccaatcccgcagcgggatccgcaaatttgaaatttccggtctctaattttagccaatatatttacaaaatttctaccaaaaatgttcaaagtttcaaaatttcctatgaggatattgtaaaaaaattaagaaattcccttttgttgattttttaaattcccgcgcaggattgtgggattttggaaattccgaaaaaatttagaattaaatcctctaaaaaactaaatatctgaccaatttggaaaagaaattttcagggatagcgaaaaacatgaaaaagaggggt

SEQ ID NO: 40319 - DNA, 1061 bp, Heterodera glycines
  misc_feature (1018)..(1018): n is a, c, g, or t
  misc_feature (1023)..(1023): n is a, c, g, or t
tttttacattgaagcatttggatggcttgctgtttacagttggctaagtcttctttgcaagaagtagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactacttttttgataatttctatagattattattttgcatgaatccttcgcttaaattcccatttatcttataaagtcagattaaattaattaccccgatttgttttagaattggtccaaacacgtttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccatttatcttataaagtcagattaaattaattactccgatttgttttagaattggtccaaatacgcttgctaatagcttttcttttcgaaaagagaggcgaggaanaatanagggtgcatcccaatgtaatttttttttacattgaagc

SEQ ID NO: 40320 - DNA, 1088 bp, Heterodera glycines
  misc_feature (948)..(948): n is a, c, g, or t
  misc_feature (1015)..(1015): n is a, c, g, or t
  misc_feature (1032)..(1032): n is a, c, g, or t
tgtctattctgataagtaagaaattgaaatattcgtattactttgcctcccttaaagctttataatgaaagcgtcgttgtctattttggatttgccgttgcaattctgtaattccactttggaatccaaaggaatttgattcgcttttacaaattagacagtgccgaaatttgtagatcggctaaaccttaactgaaacataccatatcagcgagacgccatgctgatttgttgtaatcataataaaaaggcccttattgtttaattcggcctttcctataagcacaatgtgtttgatgggctctacaaaatattgcttgtgcaaagcaattattttattggaggctgtaattttctgtagtcatttgatatgcatctgctatttttctagtcacaaacaccaatatttttcggcccgaattttataggcgtgaaaagtactgatttccaacttctttctattcggagacacccaaaatttgaaaaacgtctgtaatttagcttcttttaaatcttaattttttgaaacccgaattgagaaaatatgaatgtatttctgcgacgccttctatacttaattcgtccataatgggccaaaaattcataagttaagaccaaaagagggattttagtttcagccggaatttctataaaaatgttcgtgtgtaacctatctttgtctattctgataagtaagaaattgaaatattcgtattactttggctcccttaaagctttataatgaaagcgtcgttgtctattttgtatttgccgttgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccttattgtttaattcggnctttcctataagcacaatgtgtttgatgggctctacaaaatattgcttgtgcaaagcaattattttncttggaggctgtaattntctgtagtcatttgatatgcatctgctatttttctagtcacaaacaccaatatttt

SEQ ID NO: 40321 - DNA, 949 bp, Heterodera glycines
  misc_feature (900)..(900): n is a, c, g, or t
tttgagggttcaaatcttacaaatttgaaatgtccttatttgtaagatttgtccttatttaagctctttgtccttattttcatcttattttttggattcagggagaaatttagatttacaatgataatttttgaaagaaatgtttttttgaagcgaattaatatgcaaaatcttaacaagattcagttaaatattcaaattttctctcggcggtttcttattctcttaaaaaaattagctcaaaatcgtaattggaaatagcattaaaaattacaaaaatttttccggcggcgcctattagagcaggggtgtatctgttcttatttctaagaaatgttctgatttgaggtagtgtcttattttcatttaaaagagaaatttctgaaaaatttggctaattcctaacaaaattcattaaaaattcttaaaattttcccccagcggcgcctatcggcaccgccggccccccaaaactcctatttttctaaaaattagcccaagatcgcaaattttggtcattttttagacagaacttgttaacaaattgcattaaatttttaaaaaatttccctcggaggcgcctatcggcaccgccgaactctcttctctcgcccatacccaaaaatttttcggaaaaatgcgccgaaaaaattgttaaaaatctgttttttgattctaaatgcactgaaatttaccaattgcttatgtttcgacaaaattgttaaaatcttataattgattttcggaaatgtataaatttctcatttctaagccgaaattgctcagaaaatagttggcggtgagtaatgcttgattttgttgaataaaaaagcgattcaaagttttggaagcgtgttttaaaaaatgtccttatttttgacccgaaaatcttatttttgnccagccgattaaacggatttcggaaattttcaagggtaaccctggtata

SEQ ID NO: 40322 - DNA, 597 bp, Heterodera glycines
tatgcataagtggtcaagtggctaaaccttctgattttattatttctcgcttgggttcaattcaccactgggatagaatattcttcatattttctttaccattattttaattgaaattttaattaaaaaaaatattccaactttttttctttcattttaagcatcctaaaaacccaaaaattaatcaattgctcttttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaacttggtcaccctcaatatacatatacttctgaacaattctaatgctaaaaaacaggcactcgcgcgaaaactgaataaaaattttgtatttgaaaaattttggccataaattt

SEQ ID NO: 40323 - DNA, 775 bp, Heterodera glycines
atcacatacatattttagtgaatttacgtcaagcaaatatctcctattggcaatcacggacattggcaatgcttcttcttccaatccgtcgaattctgtgccattggcacaaattgtccgttggatttgggaggaaaatggggcacaacggatcaaagaagtaaaaataaaataaataaattttaaatatgattaaaaattttaatccattttaatacactgttaacaaaatttagaccaatacgcttaacaagggcagtagacgtagttacagcaagaatattgccagtggttgttcttcatttgtaatccgaattctcaaaaagcgggagacaaaaaagtaaatatgtgattaatactaattaaaagtggccgacattttatcagtaaaaaatgctctaataatgcagttttttttacgtgataagaaattttaaacaaaaattggcagacaaaaaacaatgccaactttctctaatttagaatttccatatattttcaaaaactaaatgtgactgacgcgttttctactgaagcattttcgggagatgagtcttggttctcccgatcactgattaatttcattttccgtttgtttttttgatattttcccccatttttaagtgcgttcccggcaccttccagcagcttaactgatcacgacgttttgacggtgaaaattggtgaaaaacaggtgaagcatcaccatcaaacagcaacattaagcataaacggttttttcacggttccatacaaaaaattttgaaaacaattt

SEQ ID NO: 40324 - DNA, 788 bp, Heterodera glycines
agtaactcggctcagagtgaagattaggggatgcaaaagagacgattaaaagcgatcgaaaattctatcgactgatataataacgatgcagtcgcggcgttgacaactgagatggaaccaaaagttccatatatctttccataaggttggaaaggcagaatttgaatggccagtctatatttacactgagcacccgttgaagcgggtgatgcgaagcaatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccaatcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaact

SEQ ID NO: 40325 - DNA, 963 bp, Heterodera glycines
ctccattaaagtgcagttttcgtatcttggtactcatttggctgcatatctgtagtacggaaaaaatattaatatccttttttaatatcaaaaaaataatttttattgtatttttaataattcccccagaaaaaatttaatcaaatttcgcagaattttattatgatacaacaaaattcagtggtaattttcagtggttttatcgacaaaaataagcccttaaagtgcagttttcgtatcttggtactcatttggctgcatatctgtagtacggaaaaaatattaatattcctttttaatatcaaaaaaataatttttattgtattttaataattcccccagaaaaaatttaatcaaatttcttagaattttattatgatacaacaaaattcagtggtaattttcagtggttttatcgacaaaaataagcccattaaagtgcagttttcgtatcttggtactcatttggctgcatatctgtagtacggaaaaaatattaatatttcttttttaatatcaaaaaaataatttttattgtatttttaataattcccccagaaaaaatttaatcaaatttcgcagaattttattatgatacaacaaaattcagtggtaattttcagtggttttatcgacaaaaataagcacattaaagtgcagttttcgtatcttggtactcatttggctgcatatctgtagtacggaaaaatattaatattccttttttaatatcaaaaaaataatttttattgtatttttaataattcccccagaaaaaatttaatcaaatttcgcagaattttattatgatacaacaaaattcagtggtaattttcagtggttttatcgacaaaaataactccattaaagtgcagttttcgtatcttggtactcatttgactgcatatctgtagtacggaaaaaatattaatattctttttttaatatcaaaaaataattttt

SEQ ID NO: 40326 - DNA, 1037 bp, Heterodera glycines
  misc_feature (1008)..(1008): n is a, c, g, or t
ccgctcgctcaggcaaaaattgaatattttttggtttttttttttacaaaaatttgacaaaatcgtatgatgaaaatatctcaccattttttttctcctcttttatgtaatattttcattttttttaaattgaatgactacaaattaaagaaaatattttctctaataatcaaaaaattgctaaatattcaacaaaatatgcttatgaaccacataatcaatatatcatcataccaacgatattaggttgaccaattattgtcaaaaaaaaggatatttaattgaacaaaatattttctgaattttttgaaaaaaattgttgattttcaagagaaatttctttgaaaaaagcaaataatgaacagaatcatttgaataatattttttttatttaataattaattcaatatattttattatgtttgaaaaaagtatatattattttctaaaatgttttctaaatttttgaaaaattttgttgatgtgtcaagagaaagatttttttttttacttttcactggcatttcttttaacgcaacccaattaaatttttcacattttaagcaaaaaatttttttctaattgaggccagtaattgaggaaacaatcttccactgtacagaatgtttttttaatgaactttaatttttgataaaatttattttaataaataaaaaaattaactcccaggccgggaatcgaacccgggtctcgcacgtgacaggcgcggatactaaccactatactacctgggaaacgaaattaacttaattttaaaattacattctcctaaaatttttgaacttttttttttaattttttcacaacaagacataataatttatttaatcctaaaaaatctataaactaaattaaaattatgcctaaattttttgtttacactacaaattacatgtttatattaaataataaaaaatgtaaaagaaacaaggcattttttaataaaatattgttaaaaataaatttattgataattgatatgaattnaaggaatggaagtgacatatttatttatt

SEQ ID NO: 40327 - DNA, 930 bp, Heterodera glycines
acaaaattgaggcgaaaattggaaaatttttaggcacaaatcgccaaaaaatatacaaatggaaaaaagaaatgaatttaaataaaattaaaaagatggaaaataatttttatgaaaagaaaaagaaagaatttattcaacgaattgatgaatttaaaaaattatatgcccaaggcaaacagaaagaatttgtgaagaaattgggcatttcgaatgaaacatttagaagatggaaaaaagaaatggtgccaaaatattagaaaagtaagagaattttactcagacgtttaaatgaattttcactttcagcaccgtatttcaatgatgaaaaattaataaagatgaagcaatatttcatagttaaagaaagaaacccaataattagtgacaaaataattgctaagcaattaggaattggaagtcgaacactgatcagattgaaaaaggaattttcatcattatcgaaaatgtgatttgtgattttgttgatacaattataaactgtttttcgggtgtgattttttgtgcctattccaatccccgacccacggtttgccaaccttcgtcatcccctattcacaacagtgagagttcaatcggacattgcccaaatcaccgacattttgtgatgcctttctctgtccctgcacaatgccagagactcaaaaaatcggtgacaagccatgctttcttggcattattctactgtttctaatatttggttacctatgtaaacattttacttttcgtctatttgtataaatgtcttttgtagttttctttggtttttttaaatcaaattaaatcgcaatttttttaaatttttttttaattataaaaaatttccaaaatgattaaatacggttgtcgcacaacaggtagaacaactttacgaaaaagtctgagaggacacagcgaagcggtggcctg

SEQ ID NO: 40328 - DNA, 328 bp, Heterodera glycines
gtggggtgggggggaaagaggggtctgatggaattccatataaagacagaaaagagtgatcgcagtttgtgttggtctgatcagtgatcacctcattaagttgagaaatgaatggctgggaattgagcagcagaaggaagggaaccgcaacagaagagaagcgagaaaagaacaataacatccaaaatttgcaagaaaaacttctgctagtgaaacctgagaaaaaaaattggaaaaattggaaatggggggagaaaacccaataatcaaaaagaggacaaaatttaaacaaatgaaaatcccttgggacaaaagagagagtaaatga

SEQ ID NO: 40329 - DNA, 840 bp, Heterodera glycines
gaaaataattgttatttttcttttaaccggtctacatcgccaaattggataactttttttggactaaatctattaagaattaaccgtaaaattttcgaaatttcaggcgtttccatgaaaaaaactgtaaaaaacaaaaatacacgccgaaaaataaatttaaattttttaaaaaataagtttgcatatattaatatgaacaaatcttaattagaataacaaaaagaaaatgaagagataaaaaatgcaataatcacatttaactttaaataattttaaacaaacaacaaaatgaatgatcgaataatcatatcgcaaaaagaaactgtttgttttttgcaattttgactcgaacagcatttttagtttaaaggtaattactagagaccgaccttttgatgcatatgcctttttatctgcgcactagtttcgatatattaagcataaattacacattttccacttggtatgaggcttctacgttgagctttattatgccttttttttgcctttttcggggttttcgtgccttaaatgccttttttggcattttgccgttggttccttttttggcgtattttccgaaaaattcattaaaaatgcaataaaatcgctaaaatacacccctaagaaatgattgaacaaaaattcagaaaaatacatccctaacaatcgacaaaaaatttttaggcttaaaaattttccttattcgaaaaacattataaagtatttcaaaatcatttaaaagaccaaaattaagttttttggttaatttttacgtgttttgctccctaaaaatccttaataaaaattttttaaatgccttttttcatgcctttt

SEQ ID NO: 40330 - DNA, 1646 bp, Heterodera glycines
  misc_feature (1588)..(1589): n is a, c, g, or t
  misc_feature (1608)..(1608): n is a, c, g, or t
gagcaggaagagacgcagttggacccgaaagcgttggaggatgaacagaacgaacagcagcagcaaacagaggagcgggacacccagcaacaggacagcaatgagaccggggaccatgaaaaaggttggggagtacagcagcagcaacaacagagcatggacaatggtgatgatggtgcatgtgcggacaacgacttgcgcaacgatgttaatcatcaacaacagcggttggacaaatcacaagtcgatggggcggatgaagcggactggacagctggccaagatgagggggacaaggcaaaaccaacggcggtagatgaacgtgctgaagaacatggtgatgcggagggtgatgaccaacaacagagcatggaagacgaaggcgctgctgctggtggtcatcaacggcaattgcagcagcaagaaatgggcgaggtgagtggcagtggcttttctaggcgctatcccgtcatggattatgaatcaataggcttaccaatgtgtaccgttcagttgtcagcacatggctctgcatcgcttgaacaggcgcgtcagacgcgtgcactattccattcccatttgcgtcgacttcgtcagcaacaacaacagcagcagcagttggatcaatcacaacttgaagaggctgaccaagctgcggatgaccaaatggctgaccaagatgaagcggctgccgccgtagaggaggaaggcatggatgaaagcgcgggtttcaattttggcgacctgctcaatggaacggaagtgatgcgttttgacccaaaattgtggcaaaatgatgagcagaacggcggacagcagcagcagcaaaaggaggaggcaatggaagaagaagaaagggaaggcaccagccgtgatgatggtgatgatcaacaacaacaactgcagcaccgtctacaactgaaatgggcactgatcacggacagtgtggcgccactcgctgctgagctggccgagtcactgcgtgccatcattgagccaaccatcgcgtcacgactcgagtaagcgcgcgaggggaattaatttgttgcgcagatccctccctggcggccaggcccatagccaaaaaaaaaaaaaaattcggaggggagcccgaaaaaattttcgttgggctaaaaatttcaagaaattttctctgttattttaaaattttggtcccattgaaaaaaggagatatttgtagcttattcgccaaaaaatgacttgttttgccatctcctctttttagggttttctaaaaatttgtgtgtcaattttcagaggcgattatcggacaggcaagcggctgaacatgcgccgtctgattccctacattgccagtgactatcggaaggatcggatttggatgcgccggacgcgtaaagcacgtcgaaactatcagatttgcattgcggttgacaactcgcagagcatgcagcacaaccacatgactgaggttggtgtgagaaagattattttatttattttttcatttatccaataaatttgaagaatggggtgactgacttatttgaaaatttaatatatttttttctataaatttgtcctaaaatgtggcactggcgttttnntggcgacagtctggtaaanaataatcagtttatctccttcctcatttctttttatct

SEQ ID NO: 40331 - DNA, 837 bp, Heterodera glycines
agaaacggctgagacaaaaggcgcggaagaaaggagccaagaggaagaaggtgaactgaacggaatggaaggggcaaaaaggaaacgaaaattaagggaggaggtgactcatcgtccaattcatcggaaggagaggaggaggaggcgaacgaagaagaagaagagaagggacaaagtcgggagggagacgaatgatcgtgttggtttatgggactgcattttactcagtttattaaactcattatttatgagcaaatatatttttgtcactaatttgtctaaattacctaattttgagttttttccccatatatctatatttttttctgtggtcttttattcatttaaatttcgtcggacttatttgttaggaaaatgccaaatttgctccaagttctgttcggaccggttgtttaccgcccatatcaacccaacctattggaatcgggcggtaacaagctgttcagcatcggtgctggtgcctacaacacttgtgttgtgctgtcgcccattctcgtgccgtacattgccttttcttggacccactcccatcacttttcttttgtcggtttgcatgtttccaattcagtcctctcacttttgtccctttttcagttgcgcttcgttttggtgttttatgccattgccttttccttccgtacgattggtcggctgacaaagtgagccaaccaaaattctcactgattgctcattttcgttgactgttcctcacttttgtccgtatttcagtgttgactacgtccgttttatcaaattgctcggaaccgtgcgcaaatctccgcagaatgtcactttgctcgacacactcaaagacta

SEQ ID NO: 40332 - DNA, 937 bp, Heterodera glycines
ctgttgcgccgaaggactgaaaatccgttggtcaatggaaattgctgctgattttgttgctgttgttgaaccctcaaaagggacaatgtaaacaaatttaatgccgcatttcttaaaggggtcaccaacttttgccgaattttacgctgtgccccggaagggctccgatggaggaacacttggagaggagaaggggaggaggagggggaagaggaagaggagggacaatgctgcaattgttgcgggtggtccgaggaatggagagacatcgccgcttggaaatgagtgaactaaaaggaaaacaatgccgaaataagcacagataatggcaattgagaacaaatgagtgataacaagcaaaattaggtgcaaagcacaaaaaaacaaactgagaaatgagaaatgaggacagaaaataaggaagaaaaaggaaaaaaggaaagagcggagagggaagaaaggagaaggaacgacgaattgagaagagatgaggaaaatgttggcttgagtttggtggaggggaggcgaagcggggggagagacgaggaaggatgagtcagcgggaaatggaagcgaaggagggagggaggaggaagaggggacgaagagaaggggtgggggagaaccgggagaatcgggggaggacggggaggggggagaggaggaatgcacccccgcccatctcacgggggaggacagaagaggaggagaaagaaaagcggaggggaagggaaggaggggagcgaggagagagggggagaaggaagagatcaatacgcagttgcgccgccggggaggccgaatattatggtaatgggggggggaaggacgaattcgtaagaggaagaagacgacggagggggaggagaaaggtgaaattggaagaggcaaatgggaaacagcagcagcaaaagatcaaatgggaaaggaacagaaa

SEQ ID NO: 40333 - DNA, 1006 bp, Heterodera glycines
ctgaattttacttttattttaaatccaaccattttgtgatcggaagttgaaaaattttctagaactgtcaattcattaattaattctaattcactagtaattactaaatctaaaattgctttttctctggttggttccttaacatgctgtatcaattgtctttggtgcataaactcaattagagaattagacgccggatcatttattttttttactttattttcatcccataatatatttgggatattaaaatcaacagaatatggtattttcagaatcgctctggtcagaaatgaatttgagtagttttttagtattctgaactgtacaatttggtggacgatatacatttataatttgaataggttttttaaaaagtaattttatgtgaataatttcgctttggaattttgtcccagagaaaagtgtctgataagggatgtttgattttaataaaattgccgatcctccgccctttttatcatttcggcttgcaaagattatttgatattgattatttattgtaaattctgattctactgtgtttctggagtttaagcaggtctcatttattatgattataaaaggatcgtatttttgggttatatgttctaagtcagctattttatttgttatcgatcgggcgtttattaataggcaataaatccaaggatttttctttcccgtattcccaatgtttttgttttatttgctcgcgtatccctagcgagttctgagcgggcgggggtttttcagagatctgatctccaagtcaaccacaaaatacttatactcacctgcggcaatattggcctgaaaagcttgttgcccaaaggagtataaaatttgaactcacttttgggtcatatcccttcggactttgatattgtggggcacattgggcaatttttttccaagcattacggaaaattaaagaaaaattttgtcacgtgaaaattttttccaaaaccggaatttttaaaatccaatccttttttacccctcc

SEQ ID NO: 40334 - DNA, 1585 bp, Heterodera glycines
  misc_feature (46)..(46): n is a, c, g, or t
tttcctcgtaaatttcaattggaatcgctattcatttaattatacngggttaaaatattaattaattttttttttttgtaaataagtttgaatttaataatcagagaaatgattttttcaattataaatataagtttacaaaataattatattttccaatatatctttttactttttgtacaaattaaaatttattaaaaatttaataattaatattattttcaaattttacatacattaaattaagattgttaaattttttataaatacattgcgtgttaataaactatttttttaattgaaatttaatataaataatttatttttcttttaaatatttgttaaattgattgcaatcgctcttttcataagaaaattaattccaattgtcccggcttgacgttagtcaatccaatgctgttttccactatataaatatgtttaaattattaattttaattaatattgaaaataatttgtattattttgtatattgtgttaatgagcatattggctaattaaattattactctcattttccgtactatattaaggacatgctgggtcgtttgctatgtttttggcatggtcatgcatatcaggggtgggataactctcgcctctcgccacaaaataattctctttctctgcttcctctagtcatttttggtgaaaatctaatagtaaatctcattaaaatttgcaaaaattttcccggcagcgcctaccggcacagccggaccccctccctgttcccaaaatttttttgcaaaaagtaaatattatttaagcctcaatttaattaattttaaagaaaaagaaaatatacaccattattttgtaattttcgccttttcggtacatttctatattttcttaaattataaatctaaccaaaattaaaaattgacaaaattctaatagatgaaaaaaatcctaattaaaaatttaaaaattattatagatcactaattataaaaatttatatatgtatataagaagacagaaacaaacttatacatattagtttcacttaaagcataagcaagcaaaaaattaattaacagaaccaattcatttatatatgtaaattaattttaataaaaaaagatattcaatatttaacaaaagctgtcaaaaaataaaataagtaataaattgaaaattaaaattataaataatgaagcaaatgttaaagtgattaagataaaatttaaaatttttttttgaaaactaaacaaaatataatcttcataaatttaattcttaagtcatttactaaattatactttctctcattatcaaattatcaatgagatttaaaagaatttactcacgcaaatttgatcaaatttaaataaacttgaatttaattattaaataaattaatttaaaaaaattagcaatgaataaatactttcggctaaataaaataaataatattttttggaaaagcaagaatatttaaagacatttaagtgagaaaaattattagaattataaaagttcataaaaacgagaattatttttaaattaacaatttcttaataaaataaataataaggaaactaaataataataatta

SEQ ID NO: 40335 - DNA, 1032 bp, Heterodera glycines
  misc_feature (1011)..(1011): n is a, c, g, or t
accccgatgctatccgtccggagagctcttcaaaatttttccataccctaagagctgcggaaatgtgaattattctcagaaaaatggtatctcttttaggacattttctatctcgtaaccccgatgctattcgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctttctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaaatgtctatctcgtaaccccngatgctaatccgttccggaga

SEQ ID NO: 40336 - DNA, 1178 bp, Heterodera glycines
ttttcagtttcatcgaccaaaatgtcatcgcttttcttcaccgttttcgtccaattttcgtttcatgtccaattaatttgtccatcagcaccgaccaaaatgtcatcgcttttcttcaccgttttcgtccaattttcgtttcatgtccaattaatttgtccatcagcacgaccaatgaacgcatttcggagttcatttttcacatttggccaatgctcggaaaaaactgtcccgtgatggaattgcccgctccaattttccaccgtttgcgacatttcgtgccgtcaattctcaaagattgtatatcgcttcgcgttatcaacacctattcctatggtttcttcatcgaatttccatgcgatgacagtgccgcggcatcggatggacaagcggtggccaaatggcttttcactccacgtccggacaatgtgccaaaggtgttcaaatgctacttggacaaggatgatgcgaatttgacgtccaaagttgaagcattcaaaacggtgctttcttttattatttcatatttctttaatcaatttttcccgtattttaggcttttgccaatgcttcatctcccgccaatttcattgtctccatttggtttcgttattttgctgacttcgttgtgccatttgaccaaatcaacgaattgactcgggaacaattgacactgaaaagaactgactttcactactgttttctgttggtccgttgtccaattgcgcgagacgaaagcaaatggacaaaatgggaagaggaagcgattgactggcaaagttatggtcaatggaatcgaattagcatttgtcctatttttgtggatgacatcggcgatgggtcagcgaatattttttcaataaatccaaatttatttatgtttcacttttttaggcttctcgacgaaattcccggcccaagtgatcaacagcagaagtgaatgaatgaatcaattgttgagaactgatcgatctaattgaattgcggaattggagaacgaatttgagcccatattattgtaatgatcaacttttattttgtttgtgttatacaataattatgtctttaggataaatttgttgagaagtgatcgatcaatttgaatcatgaaatttgaaattgatgcgctcgtaaaaatgttttatttattgttgaaatgatcaacatggttttttttt

SEQ ID NO: 40337 - DNA, 1071 bp, Heterodera glycines
tgattgaaatgctggtgggttgagtcccagtgattgaaatgttggtgggttgagtcccagtgattgaaatgctggtgggttgagtcccagtgattgaaatgctggtgggttgagtcccagtgattgaaatgttggtgggttgagtgccagtgattgaaatgcaggagaattgagtgccagtgattgaaatgctggtgggttgagtcccagtgattgcaatgctggtgggttgagtcccagtgattgaaatgctgttgggttgagtcccagtgattgaaatgttggtgggttgagtgccagtgattgaaatgcaggagaattgagtcccagtgattgaaatgctggtgggttgagtgccagtgattggaattctggtgggttgagtcccagtgattgaaatgctggtgggttgagtccaagtgattagaatgctgttgggttgagtcccagtgattgaaatgttggtgggttgtcccagtgattgaaatgtaggagaattgagtgccagtgattggaatgctggttggttgagtcccacagattgaaatgctggtgggttgagtcccagtgattggaaagcctgagaattgagtcccagcgattggaaagcctgagaattgagtctcagagattgaaatgttggtggattgagtagagattggaatgtcattgaaagttggtgggttgagtcccagtgtttggaatgccggagatttgagtcccagagattgaaatgctggtgggttgagtcccagcgattggaaagcctgagaattgagtctcagagattgaaatgctggtgggttgagtcccagagattggaatgtcattgaaagttggtgggttgagtcccagtgtttggaatgccggagatttgagtctcagagattgaaatactgatgggttgagtcccacgattggaaagcctgagaattgagtctcagagattggaatgctggtggcttgattttcagtgattggaatgtcagtgaaagttggtgggttgagtccccagtgtttagaatgccaagagatttgagtccccattgtttggaatgccggagatttgag

SEQ ID NO: 40338 - DNA, 1214 bp, Heterodera glycines
tctctctttctctcttttctgctaagtctctctccctcctttcatctattccctcctcattctctctcctctaatctctcctctcctcactctctctctatcgtttcctctccactctctcttattttatcgtttactctattctcttctctcctctctctctctctcatcttatcctttcctctttctttcatctcctcactctctctctctccctccttttgggtccgtatcgttttggcgccgacgttttggcgccaagctataataaaaaaaagaaaacacccaaatttaaaaattttgtaaaacaacaaaaaaacgtatttttcgcgaaggtaatactgccgatggttggttgccccccttttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaattctctttttgtttctaaaatagattaaaacaaccaaaacgttttggcgccgacgatttggcgccatgtagggaggaggtagaaatgatgaaatcgttataatttttctgacgaagtctatcaaagagccggatttaattcttcatttactctttttcgctttggcttatgttctcttaattttgtatttagataatgaatcgtcaaattgatacgaaaaaacaaaagcctaaaataacgcatgaaggccagcttcggccggtggctgatcgaatgaaagaatgtttcggagacggcacattctcattggcacctccaatgttctaccaaataaattgtttccatttcttcattttgttaaatttattatatttaacgaaaaatttcattttttataatttttacaatttcttcctgcctttttttcatttttggcttggcgccaaaacgtcggcgccaaaacgacctggtccctgcagaacaacggcaatataatttcctgcgctgataatcataattaggagaaaattttaaaattttggattttcgatttttttgttcaaatccgggttcggggttcgaaatggatatcagattcgcattctacgacaccgataacctatagaaacaatttttataaatttcaaataaatttaacaacaaaatttttttgttgacacaaaacccacaagtaccaaagaaat

SEQ ID NO: 40339 - DNA, 1169 bp, Heterodera glycines
ttttcttgaaaaatttctaagtttgaaaatttaaaaaaaatttattcccggctgaattatgtctcggctgagtttcggcggctgagttttgtcctgctccgataagagctgattgtgagaattggttccaaaacgccttgaattttttggtgttttttttattattgtctaggacgtgttacttttacgtactttccaggacttggtgctggcttcgattcgtactttgagtatttgctgaaggcgcacattttgttcggtgaggtgcgcgagttggagatgtacgagacccatcaatattattgctatattaatcacacaatttaattatgacaaaaaaatacgatttgttttcccataggttcactgaattacgacaccgtattgaggcaaacatgcgtcgtggaagaccaaaatgcagatttggtcagttttaaagcgcctattttggggaaattttgtcatgaaaagtggatgtaatacccctatttgtaaacaatatgcaattttctgtcgcttaataattataaatttttagtccacatctattttttagctgtacaacgcttacacacaccctcctccccccgtagcgttttcctccgaaaaaaatttattaaaaaaataaattcttaaaaaaattttgaaaatatttttttaatacaaaaattttgaaaaattcttatcatttttaaaaaaattatgatgattgcttttttttcttcaatttttttttataaagaaatttttgatcatcacattaatttttgaaaatttttttaggcgacggtgaaccgccaaactatttgaatgtggacattaaggacggctttgtgctgaacacatggcttgacgcacttcaggtggctattgtgatccttccgatcgtcaaaaatcaaaatttaaacgattttttaaattttttttaggccagctttgctggtgtccaagtgttggccggcgatttggacgacgccatctgttcccatgccttttattacgcaatttggcgcaaatatgaattgttgccggaacgtttcaattggcattcaaaggcaccggatgtgcacttttatcccctcaggcaatttgtttttcaacaaaaaaaaatacttttttttggttttgttttcttagaaaaaaaattcttttaaaatcaaaaactaaaa

SEQ ID NO: 40340 - DNA, 1580 bp, Heterodera glycines
aaaaatgagtgattgaatttttcactaaaaaagttaagcctaaacttttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggcctcgtggtgggccttcccccccgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgataagtttctgaaaaaaaagttaagcctaaactttttggccaatgtaaaaaggaattaaaaatttttaaaaattttattcatct

SEQ ID NO: 40341 - DNA, 905 bp, Heterodera glycines
tgttcaggcagtgatggcactggatgggacgggacgaagtgcgtgccgagattggacgagcagtacacgctcaaaattccggtgggagacaatcacggcgactaggaaaaaactgggaccgttgaaaaagcgcttcaaaagcggcacaaggggggcagggtgcgcaatttttaaaaattttacgaaatttccaaaaaaactttctaccccctccaggccttcccgacggtgctgaaacggtttctgtcctcctccatcgaccgttacgtgcgggtcattgcgcatccgatcaccgcttcgttggtgttcattgcttggcttgcgtttctcgcattttccgccattgtgagaagctattaagaattttttttttttgaaaaatacctctaaagcagggggtgcatttatttgtttaatttttaggttttttgctgaaattttttaaatttaaattttcaattttcactgatggttggcgcctgcatttttgatcaaattaattgccttgaagcaatgaaataaaaaaattaaaaaattaaacttggcatgctacccgatttgttttatttttaaaaatttttttttttttttttggaaaattcctaagagatttttttgttttcaaaaggcaataaaaatttctgcgaaaaaattaataatacccacaaatttgctgtcagggaatttcgcgctttgaagtcaacttaagcacgaaaaagatgttctccgcagattcaccacttcttgaggcatcgatttaaaaaataaattaattaatataaattttttaaattgaattacctaataattaaatggtcattaaaggaaaattcaaaaaagggcaaaagctgcatatatcatagacgtaaacacacaaataaaaatttcgataaaattcttttcct

SEQ ID NO: 40342 - DNA, 1591 bp, Heterodera glycines
  misc_feature (5)..(6): n is a, c, g, or t
gtccnntcgaggaaattgtgtctaaataaaatcattgcaaaacatcattaattttttctaaaacttggcactttatggcactgattaaaacaaaaaaatattctatgtaatactgaataattaaaaataacaaacattttgaattaatccttaactaaaatatatttcttctacttttatttaaattatggtcgttttcccaatcccataaagggaacaaatagtttatgtagactgaatgaatgcttcccaactattaagcggtggagtaagcgttgaagcgcctcggcttttcctcggcgtcggtttttcctcagcgtttcgaagagatttatctcagtgaaccgaactaagaaaattcaaacggtttttcgccagtgtattcctaacttcactcttgacaatccaatttttatttcctatcaagttttttgttataattttctctttaatcatttatattaaacattcaaaactacgattactttacgatttaatttatccattcgatttgcattcgtacaatttagctgaattgttaatgagtttttttttgcccatttccgatcaactctgggaaattgtgttagcgtttagcaatcagtggagatgggcaaaacggtgaatcacaccgtacatttagcactgggaaagagaaaagcgaacaaaaatgggcatttggggatggaaaatgagaaatgaatcatctgaaaacagaaagctaagccgatttggatggattccattctgtggtcttggctttttcttcagttacgctcattaactccgccccttaccaaatcgtttctgaagccgattgggtgcataaatagccggatcaggccattgaaaaatcagttattgggttgggacgggatggcttccaataatatcactctattgggttcagtagttttttggcttaggaaaggacggactgctttaagattaggatagcaagaaaaatttttgttttagtaaatttaataaaaataaatgtaaaataattttacaggaataactgcaaaaaatttgcttacacccgctgagaaaaagttgaaaaatatggggaattagggttatatttttgaatcatttccatattttatgcgtcccaactcatcgaagtctgccgggaaagatgcaaatgcggatggggaagctgcttcccgttagatggcatgaaaacacggatcggcgattgctgtgtgaagggctacgcgtgggtgtgctacaaaaaggttgagtttaagcggaaaagaaattaaatatatttatgtatataattattttataattaaatgcttgatttagcctgcatctgagctgaagggttgccaaaaaacgcaaagcgaatgcccgaaaaactgcacctggggagcgtgccatcatcctcaagaaagcaactgcggagacgaatgctgcaaagccgaatggccacaagaaaaaaagtgcgaccgtggctccggagaatgcttcccggccaatggaacaaagtgccaaatgttacgctgcagaccatgagtttctgtgggcccaggaagtaatttttttttaatttggaaatttgattaatgaatttctttaagat

SEQ ID NO: 40343 - DNA, 677 bp, Heterodera glycines
ttcgacaaaatagagtggtggatggagcaacaaaattttgtgaggtgagaattcaaagacagcgtcaacaaatgtaaaggccgtctttggacggacctaaacaatcacttcattcgtctttcaacgccacacacttgtcccgcaaatgcttcgaatgttgaggctcaacaagtcaaaactacaatcaaactccgtgccatcactaccttggaaccgccatctgtcattcgttcagaagcattgcagaacgtgccatcaccagccgcaattttggtgacaaaaagggctgcgaatgacgtacgagaatttttttaacaaattaaaaactaacaagcaaactaaatttagttaatcaaaagggcgcgccacgaaatcaatgcaccaccagcagtcccgaccaatctgaattttgagatcaaccaagcatacaggacctacacgtcgacggaaggcgttgaggagctgtttctgttgggcgactccggtgtttattttgaaaatggaaacgaaaacccgcaacggtaatttagaaaaaaaatgcgaaattcttttttctcagaattttgttgtttggtcgcgattcattcgggcgttttgcggacagaatgaatgagtgttttggcgacggaactttctcattggcaccagcccaattttctcagatttatacgatcttg

SEQ ID NO: 40344 - DNA, 798 bp, Heterodera glycines
cctccgacggagtccgagtcgagcagttcgggagacgacgacgaagtgccggccaaaaaaccggcccagaaggcacagccggccaaagtgcctccgaaggcaccgatttttcttttttttttttaattttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttttttaattttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaaggccaaaccaccggcggagtccgagtcgagcagttcgggagacgacgacgaagtgccggccaaaaaaccggcccagaaggcacagccggccaaagtgcctccgaaggcaccgaattttcttttaaatttttttaatttgtgtttttctttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttctttt

SEQ ID NO: 40345 - DNA, 1160 bp, Heterodera glycines
atgatgttgttggtgggatgttaattgtggcacaataatgccagcaggagcaggaaaattaattttgacaggcggtgaaaccatcggctgatcagtgaggcaatttgatcggaatcgtcgctgatggcattttttgtcggcatttgattgatcagcggtctcagaatacaaccaatcggccttctgagcggcatcagcttccagatcactgatcagaatttaaattgagcattttttgtataaacttccatattttaatttttttggcgtttaaatgtttttgttgttcaaaagagattaaaatttatagtcatttattgttaatgatcataaatattgcattttcccttggtttaaagggacttttagtatgaaatgatgtggccgctaatggcagggccgggtcccaatttttttccaaaatttgctcctaaaatggcaaaaatttggcaaaaattgcttcaatttcctattttttcccaccgttccgaatccgaaaatttagaaaaaattatgctagacaaaactttaattccaaatcgtaattaaaaaatattaatcaatgcccctcaccaccacacctcaacacttggaaaacggcctcaatgatcacttggttttgttgctgattgttgctcccatgtttgtcctcctgtttttgctggtgatttgttcctgtttggttgtggcatagcccgaacacggcatgcacccggaggggttgtgaagacggcattttgccatcattatcattaacagtttggcattggctgctaattgctgaagtggcggaagggatcagctccagcagcactggcttctgctgcttcggctgatcagcaacagcacaagcagaagcttcatcacaattcgatctgctgatcggatgatattgatgatgtcgattatggttgagcactgttgatcaatttaattagctaattaccactaatgaaggccaggcagggagggagagatgttatggcaaaactcaaaaaccgaccgggggcacaaattcaaaagtcgggcaaaaagccggccttttttgcccccgaagccaagagtatggctacgcccttgaaaaatacccagtttttccaaaaatataaattaatcattgaattttacccatgacttttaggtacttgtaggttttgtca

SEQ ID NO: 40346 - DNA, 1179 bp, Heterodera glycines
ccccaaaacaaaaattcacaattccaatgcgggcgtcctttttcggattcggaaggccccatcggcgatgactgtggcttaaacagaggaaatgacaggcaaattgtggggagagaagtggcaaacgattcgctctcactttgaatggttcaattttctgcggtttcgaaagcattgaaggaggcacaatctgaaacaattaaggaaaaattgagaaaataaaggaaaaaatgcaaatccgaaaaaactcactttggtcacagtgtttttcttttccatggaggggaagcgagaaagaggagggacagcctaaacggaagagaaaaagaaagagacagaaattgggcaaagtgtctcactttgagtggctcctttttcgtgaacggtgacggaaaacgaggcgaaagagtcttaaaagagacgaattcatcataacaagaacaaatgatgattaacgaacggtaaaaacccaacccgtactgttttttgacaaaaaagtcgtcctaactttttgttaaagtcgaccaaataaacattcttggcatcattcaatagcccttaaattctctatcaatataccaagcttcaaaaaatttgattaaaatttagctaagataccaagaatgtttaatttggtcgactttgacaaaagttatgacgcctttttttgtcgaaaaacagtacgagttcggtgtcgtcctgaacgaactcactttggctttgacgaatggtttcttacccgaaggcggaggacgacgcggcggaggaacgacctttttaaaaacgaattttgaatggaaacaaaaacaacaaataaaataaatagccaattaggtaaacgcactttgcctttatctgttttcttggccggtggcggtggaggacgagagacagccttaaagaaaagttgcggattcggaaacaacaacgacaaaaagaatcgtcagtgaaactcgctttggtttttgcatccgtttttttgcccgacgacggcggcggaggacgagaaacagccttaattaagggaagcgaatgtgaagacgagacgaagaaacggaggacaaaaagacaaaaacaacgcactttccctttgcctgtttttgcacaatcaattgggtccgctgaacacagagaagttggaacatcctgaacaaattgacaataagaattgagaaaagg

SEQ ID NO: 40347 - DNA, 940 bp, Heterodera glycines
  misc_feature (863)..(863): n is a, c, g, or t
tctattcttagttatggagccattttccaaccgaccatttgtagggctcaaccgtatatagtaatgcgttttcggggaaaacctcatgttgaaggctgtaggcaaaagagatagccatttttctgagaatatctattcttagttatggagccattttccaaccgaccatttgtagggctcaaccgtatatagtaatgcgttttcggggaaaacctcatgttgaaggctgtaggaaaaagagatagccatttttctgagaatatctattcttagttatggagccattttccaaccgaccatttgtagggctcaaccgtatatagtaatgcgttttcggggaaaacctcatgttgaaggctgtaggaaaaagagatagccatttttctgagaatatctattcttagttatggagccattttccaaccgaccatttgtagggctcaaccgtatatagtaatgcgttttcggggaaaacctcatgctgaaggctgtaggaaaaagagatagccatttttctgagaacatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtaggaaaaagagatagccatttttctgagaatatctattcttagttatggagccattttccaaccgaccatttgtagggctcaaccgtatatagtaatgcgttttcgggngaaaacctcatggtgaaggctgtaggaaaaagagatagccattttttctgagaatatctattcttagttatggagcc

SEQ ID NO: 40348 - DNA, 68 bp, Heterodera glycines
cgcgaagcttgacgcggcgtcggaccggagagcgtgccgagcaagctcggcacctaccaatgcgaagg

SEQ ID NO: 40349 - DNA, 1566 bp, Heterodera glycines
  misc_feature (1540)..(1540): n is a, c, g, or t
  misc_feature (1543)..(1543): n is a, c, g, or t
  misc_feature (1555)..(1555): n is a, c, g, or t
tgccgcatttttattgccattttccttttgttttttatttatttttttttccctttccaatttttttccccccttaaatttttaagttttatattctcacaaattcgacgagccccttttttttttcagctctttttggcactgaaatatgcgagcgaaggtatttttgggccattttcccctgctgctgttgggttgtaggggcgagcccagcgggactggccgagttgggacgcaatgcgataaaatccatccgtatttggaaataaattccggattaatcccacgcaaaatccctgcaatttcagtggcgtaagaagcgaatgcgtcggctaaagcgcaagcggagacaggcgaagaaatgagcggacggacggagagaaaactcagccgaacgcggaaacggaggcacaaaatgttgttgctgtttttttgttattgttgtcaaccgcccctttactcagataaaatttgttgcaaaatattgggatattcaatcaaattaatttttagcaaaaatccatttgttaagcattgctttggcaaaagatttggatggcacagtttgccgaaagacctagttcgagcatgattcgtttaaccgactcaaattctcattcccaaaaaatactatgtgatttttctggtggtctatttcataaaatgttatgcattgattatgatttttgtgttttgtgatcagttaaaagtcacatatggtagaatttttcccattgtcgggttcgatttacacgaaatcctgggactgtccctgttctttgacttcgtttgctccaaaataaactcgaaaccatgtgccatcgtgtgctgttcggccaccgtcgccgaagctgttgctgatgtcaaccgctgcgaaaacattggtgcaatgacatggaaaacggacgaaacaaacattttaaggaaaaatcccccgaattttctcaacgcggcaaaagtccagaaattttttggaattttacttcaatctgtttgttttaaattctaagagtgccggggttttcacgggaacggaaaaaaagacggaaaattttttaccggactctaattaaaatagtctttaataaatttatttcgttgaaattcaacattttgacgaatattaaatatttaattatagaattttgagggacaattagtaggtcagaatggtgcgaagaggggccaggccaattaaaataaaatacaaattgaaaaacaaaaggaagtaatcacctaaagccaaatggcgatgcgaagcctactcgagattctgcttctcgagtcgaaaaattcccggatttatgtcaattctcggtctcagtcttagcaaatttgaactcaagagtagctctaaaaaggtactttttcggcttaacagatcaaatttttcgtatgaaaagttgacattttctgtatttctgattgtgtgctaatcactctgactattttaatattcattcgttttgcccttggaaagtcgcgtttcacattaatgggacgcattactcgtcttattataatttaaagaagtgaccanctntatgctgcaccncggaatggttt

SEQ ID NO: 40350 - DNA, 518 bp, Heterodera glycines
ctcgacaacggaaaaaattatcaaaatacgctgacttctatcgatcaatttcacgttcacgaaatgaaaaaagtgctcgtaatagattgcaacaagggagtggtgttgctctcggcgctattcttatccctattctttcagttcttgcgcaacaattaatcgaaaaagttgtataaatatgaaatatacaaaaaagatggttatggtgccggagaatgaatatttagcgctgatcaatgctttaaaaaaaggtaggcatggaggaggaggaggagatgattcattgcaaagtgagaaaacaacaatagactcaaaaataatcaacaatctaacagatccaaaaacaagcacagatgttaaaatgaaacgccactcatggctttacaaacaaagaaaacagctcaaacatatgatagaaaataaaccgcaaaaagtgataatagaaaatccacaagctatctcgaatatagctccatacatgaggattcaacagaaaaactcaaatatgagtaaaacag

SEQ ID NO: 40351 - DNA, 1164 bp, Heterodera glycines
aggaaagacaaacaagaactgatcactaagttgtcagtttgagaatggcacaagaaaagggcacaaagggaggacataaaaagtgtcctataagcatcaaaaaccaagctaaaaaagcatttttgtgcgtattatgccatcctaaaattggcagaaagaatgacatttgtgtcaaattgccaggccaactgatcagagcttaagttgggccaaacagacagatcaaaacctcaacacaatgttccatgctttttcaatcactcaccggacacaaacaaatcaatgcctccggcggcggcgattgaacgcctaaaatagtgaaaaggcgtcaatttattgaacagcaaatcgtgtcgcctttcttactcgtagtttgcgcattccgcggtcagatcggcggcgtttccattcggaatatgcaccttttgaggggaggggggggcacaaaattagtggcggagggacaaaaaccaaacattggacggatcgatgtcaatgtgcctaaagggaaaattgggggcgatcagtgaataattgatcagaggcaaataaggtaattcttcaactttggcactttttagaaggatttttcatccatttttcccttcaaaatgtttctatcctttcaaaatatgtactcaccggaagaaattggagaacatgaatgtgtggtaactgtgcggatggttgcgcggaatgccaacatatcttaggataagcaaaaaagacattttctatcaattcatgactaaagaattcatttaaaatcggttaatatatttcaactgttggaaagtgccggatttggactctgatcaaaaaatcaaatggcgcctcgtaaaaccgatcagcagatttaactgctgctgctggttcggtttgaattagatcacgcaaagtggcactaataaatgcgcccgtttttccctactcgtccatgttgaaggtgacaacattggcaaacgacacttggccagccttgtgcatctctgtcagcttacagtacaagcccagaggggtgccacctgaaaaatgatcggaaaaactgatcagaaagagtagcaattcgtgtgacggtttagtcgaaaagacgacaaaaacgaaatggcaaaaatcggtcaacaatggcacaagaccgacaaataatcagagatgatttctatt

SEQ ID NO: 40352 - DNA, 1064 bp, Heterodera glycines
attaaatttataaaagggccctttaccagtgtcgctcgcgttgttcaatttgccgttcattttgctgcccattcagtcattttcgtttttagttttcccgccgaagcttccattttttgacataattaggcaaattcgaccaaggtcagtttgtcatattttgttaaccaataaatattcctaaaataataataataattattattaaattatttttaattaaataattacaataatattcatactaaaatttttggcggattttttattttcaaatcagaatataatatgttaatttttagtcagtaaaattagtagtcaatttggagtccatccgtctcatccatttgaatttgatttgttatttgcagttaattaatcctttcaaaatctgtgcacttttcccttccttctcagaatccgctgtttcttcttcttcccttatgcttcttcttctcattgccctcctttctctgctcgtttcgctgtctttcgcaatttcttttgcgctttttcttcgctttctttggcacaaaacacaaaaaaatgagccgacggaaggccaatcggcggccgattgttccgccggggagcagacgcaggcgacgttcgttccggcatttttgaaacaaaaatgtccatttatgggcactttctttaggacaaatgacggcagtttggccgagtcgtcactgttcgtgtcgttcattcattcactggtaatgagtttcgtttcgcaatccgtttagggtcacggaggagcaggcgatttcgtcgaccatcggagaaaatgcgcagcgaacgtaaggcaaaggaaagggcaattaattgattagttaattaattggacgaaaccctagtcaatttaggagagcaatcagaaagaatagtctatttaaacataaaaaaatcgacgatattttttataattaattttcatgttccaattgggttaatatgattataattggatagagcagaatttttagtaccatttaaacacagttctgatcagacttgaaaaaataatgacctgtaaatcggcaaaaaaaaagctcaataca

SEQ ID NO: 40353 - DNA, 841 bp, Heterodera glycines
ttttgtgaatatgagcattttttagtttctgatcaatgggtttttgatcttttctatcgatccaaagtgaccgggatcactaattcctcgttgaagagtttccccactcactcagttgggcccagtccgatcgcttgatcaccgcaaaatcaccgcaatgattcagtcggaccgattggttttgctgttggcgattcgtacgactgatcatttgctgctgcttcgcattaccatttttattgttgttattattgctgtgctgttttaaggaatcggcacaattaattggcattaaattgacttattttggcatttaattggtccatttatcgctttattttgtcgccaccttctgctgtttatgttccttctgctgctgtgccgctttgcatagatcggacggcaccgaccgcgtcggagagacagcgcaccgatgagacggaaattgcggaaattttggcggaagaagcgaattggtgccgaagggaggaggaggaggggaaggcggaggagaaacgtgatccagaataatgagttgctagtgactgatgttacatatagtgcatgacaatcttcttctgaaacttcccacacatgtttccagaaaatcccaccaattcgctgcatttcctatcataaagtgaattgatctgacgtttgaatccgctgggcttcgcaacatcaatcaatctggccaattccaggccaaacgagaacaattcgtggataaaatggaccgattcgttttgccacattttttggttattaaaatattttatttgcaaattccatggtgccgaagtctcattctccataatgttgtttataagtaatttaagtt

SEQ ID NO: 40354 - DNA, 1206 bp, Heterodera glycines
  misc_feature (896)..(896): n is a, c, g, or t
  misc_feature (1070)..(1070): n is a, c, g, or t
  misc_feature (1079)..(1079): n is a, c, g, or t
  misc_feature (1169)..(1169): n is a, c, g, or t
attttaattgtttatcaactttgtagaaaaataataaaataaacgatgctcttggcaaaaaaatataaataaaatttcagaattattatcaagttccaaacattatataaaccgatgccggtatgaatagaaacaatctaatgcattcaattaccaaaaataagtaatctgaaaattttaacagctttacttcaaaatttctaacctactttaaataatagtacgataaaaactaaaataattttaaaaaacacatattgtgttattatttaaattagtgctaaattgtttggcgttttgactatttattgatatttgttttattcattctcatttcattcacttctccactcttaaagttttgctgttctccgtagttcgtcgtgtgcggtggactcagaaatattacgtggcgctcctgacgttttgggtaagctcactgcagtttttcttgggttttgaattttgggagatcaaatcggctttggtttttcgactacgactttcacaatccggcgttgttcgagcccgaagaccgggataaacactacaaacggcattgcaaattgctcagagactgagaaattgcttaaaacttgctcaaaaacagaaatttgccgaaaatttttgaattgttgaaaatttgttaaagcttactcaacgactgatgcttcttactctccttttaccgccagttttaagactgagaagaattgccaaaaattgattgatatcgaaccaagacggttaaagaaaaatggcgaatatgagaacgccaccgctaacgcggcaacgcgcccttaaccttggaattgaattggacaatgtgggaaaccaaatttctgcacaatttaacaccaacataagagtaagcgagtcttttagtcctgaattgngccaccgccaaatggttggaaatggagttttagaaggtggcgaaaattttggcggcgaacagcacctgagaaaccgaacaatgaacagcaacaactcagtggtgattatgatggatgaaatcgcaccaaacgcgacgaacgcaccgatggtgaactccggaactttacgcgtanatacccganatatgagagaaaatggtttgggagaattaagtgaaagatttttgtcaaatcgtttggaaaacggattgggagtaagcaatttgaacactngcgggattagtgcctatctatcccccccgtccatgaa

SEQ ID NO: 40355 - DNA, 750 bp, Heterodera glycines
atgtcgccgcgtcgaaatgtcgccgcgtcgaaatgtcgcccaagctaaaatgagtcaaaatgtcgccaagccgaaaattagtgaaaaagtcggaaaattacatttttaaggctgcacaacacataattcactaactatttatcagaatagcataattaaataactaagataataaaatttgttggaaaaaataggtatttcaaaaagtgaataaaaaaatattgggatgaacaattctaagcgatattcatgattgaatcttccgggttttcgtagtcattcaattttcctgcgtattcttcgacctgcagaccaagagccgtcataaaatcatgaatttcggcataattgttgtatgttgcatccgtcaaaattctcatcagaatgatgacaaagacccttataaaattgaatttttctgggggtttcataagtgaaaaaatacagagaaatggaggtgcgttgcttcgagtcaattgttggtcctcgcgagcgcagaaacgcatgcgagtgcacgttcaaatatgggattgggaatagtgccgacagatgtccggttgttctcaagggcgggctcaaaattttgaataaattttttgaattcttgtattacctgtatgaacctggaccgtctcgccacgcattgattctccattcattttttttaatccctcattttgctctttacaaatggaacatgcagcaaatgatgtttgtggcggagaaaattgctgtcacggcattcattca

SEQ ID NO: 40356 - DNA, 899 bp, Heterodera glycines
tttttgtccatttattccaatcgcctattgctttaaggttttgtctttgactttgcttttttgtccatttattccaatcgcctagtgctttaactgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgtttt

SEQ ID NO: 40357 - DNA, 1055 bp, Heterodera glycines
tgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaagattttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaaattgctttttaaattttgcgaaaaattttaaggcttaacttttttttttataaaactgatcccaaaccgaaccagattttgcggagggcatccaaaaaacaaggaaaaagcacctgctatgaatggtaaatcccctaaattctgaaatttaaaaattttt

SEQ ID NO: 40358 - DNA, 1244 bp, Heterodera glycines
tgattgaattttcctaatttgcaatgccgtagttcgttggtgcccccccccccggaaatgccgaccaaccagaagcctcatccgccgtttcctcctcgtcctcctcctcaagcccggccctgttcagtgtggcgcgtgccaacatcggcggctcaccaaactgttgttcatccgcattttcttctgcgtcatcgccaatggcattctcagcggtgcctttctcaccatcgtctgctgctttgtttggacagaaaatgatgattttttcctgaattaatcatgagaaataaaaaagaaattatattttttaacaaaatattccaacctctcccgcataaatcggttcggcgtatggctaaaattgagaaatatacaaaataaataatttttaaagagacaaattaccttttgttttttcttttcagcacttttttgtgccgatgaacgccggggacgcggcaaatagccatgggcacggctgaaaaggaggaagaaaaattgaaagagcataataaaaattgaataaaatgcataaatatggataaatgggtgtatcccaaaatttcgtcggtgaaatttctttaaaaaattttgaaatttttagcaattttttgaaaaaattttcgaaaaaacttaacggctctaatgcactttatgagtccaatctacctttatgagtcctctcaattgacgatcccaggattttatacaataactttgttcatgtactaacaaatcctatctttatgccatgcttggaatgaactgagctcgaataccgttttcatgcccacaatgaacacaatactcttcatcattgacagtgacaagcacacatacaaaagtgtgatgatggagaaagaaaccgtcgtgtaatccaccaaacggtaagctttgacacgcccttcgaagtcggccattttttttttttgcaaagctttctacctgaaggggggtaggaaattgttaattggttgggacaatgcttaatagtgagcggtgcggcaaaaaaaaggtagggaaaattaatgagattttcttgaggacttttgggatgatttaggaaatataatttgattatgctaataattgcttcttgaggggccggctgatttttctgttcgaattcaagaaagctcaattttcggggtccgttatgaaaggaatgtggccgggtgtctttttgggagtaattgaaccatttctcatgagtgagacggtatgaattcctgatgaaaagactg

SEQ ID NO: 40359 - DNA, 1177 bp, Heterodera glycines
tttgtccttatttttcttttgatgacttcggagttaggaaagtcggaaatttactcctgaaaattttccctgcgctacactaacatttgcctccacgatgtcaatatggtatcaatttaatgatatgtctgctctccttatttttctttggatgacttttgtccttatttttcttttgatgacttcgaagttaggaaagtcggaaatttactcctgaaaattttccctgcgctacattaacatttgcctccacgatgtcaaaatggtatcaatttaatcatatgtctgctctccttatttttctttggatgacttttgtccttatttttcttttgatgacttcgaagttaggaaagtcggaaatttactcctgaaaattttccctgcgctacactaacatttgcctccacgatgtcaatatggtatcaatttaatgatatgtctgctctccttatttttctttggatgacttttgtccttatttttcttttgatgacttcgaagttaggaaagtcggaaatttactcctgaaaattttccctgcgctacattaacatttgcctccacgatgtcaaaatggtatcaatttaatgatatgtctgctctccttatttttctttggatgacttttgtccttatttttcttttgatgacttcgaagttaggaaagtcggaaatttactcctgaaaatttcccctgcgctacattaacatttgcctccacgatgtcaaaatggtatcaatttaatgatatgtctgctctccttatttttctttggatgacttttgtccttatttttcttttgatgacttcgaagttaggaaagtcggaaatttactcctgaaaattttccctgcgctacattaacatttgcctcccacgatgtcaaaatggtatccaatttaatgatatgaaccccccggaatttccattttttcaaaaaaagtagctcaaaatcgcaaaaattggccatttttttgtgcaaatctgttaacaaagcacccccaaaattttccccggcggcgcctatcggcaccgccggcccccgttccctaaaattttttggaaaaagcgcgccgaaaaaacgatttttgaaaagcaaaaaaaagaaaggtcatcgggcggccgaaacctttcgcaaaattgtttccgactacccccctttttaatgtatga

SEQ ID NO: 40360 - DNA, 885 bp, Heterodera glycines
agtgccgactgggatcggcccaactccagcaacagttgatcaatgcgtttctgctgttgcaacaggcattgctcgtgccgttggagctgtaattcctgtactgaaaagtcagcgttgactcggcactttcgctctgcgcctgcgctgttagcgccggcattttcagtcctggccacccgcgcgctgttgcttctcttttccggcatatcggtgccgccgttcgttatctcacgttttgtgcaagaaggtgatgaagccgccgccgccgttgcatgtgtttttggctccacttttacgctcggatatgccgatgccattgtgtggtgccgtcgactgttgttgttggtgatcaccatgtttgcctcattttcgtggttggcaaaactgatcggatgaggattaagcggatgctgatggatgaaaggcaataaaagggataaagcgaaaggacaacaacaagcacctggaaattggacaatttaaaaatgccgtcctgactatttagtgagagtgattagaaagtagagccgggaattttgaaataacggatctcgcttcggcaacttgacccggaccagtttttagaatgcaaatctgcctgggatgatcatgacccgggctaactttcaaaaatagccgaagcaagatctggcttcacgggaaaatcctgttataatctggtcctgtccccggctttaatgatcagcataataaagggtgtgcggacgtttcgcctactggacatctcgcctactgacacttcgcctactgacatttcgcctactaagccaaattcggacgttttgcctactaagcaaaaatcggacgttttgcctactaagcccaaatcgggacgtttttgcctattcaccctaaaatctgaca

SEQ ID NO: 40361 - DNA, 878 bp, Heterodera glycines
gcaaaatggcatggactgatgggtgggggcaaggggaggagggcatctcaattaaaaaaatatatcctcaccagcagcacataatttatgtttcgattgtttctttcttttttacatttctttgtgtgtgtaatgccatgaaagttggcacgcgaatgaatcggaaaaggacaattaaatgcccagatgaggcaaaagcggaggaaaagcataacaaattcaaaaaactaaatgagacgagagcaatggagttgtaataaatgctaatgaaaagaagggaacaaatgaataagggcagaagaatgggggaagttttggcatgacttcaatttattttaataaaaaaaggaaaataaaaaaattatgcacttttaagggggacagagagaattcggcttaacaaaacaaattttatgggaataattcaaaatgaaaaagtgaaatggcaaagccaatcgttttgaatttcgcttcccagtcaatggatctggctgcattaggcccaattctgatcaaaaaggtttggcccaatttttgatttttaaaatgttttttaggtccgacgcggtgccaataagtgccaccgttggggaaaatcactttccctggcatggactgaaattttcatataattaactactcaaatttgggttaataatgccaatttgggaagcaaggccaatgtgaacgcattttagtaacaaaagattgtcagaaatttttgtgagacgcgccaaaaaaaaggtattttattgagcaaattatgtacaacaaaatccgccgcaacgaaaggggcggcaggagaaaacgatgaccaaacgccgccgccaccgccaatgccgatgatacggacggatgagaggagagggggggggggg

SEQ ID NO: 40362 - DNA, 785 bp, Heterodera glycines
  misc_feature (26)..(26): n is a, c, g, or t
ctttgccaacgcatagaaggcaattntggaattttcaagatttaattctccaacgaattgtgccttcgcattatgcgaaagtcttcggtgtcggcccaactgacgcggacagcgcgacgattcagcacggtcagcggggaaacggggccagtgtgctagttcagtctcggcttttccattcagttttttagtatttttgcaccgaattgccaaaaacagtgcaatcggtgccaaatcattctctggccggccctttctcctcaattggtccaatttgatgacctctttctttggcaggtcatcgcccctcaactgaccaaactcgaccccgtgcccgtcctgcaaaagcaccaaacactgctcatccgaatcgctgacatctccaaactccaggaggccatcaaacagtacgtgcttcacaacgggcgactttttgacccggtcgaattcgaaattcgggcggacgacgacgcgggggttgggctaccactgctgacagcccaattctatgcagaagaggtcgaatttgggaggaacggatgggcacaaatgagaaaacgccaatgacggcaaatatgcccaaagtgaccccttttgtcccatcggatgccattttcgttttgagttcgatgtcaaaacatttccatgggttgccgtggaaactgtcaattgggaagtctattagccttcccatccaccgacagattgtccttttcgagggcacaaagcgactgttgagcatttcgctcagcgacccctcagagcaagacattatgcagcgtttc

SEQ ID NO: 40363 - DNA, 1132 bp, Heterodera glycines
  misc_feature (113)..(113): n is a, c, g, or t
  misc_feature (1086)..(1087): n is a, c, g, or t
tttccatcaaaattttttttttcctttaaaaattttcgggtgtattcggggaaataaactcttggacgagacaatattaaagccttttatttttaatactagtaaaatttaantagcattggacattcaaaatatctatattttcctcttttaacaaatatttgttcggtatagagaacccaacataattttgggtgctttgggtgagtaaagaattttagacgaagaacaataacgaagtaataagtgttattacaaataataagcattaaattagcgaattttccatttggaaaaagaaaggatatctggtattaaaaaagcgttgaaatgcaaaaaggtcgtcgcccagtgcgacaaatcaggggaccgtctcccagataattgtggccatttagctccacccaacttgccatgtgtatttgattgctttcctctcgagaaccctttcgacagttttccaactgaacctgaccaacgacggatagccaaagatgggatccaccatagtgcgaatgaagtgtttagttattgggtctaaagtggcagtcattttcacgttattaagtaaatattcacctgacggatatcctgaccccaatcctcgttcaggcgcaataaagccaatttcgtcaaagacccattcggccaatttgtcatccctcgtcactttggcaacaatggaagcagcgccaacaatgcgaaaaattgcatcagcttttttggaaacggtgattttgagtgtaggaaaacgctcattgagaaaggtttgatacacttcttctttgttgcctactaaatccacgaaaacctgcaaaaaaataaaaacgcaattaaaagtaatgcaataagatatcaaataaccaaatgattcattcattgacagtttgcttcctctgacctcgctaatgcaaatcccattctgaattgctttctcgatgagtgaaattgcacaaagatggcttatttcgttgagtgactgtttaacgcgccgttgcatttgcgcactgattgtgcggggatgaacaatgcgaagagaatatgtgagaatttgctgaatcggatggagacagataagtgaccaanntgataagcacttttgcgtcacagacgcaattagttcctgcatttt

SEQ ID NO: 40364 - DNA, 1231 bp, Heterodera glycines
tattttccggttattgtttctccgggtccaagtgttatagtcgaaatttcctggtagaattaccttcggttagtactttcctgatcaaaaagttatagttaaaatgcaattgtgtttccaagtgagaaaacgacagacaaaaggacaaacagcagaattgaaaaatgatttattgtattttttggggaaaattgaataattttattttacaattaaatgcttattaatttggattctatcacctttttatgtataaaggttttttaagacagattcggttgcttttttgtaaaacatcattaatttccacagaaatcggaaactaatttattaatttttccaaaatattacttcatcatcccaatattgccgcaaaatatttgccaacattaaaccatgttttacatccatatttttcattttcactaaaaaaacttcaaaatatattctaaaagacttcattttttgtaaaaatacattaattaaaaacgattttttgcctaaattaaaaaaaattgtctttaatgatgccgaaaaataaatctaagtctgaatgatttaacgagtggataaaaagaattaatgaaacttttttattagccctaacttttgaccaattgatcagtgtttttctatttgatccgtgaattggccaaagccatgataaaaccactcacagtttaggtggcattagtcagtccaaaatcttttttgttatttgtctaaaccaaaattttatctggaaaagcaaaaataacatatttgaaaaatctgagaatttcaaaatttaaatgcgcctctaatttcaaccaaaatgctaaatttattaatttatattgattctaaaagtctaaagtaattttgggtacttatatagtttaaagaccagaaaaaaaattttttaaaccatataaaatttccgtgcttgcgcgttttataaatccgtcaatgtaaacaaaatattgtacatatacgtgattatcaattttttatataatttaaaaatagtaaaaatgcgaatttttattgctctttaaaactctctccaaaaatatgaactgacaagcataacaaatcctaaacataataaatctttaaaaatataaaaaactagcaaacttttgttagaaagcaatcagtagttttataaagataaatgcaaaagttaatatcacaatcataacgtttttgccatttattatgtaacacacatcgtgttgatagcaacatc

SEQ ID NO: 40365 - DNA, 756 bp, Heterodera glycines
ttatggcttgatttaataatcattaaaaaattatggggctattttatatcaaatacattaaataaaacgaaaagattattaatcagtttaaaattgaaaaccattaaattcatatttgaataagagttaaagaaaataaaatttcatttagaaaacttaattgtaattcattaataaaatagataaatttttgtttaatatttatcatttttaaatgtctatattatttatttgctaccaaaatgtataattaatttgtcaatattttaaagcgattaaaaaaattttaatatctatctccacttatttatatatatttttagaattttgacattaatgcatatattgggatattttattgccggaattcaatatattaaatatgtaagtttaaattctcgacgtaacaatttatatgattatattattttttcaaatattcatttatttaataaaataagattttcaatttacgttaattatccttgttatttctcatggcctgtctttccattctgacattaatttttaaattgttataaaatttatctaatttatttcataaatcatttaaatttaaattttaaatactaatttgggcttttatattttttcgtttttaaatgttttaagcttggcttaaaaatttgtggccatatttcttgtgttataaaattggcgaaatgtataaatataatttaaatttaaaagaagtgatcaaaataatgtcaaaagggtccagcgctccgtatgacg

SEQ ID NO: 40366 - DNA, 847 bp, Heterodera glycines
ggagataaatggacgaattaacggacaaaatgagcaatgaatcaccaagcgggtgcattttattaggaaaagaaatttcaagaaacgtttttttttttttgaaaaactaagtaattttcattataaaatttgaaaaagcgctagaaaattttttgttgtggttttcttatacaaaatttttggcggcaattttttattgttgccagaaaatcacgcactttttcagacgttcacttatggtacacaacaacatccaaaagaataaattctagaggagagcgaattgcttccatttactcaatcaactccgtttaacacagattacccccacccaattcggcattttttccaattaatttgcccccccccaccaaggacaatcctttggcattttgttttcaattaatttctcccctcagggctttacgccactctgctgaccggcggtttgacctccgccctgtccggttcgttgggcattccgttgtcaatgctggccgactcgtactttcgcaatcagccgcccagcgcgtggcaagtgctttcatcaattccgattatggtgagcattggcacttttctttggtgaaaaaaacaaacgacacggtcaattagaaaattaattgcctaattaaaaccggctagcttttaattgctccatttttgcaacttcttacatttgaattttttcaatttattgcccattttgcccctccgcaattcggctttaacaagtacgtattattcccgctgatcagatctccttcctcggtgcttcgctgatcacaaatgccgcgcaccatcgcacatcctcgtcccatcactaccaccatcatcagcatcaaaa

SEQ ID NO: 40367 - DNA, 1559 bp, Heterodera glycines
  misc_feature (19)..(19): n is a, c, g, or t
aaaaattgccattttttangcatcatttttagtttggattaaaaaaatgctttttgaattttacttccctttttttggtgttgaaaattttttaaaaaatttcgaaaactgtatatttttactattttatgcctctaaattaaaagtaaattaaacaatttttcattcattttaaaattaaaaatattttatttattcgagagttaataaaaattaatttgatttcatttttttatatttatttcttaattcataaatttttcatataaaatataatttaaattaaaaattaaaaataaaatttatttattaaaaagttaattttatattttttttatatgtaaaattaaattcttattttttaaattttattatttatagattcattatttgaattttttaaataaaaaatgtaaaaaaaggtttttaatttaattttattacaaaaaataaataaaataaaatttaattattgaaaataacatatgttgaccttaattttattatacatataatgtaaaattttttgtacttccttcaattaaataatttaaacaattatttatttatttttccatttaattcaattaaatttttaaaattaacaaattttagtcataattgttaattatatttttattccctccaaaatggggaacggaaacagtcaccaccaaaccgcaacacattatttggatccggcaataatccatgaacctccaccagctccgtacccggacatgaacatgatcttcaaatccattccaaaaatgatgcaggtacagaagggatccaaaaaacaacaattaatttaaatggattaaaaaataattaatttttaattattttttgaggcaattttcttttaaattttatttattttttttgcttttaatttaatttttatgaattaaaaaataagttaatagtaagtgttatttttggctatttgctttttacataaattttaatttttgctttttaatgaattttattgaattaaaaataattttaaatttactgattattttatacaatttgttttaaatttaaattattttccttttttatttctattttttttctgtgatatttatttaatctgaattaattcaaaggttctcatcattattatatttgttaaaattaattttagattgatttttttatattccattggttttgttatttttaaattaataatttttaaaattatttcaattaatttaaactcttcattaaatgtttcatttaaggtggccgatgacatgcacaggatgagcaattatgtaagcccttttccaaacatttatcaaaattaagccgaaaaattggaaaatgcaaaaattaaaataaaattcatgagacaaaaaaaaaatttttgatagaggcaaatttttcaaaatttacccaattttttaataaaataaaaacctattttgtgagtcagaagtaataagaaaaattgttcagataatggacctcaggaatatgatgttcgcctgttcggtgaaattttaaaatttctaaattaaattaaattttcattttttttttgc

SEQ ID NO: 40368 - DNA, 301 bp, Heterodera glycines
acatttcgaaatttcaggatttaaaggtcgattcttaggggtgtattttttgaaaatttttaggtcgtttcttaggtgtgtttataaataaattgactcaaaatcacaaaaatattatttttagtaaaaatgccttaacaaatcacacccaaagtttcaaacttaatgaaatgcgcaaaaaaatgcataaaattaaatttaaattaagataatttataaattaaaaaaagaagaggaaaagaaagttgaaatataaaataaataaccaaaacttgaattaaataaaaagacctgcaggaat

SEQ ID NO: 40369 - DNA, 964 bp, Heterodera glycines
  misc_feature (959)..(959): n is a, c, g, or t
tccttctaaattgtatagttaaagaaagaaaaaatctaagaaaacattttccctcctcatcttcagccattttcaggcctatgaattggagcctcgcgcacaaattcagtcgccgtcgcttggcacaggcggacaaacgcaaggtgagcagaaaagtcactaattactggctttttattctcaaattgacaccgattcattttccacttaactttcatccgttggcactttttgccattttccccattttttttttcttttggcattttccctcaacactcatttgcgtattttcccctttcttttgcacacattttcccctctgttcttgtccctcattaacccatgcttcccaacagccagcctaatgggccgtttgcgtcggttggcctccgtcgaaaagtgttacggcctcggcaccgcctcagtcggtggcatcgacgactttccgctgacaggcggtggtggcggcggcgcttttggtggcgttgacccgtacaactacaaccacaacaatcactaccagcagcagcagcggttcggcttcacctccccctcctcccaccactgtccgccgcgtcgttacggcggctccagcgaccatttggcgtcgtccggcggcgcggcgatgatgccaccctcgtaccagcagcaacaaagtgtgccgccgatgggccattacagcggcggcggcacgtactttcatcacagttcgttggacgcggccggtgagtcacttccgcacaatataatatgtttgcccaacccttcaaaaatgacacacgttgatttggcagcgagtactgctccaacttgatggaccaaacaaacactcccccaccgcattttttaactgttaaagcaccaaattaacgaaacaaatgcaaaatatgtgtccaatcaaccgccaatcgtaaaaataatcatttaaaaaacttaaagcattttttagatcaaantttat

SEQ ID NO: 40370 - DNA, 895 bp, Heterodera glycines
  misc_feature (14)..(14): n is a, c, g, or t
  misc_feature (873)..(873): n is a, c, g, or t
atcttttctaaatnttgtcacaaaataaacaatttcgatttattcttaagattaaattcctttttgtttaagtttttgggcagtgattccgatttttaaatcaatgatttcggctgcttccctgggaaattgtttttgtaccgattgcgatgaatcaaataagaaatgatgatgaacacaatgaccacgggaactgtaaaatgaccaaaagtgattagcggtgggacaaatggcctttggctgttattattttcgggttttgccattaatttgtgccgtccgtccgttcactcacccaacattcccgtcgtaatgtaagcggcaaaagtgtagccaattgaattgaatttgacgaaaaaaatgacaccgatttccaacagaaagagaagaaggccaatgcacgtggaaaacagccaggaaagttcgatgtaaaagcgcagttttatgtgaggggagtcctgagtgcatccgttggcctctgaaagtgccaattttggcaatgccatcgaagcgcccaatgaaaggcaccgatgtacggcaacagacaggtggacatcatcagagcgagcaggtggacggagacgagcagagaagtgaccacgccgagcatgatcagcaacggcttgggggtcgactcttggtactgcagctcgacgagagcgatctgagaatgggcatcaaaaggaagcggtaggccaaacggaccatggcgaagccggcaagcagagcggaagtccgcgaagaagccttcagctgggcacggctgagatcgtaccgatacttctcgtggatggacaattccccacgatgtctggaaggaaaaacatttttaaagtgctgaaccacagctttggtcgagacttgtgcatgggntcaagctgctggtgggaaaacc

SEQ ID NO: 40371 - DNA, 1490 bp, Heterodera glycines
tgcctttaacatatttgaaatatgttcagatgaaagggagcgagaggagcacttccattgtatgtacagaacaacaaccaacaaataaattatcaaataaatgtatgtataatttgatttaaaatgataattgataacatgttaaacaaattttaacagagtcaatagaaatcgatagaaaatcatctgtgatttgagcagcggtaaaacaatcagcagaacaaatggaagacggtattttgtgaagggcagcaatgagaaaaagatgatgatggccggttgatttgtgtgattattggcggggggggggggagattccgagagggcggagggggtaaatggatatatatttacagaaatgggaagtcacaaatatgcagcataaacaaggcacttagcatctcgctctctctgttttttatccacggttaattgctcgaagttatgatgcccggggagtaaacggcggcgatgtttcggatcagaaggaggtcggaacaatcgcagtcgagaacagccgagacacgctccaggggaagcgtagaacagtggccatctgctgagggggcgaacgaaactcagaaccaaacaaaaacctcccaacctcaaaactacgcaaaatttcttaagaatcaatttgaaaggaatggaaacgatgagaaaaatgcaaaattaagggcgcactgaatgtttttaatgtaaaaaattcggactgaagtgtcctttttcaacagggacccagttaccaatcatacataaaaaaggtgggtgggtcggaaaaaatttttgcgaaggggggtcggccgctgatgacctttttttttgcttttcaaaaagcgttttttcggcgcgctttttccaaaaaatttcgggaatagggagaccggcggtgccgataggcgccgccggggaaaattttttaaattttgggtgtgctttgttaacagattttcaccaaaaatggccaatttttgcgattttgggccaatttttaaagaaaaattgggatttggggtccggtggtgccgataggcgccgccggggaaatttggcaccgaattacggcactaattatagccaacaatccttcgaccatcctccggttgcttttatggcttggtgttatcagttttaagcgtaataaaaattacaggcaatcattttgccgttcgtccaccgatttccgcatcttctgttcctgcacagcatttggcaccgaattgcagcaataattatgaccagcgacccttggtccatccctctggtcctttaccacacttgattttttattgatgactatacaaatttcaggcaattattttgtcggacgtccaacgacttcagcagcttctgctcctggaacccattattctcggtttatctgtgctaatgataattgcaaagtgcagccacttttcatccttaccgcccgccgtagtgatcaccgttctgtcgtcatccggcaaatgataactggcgaaaaactgcag

SEQ ID NO: 40372 - DNA, 842 bp, Heterodera glycines
aaatttcgttaagcttcagaaaagtaatggccaaaaattttcggaaaacccagtttgtctatgttttttggctatatttttctgaaacttaacgaaattttttgaaaattggcatgctaatagaaaacacatagggctatcgaagctactaaattcattcaattcagacaactatgaaaagaaccgggctggcgcccagtcgacccccaccgtccgggaaggcataagtttgatcagctaatctccccgggattcattcgatttggcaaatggcatcgattggatctgtcccatatttgtccacatcccatcccatttcccttgtgctttcgagtgccgttccttttccccttagcatttccacgattgggccggccgttgttcgtcttggtgcgaatgcaaatcgaacgggtcattgctctgccatcagcttggctgcctttcggatgcgcaatgcgaagcattgcataccaccattggtatggccaaaaagcacagaaaacgcgaaattgttgaacggaaaagacacggaaataaatgtaaaaatgctgaaaccattttaaacaatggcatttagggtttggccaacgtttgtacttggaggaccgcggggcgtgccaatgccatgacggagtgagctacttgttaactattttgagcattgagattgactgggattttttgacaaaatcttactgatcctctaatttgaacaattcatcctcaaaagggccgcttcatctgcgacacttctgaactgatgcccgatctgccgcccggactgtacatcaccatgggttattcccaagctggtaaggtacagtaagtcccgaaatcagggg

SEQ ID NO: 40373 - DNA, 945 bp, Heterodera glycines
tttgtgatcaagaccccgcgaattgatcagggctaattaatttcttattgtcgaccatttgtccttgaaaatgattaggtagaaaaactactgttataacgcattttcaagagcagtaaaccaaattttcaagtacagttctttgctattcaaggacgagatgatgccaattattaagcccaagtcagtggagaaacaaaaaagaaattaacatcattttcaccacaatgccaaaagggcatattttgaattcaaattgattacaaaaacccaaataatatttggaccaaagactgaaataaatttacggcagctaaattaaacggcacttttctatgtgccgaacagttttgacaattgaacaaaaaaactgaccaaaacatttgctctgattggtggcacgatcgacaaacacctgaacagcggacacagaatgaaataggcgataaattgtcataaatgctaattgttgcataataaatgagaattattacgcatttatcaaattagaaggctaattgatttgcataattaaatgacgaattgtcacacgcatcttgccaaattagtgggctaattgatattgccgaattagactgctaattcatattgctaattagtgggttaattgatgttgcctaattagagggctaattgatgtttctgatattgcctaattagaggtgtaatttctcctattgtttatcgcaacaaattctttggcattcaaattacctttgcgctgagcacttggccaaacggtatgaacatttgggccagtttggcatcgtcaaactcttgtggcaaatggtagatgaacaggttgcacccatccgggcccagcagtgagtattcttgaaaagggaaaaattgttgaaatttgaaaaccttaacttttatcactgctgaggctgccgaatttttaatgactttatatatatatat

SEQ ID NO: 40374 - DNA, 1448 bp, Heterodera glycines
  misc_feature (22)..(22): n is a, c, g, or t
ttccgtaaattttttgaaattntaagcaatttagttaacaaaatagcattaaagagttaaaaattttcccggctgcgcatatcggcaccggcgaacccccatttcaccatatttttgaaaaattgaggccaaaatggcaaaaatagtaattttttggcgaaaaaggcagaaaaaatttgtattgcttttattttggcgcaagactgctaccaattcctgctttttgcactgataaatcttacactacttcaactacttaattctaagcattagtcatagcttagtcttaaaagctttggcttgcttagacctaggcataccatttttatccctatttttttcatttctataattttgcttcattatttcattttggttgatttggaattgaacttttcataaatatttaaaaattcaaattagacagcccagtaattttatataacattatttaaatttaattatttattattcggaatacaaaaacaaaacgatattgataaaaatcataggaaagttaaaattttgccctttttttgtgaatcgcccaaattttcttgtgtatcgactataattaactattttaattttatattaaatatcaatttaataatatgtgaagctgacatacaaaaaattataaataggtaattgaattcttttggtaataataaattaattttataatcattaattgatattaaaataattatttttaatgtcacctcccccgctggtttccaaagtatgttcccttcggtggccaagaaattgaatacaacgctatgaaaattacttgaaattttattatttaaatataattttggagattttgggtaatattccatgagcgataatgacaacctatatctcgacggtcctcccccccccccccccggtggcgcttgtcggaaccgccatgcccatccatcttctaccagaaagttttacggaaaaacaccatcccgccctaagtccccactttcatcgtttcctgaaaataaaaaaacccaactgtccaatgttttcacggcactttccatcgctcgctttaatgaccatttgctgaaggtggacaaaagcattcgtttaattataattagagttgagaaaattgtcgagagacggaaaatgggaattcaagaaaggatggaatttaattattatcaattatttttttaggattttgttcaacgatgtttgttgtacattgatacaaatgtggaaactctgatcaaatctgattcatttttgcaaattgaccaaaaattgttgtgcgaaattttggaacgtgaagaattgcaaatccatgaagaaatttcaatttggaacgcagtaattttcattatatcctcattaattaatttgattatccccagattaattttaaatgttttttcggcactccgttgggccgatgaaaagtgccgtgaaaatggcattgaatg

SEQ ID NO: 40375 - DNA, 1315 bp, Heterodera glycines
agatgatgatgatgctaatttgtgtgataatgtgttgtggctaaacgatgtaattagtggtgcttaatgagagtgtatgaaagattcaattaattaatgggggggattttaaatgcaatgtaaatgcttttccattaaatcaagcatttaaaaagattgtttgccaataaagcaatttaaagaattcatagtttgttgatttatttaattttttataaataataattgataaaaataagtggttagcatattcttcactgattaaaacaaaattatatgagatatgtcttttagaaataataattaattataataagaaaattaattaaggcatttgtaattttagtataatttatttggaaaattaatacattgttgaggaaatgcaacaattcaacctggcgttcactattaattagttcaaaatcatttttaaaaataggaaaaataaataaaatagaatatgtcattaattccaataaaatattctgaaagaataatcagaaccaatttagcatcttctcaattgcacaaattctttaaaaaaaataaaaaatgttaataaaattcattttaatcaaaattcagagaaattgattttcccaataaaacaccccataaaatgtgttggcgttccgttccattccccgattaagacgagtgcacataattaatgggatacattcaaattgtcccaccgatcgggggctggcactctaagctcatccatctcattttcatccattttaccctgcgcatcatcatcacttccttcactttttgagagggacagaaaaatttcggtttttttgcccgagggcaaaaaaagtaattaattaaatttgtgaccaatggacaaggaaagagccaccgtaaaattgtccagcgaaatgctgctggttgctcgtcagctgcagccccgccggaggggtaataaattaagccatttcagaggtggcgggcggtgaaagaccaaaaatttttggaatttgaattttccgccaccacaaattggagcgcgggcagggcccgcccgttaattgagcatgctgataatgatgatgataatcattagcaggaggctgataataatgatcatgactgctaattagtatgctaatgagtattgtgcaaaaaatgagagcccgcaaattaaagctcagaatcgggatttcggtattgagtcgagattttcgcactaattcaaaaaatgttgaaggaattttttttgataaatctcaaaaaacccgcaaatttttccgttcatggtcttacaatttgtttcgaaggaaacgccggcggggcaacaggatgc

SEQ ID NO: 40376 - DNA, 939 bp, Heterodera glycines
gggatggtaccaggattttggaggggggtggggtgattagctttccgggatgaaggccttttttcataccatttttgaaggtgttctcgaaattgttgttttggtattttttaaattaaccctattttattttaagttttaaaaaataaaatccaaaatccagaccgtattttttcaaaaattttcattaaattatgtcttggggctgaatatctttgttactgtgaccatccctgaacaaagtgaaaaaaccaacaaatcatgttttcctcattgcacagtccaaatccgccatctatagctatgatcgagcttggtgcgaaagtctaggcaagaaaaaagaaaaagatcgacaagaagaagaagcagaagaacaaggggaagaagaagaagaagaagaacaccgaccagaacaagagcgacaagaacaagagcggccagaagaagagcgaccagaacaagagcgacaagaacaagagcggccagaagaagaacgaccagaacaagagcgacaagaacaagagcggccagaagaagagcgaccagaacaagagcgacaagaacaagagcggccagaagaagagcgaccagaacaagagcgaccagaaggagagcgaccagaacaagagcgacaagaacaagagcggccagaagaagagcgaccagaacaagagcgaccagaaggagagcgaccagaaggagaagatcgaccagaaggagagctaccagaaggagagcgacccgaaggagagcgacaagaaaaacagagacaagaggatggggaagaagaagacggggacgatgatgatgatgatgatgatgataatgaggatggcgccgtccagtgcaaagtgattttgcgaagaggaggcgaaggagacgatgatgacagtgctggagggaattcgggagggaatggtgcaaaggatggtggagggg

SEQ ID NO: 40377 - DNA, 545 bp, Heterodera glycines
aggttgcattgctgttgccacgggagcagggttttgttgacgttttcggaagcgcgcttcatattcttccttgagttgttctttggtcagcgctgggcggacgaacaggcggttcaggttttgtagagaacggagtcgagcacgctcgcgcttccatcctccgagtgccatgtgttggtgtgtggttgttggcatgaccaccttgagcgggcgtggtgttgttcgttgcgggtcgtaccgtccgagtcgaaagacggcggttggttgggcctcaacttcaagatggtccaggatttttgtggcggcttccctgtcttcctgaacacgttccgatgggcgaatggcattgctttccgggaggccaatgaacaccaaagtgcgttgtcgttcttgctctgcgagtgcaacagtgtttgggtccaggtccagtgcaggtgccattgaacgttttgcgcgaggcggagtgatgtttgatgcgttggttcgcttcatgacgaataattagcaagaaataattgttttttgtgatctgaattgtacaattt

SEQ ID NO: 40378 - DNA, 933 bp, Heterodera glycines
  misc_feature (204)..(204): n is a, c, g, or t
  misc_feature (896)..(896): n is a, c, g, or t
ctgccattgctattcctgcaatatgcagtctagtcacccctatcgattgctattcgaatggtttaggggtcgtatggcccacacaaaagttgtagctacttcttgcaaagaagacttaaccaactggaaacagcaagccatccaaatgcttcaatgtaaaaaaaaattacatttggatgcaacctttatttttcctcgcctctncttttcgaaaagaaaagctattagcaagcgagattggaccaattctaaaacaaatcagagtaattaatttaatctgactttataagataaatgggaatttaagcgaaggattcatgcaaaataataatctatagaaattctcaaaaaagtagttcctcgcagattcgggcaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatgcagtctagtcagcccaatcgattgctattcgaatggtttggggtcgttggcccaaacaaaagttgtgctgcttcttgcaaagaagaattagccaactgtaaacagcaagccatccaaatgcttcaatgtaaaaaaaaattacatttggatgcaacctttatttttcctcgcctctcttttcgaaaagaaaagctattagcaagcgtatttggaccaattctaaaacaaatcggggtaattaatttaatctgactttataagataaatgggaatttaagcgaacgattcatgcaatataataatctatagaaattctctataaagtagttcctcgcagattcggngaccgtttctataaagctagagacatatgcgctaacc

SEQ ID NO: 40379 - DNA, 807 bp, Heterodera glycines
ccattagggcgggaataattggactttgtttggtttgaccaccgacactcctcccccgcccgtaatgatgtccagcaatgggaatgccatcgtacaggttcgacgtgaccccgagacgcagtaccacatgtcgcgcgttgcccgcgaggggtttcggcgtgagggacgcggttcagtgaacattcggctgatgtaggaccggggaaagggtccgtccggcccgactccgatgcgcttctcccctgcagatcggcctattccgcgcagctttacctcgagcaggggtggcgcgtgttcgcccagcacgaccccaaccaactgttgttctactatccaatccaaacactggtggaccagcgcaaggagtcaagcctaatccaactgtgccggaaatacaacccgaagtgaggggagttttactgctccaaattgggggcacggaacagccaagagaaccaaatttcagcgagaagttcattctcagcgtcagtatcattgcggacatcgaacagtgcccggagacgccaccgcccgccgagccgatgagcggcggcgcggcggcaccacccgccacggcaaacaacgcattgccaacgacccccgtttatggcacgacagcggtgccaacaaatgtgtgagatgaatgcagtggcgatggcacaatattaggcgtaagatcagaaaccgaattcactgcccctccccctctcctccgccttatttttgtgactttttcctctccattcattcgttcatttttcactttttaaaacagctctttcactgttccaaccccaattgtcaagt

SEQ ID NO: 40380 - DNA, 1272 bp, Heterodera glycines
  misc_feature (1206)..(1206): n is a, c, g, or t
cccaactctaaaggcatttcccattggtggaaaatgaaagtattggcatttccttgagtttcctttatgcctttcccccgccgaagggtctcgaattctgatcggttcgtgcagtcgttctcgaatgttgcgggcgctaaactctcaaattggaacgagggaacgtttatgggaagcgcagaaacggaggatgaacaaaggccaagtgcaagtgaaaaaagaaaaacggagaaggaagtcaatggcatacgaaaagggggcagacgaaatagtggagggaagagaagcagaggaaaacggaaaagcgcaacactttggcattcgacggtaaattatggcaatgctaaagcaattaatacaaatgccaaaacattgacaatggcattttgattaatacggaacccaaattgttgtgaaaacctaagctaaactcggacaaaaacaccgcggagaaatgacgacaaaagagcaattaatggggacaaatgggcacacattaagtgtataaaaatgaattcggccaaatccctcaaaaggttttcttttgtgccgccttcgcttgccaattccgacaaatcatttggcggaaactttgcggacggaccgaatcgcacggcaacggtaaggcgatcaaagaccattccggcatcgattaactccgcgggcagtagcttcaatcatttggatgtgtacgcgacagtcggaggtgagtaacgagctcaacatttggccagaaaactatgacattggattggcatctgaaaatgccaaaactcacccttttcaaaatgccaaggaatgatcaccactttgagtcggctaagcgcacgactccgaagcaacggattcgggcatgagcaggaggaagttgatttgtacggagaagaaagggcacaatgggaacgaaaacagctggcggccaaagtgaacttcgacttgatcggaatcgacccggtccgttggggaagggaagcgattggtactgacaatgagccgattgatcatctcttccgatcagtcatttagcgaatttgattttgattggccaattaatcacttcctctgatcactcaattcgcaattccgtctctgatcgcttttccccccgtaggcgcccttccaattggtcgagcacacttccctggtcaaagtgcactcgctgttttccctgctcagtctaaaccgtgcctatgtgactcgccgtgngcgtttgatttggcgtgtcgcacttcgcgatgtgagcaaaacaaaacaaaaaaatgaaaaaataat

SEQ ID NO: 40381 - DNA, 227 bp, Heterodera glycines
ggcggcggcggggacgggggcacgataattccgcccccgcggaggcgggggtttgatttgaattaactccaaaaaattttacaaaaaattatttttttatgaatgatgtgatggctccacattcctttagtcaatgtatcgcttcaattcaattccttttgcataaattacacagattttgtctaaagaattaccaaattttagagatttttggctaattttttaag

SEQ ID NO: 40382 - DNA, 1225 bp, Heterodera glycines
gttgatgtcgttgtgaagagcataaagggacgaagcgcaaattatcggatgagtaaaagtcatcatattgggtaattattcattgaattatcaaaattgtgttcattttaacattctttcactcccgagattcatttcatcaacaatttttactctcaggttccctgtctcttgtgaagatatcagattattatccaccatttttgttttgatttttgattattaaatgatctacatttcatttgtttttcaatcgatttaaatttaacaggattttccgctagaagaagacgaatcggggagggggggggggggggtcggggcacgtttcgggaccaaaaatttttatgattgattgctcatttgatcgaaatttcaaaaaaatttgatttttgttcatgatatactgaaaaatcaaatctcgtatcattcattcatagtcctaaagattctctataaacatgcaatttcaaaaaattaaatcaaacttggaaaaattatggacgaaaatttttaggtttttgatctttgcagtaaaaatcatcaaaagccatttgagaatgattgttgatcatttttttactgcattgaatttaattgtcaaagtaaaacaacacacatttattatacaattttccttaaaacattcgttcattcgtcccattcttcgccactggacgactcaaatgcgtgggcagtgtctttgtttcggcggtaccttcgttctttttaaattaaatttggtttaatgtacacaccgtttcaaaaaactagatgtgtgccaataaatagagagtgcagagaaaaaaacatctctcatttttggcgtactattttttttatctctgttaattagagtgccacgggaccgggaatttttgccaaaaccaggaccgggacttgccgggacctgagaagccgggaccgggaccgggacctcgatttttttccgggaccgggaccgcaagaaaaaccgggaaccgggaccaaccgggaaattttaaaaattcaaaaaaattttaaaaattaaaaaaaaaattcaatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaa

SEQ ID NO: 40383 - DNA, 1081 bp, Heterodera glycines
  misc_feature (54)..(54): n is a, c, g, or t
  misc_feature (67)..(67): n is a, c, g, or t
  misc_feature (93)..(93): n is a, c, g, or t
  misc_feature (1007)..(1007): n is a, c, g, or t
  misc_feature (1043)..(1043): n is a, c, g, or t
gtcaggtggccatttatttaattaattttatgccaattaattagcaatttgtancgtgatcacttantccgacacttcccgtggctttcgaantgggttcgaagcaatgaaaaagtttcttcaatttgtacttcgaccacaacaatcattgtccagccgaagaatggcaccccaaacggtgccaatcgcttttacaatgaaaaattggcatctgattgaactcaaaaaagcgactcaaattttttgattgattttgtaaaaatgatttaaatagtttgtttttctgatcaatataaagctgtatttggtggatctttatttaaatattttacatattattttgtttttattcattttatgtaaatttgggtaaatattttttattttttgagaataaagataaggaattgcgatgacattttgtcacttatcatcaatttataggagaaatgaacatcaatcacagtttttataagagttttctgctcaattgatgatacaaatttagtcatatttttgatttattttaccccaaattcttaaaatttttttccaatttttaaaatgtcccaaagaacttcctcaacaataaattttcgtgacatcgctttatgccaacagcagccacccggcacaataatttgctttcggcactgtcgtctttttcaaaacggcactttcgtcgctgattcgggtgggtgtttttacttgttgtaaattaagctcgttatttctcgcttattattacagtaatacagagatttacattttatgcgtcccatgaaatttatgcgtaacataattattttatgagtctcatgaccaggggatggatttatatgtttttacatatttttttgcgcatatgctatcgtatgagcacaaaaatagcatttttacctgttttaataacaatctgagcgattttttagcacttaaaaaaacaaattttgaactttttgctcataaaaacatattttggtgatttttaaccttcacatattttngagggtttttttggctcatataaatccgttccctgntcatgacattttatgtgtccaactgaattatttttttt

SEQ ID NO: 40384 - DNA, 1269 bp, Heterodera glycines
taaaattctttcattaaatcaaattgatgaatatttttcaaattgattcagattaatccaatgttgcagcacatgtaagaagcaatttcttctcatatttcaaaatatttaaaatattaattagtctttaataattaattaaaataatttagcaaataatttttcaagcattttaaataaagtaatttttggttttttggcaatcacttcaaacggtccattccgtacgaccgaattgcgcagtcgctggtccgaatgaattgtgacgaccgttatggcgcatcgttttgcaaaaagtaggcacgcaaaaatccaaagtcaaaaacacaacgccatgaattttcggcgcaaatttttactttttctcacaaagatatgtcagcgatttggacgtgtgggtaagttttgtccgccttttacagtatgccattgctgtaatttttcttccctctcccgactgattttgagacgtataagcagtggtcgtgcagtggctacaggtgtccaattaatgaattaattgagctacaagtgtacaattaattaaataattgattgaataataattagcacaattattttgcattgttttaaattatcataacaaggtattaatttttttatgatttactgaaaccttaactgtgtacttttattttaagttttttattttactacgatataacgttttattattgaattttaaatattgttttaagagtttagtaatttaaatattttattatttcattttttattaactttttaaattacatttttaaatttaatcagttaaagttaaatttttttttcttcaattcatctttcatcattttattgctatgttttttctttttactttatataaataatttttatgacgtttcattttttatttttgaataattatattaataattttatgtagaattatttgaatattttttatgccttcattttccaagttttttattttatgcgatatattagcattttttgttttaatttcatttttgttaatattgaaatttattgttaagcccttatatggcattccgcgcgtgccgcaaaacatgcggctttttgcgactttgacaaagtgcactacaatctgcgaaatgccaccgatgcatgcagaagcatagcggacgagaaggagcggcgccgatgaaagtgatacatcgagcaaattgatcacctaatcaagcgatcagtcgatgattgatcaacaaaatgaacagaagaacagcactgcaggagtgatcgaaa

SEQ ID NO: 40385 - DNA, 673 bp, Heterodera glycines
ttctgctcaagtaacaaaaaatatgagtgatcgaattatcactaaaaaggtaagcctacattttttggcatatttcaaaagcaataaataatttttaaaatttaatgattttcctgcaagaaataatcattggtccttttaagcggccttgtggtgggccttcccccccccccctcccacgcccttcagaacacgacaaatatttcaacaaaaattttgaaaaattgactagagcaatcgaacgctaacggacgacctaatggaaaaaatcccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacg

SEQ ID NO: 40386 - DNA, 1492 bp, Heterodera glycines
tagggttgagcggtaccggtaccggtactggccggtaattccgggttttttttggtaccggtaccggtacccggtaccggttttttcaaaaatgaaattaccgttaccggtttgtctagtaccggtaccgccggtaaaaatttgcactggtaagaatgggggtctggtcgagaaaagagtaggaatttgtgaagaaggagaaatttttgagaaaaaattaaattttatttcatttagtcatgggagtacacacatgcacatgtggtgtagtggttaaactttctacctttcataattttttgcctgggttcaattccccacttggatagaatattcctcacattttctttaccatcattttaattaaaattttaattttaaaaaatatttcaacttttttctttcatgttaagcatcctaaaaacccaaaacttaatcaattggtcatttttttacaaattctgttaacaaatcgcattaaaaaatacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggccgctgattattcaaaaaaccgcatgtctctatgacttatagcggctgaggtatgggcacttcaattttgacgtagtgtaaaatgcactattttcttaagaaatacagtactttttataggcaccgaaataaaagtcgacgtatctcagcgggcctaaatcgtagacccactattccaaaggcaattcggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatactgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtatgtcctgaatttgaaaaaaaaaaacttggtcaacctgaatatacatatacttctgaacaattctaatgctaaaaaacaggaactcacgcgaaaattgaataaaaattttgtatttgaaaaattttgtccaaaaattttttttgtctaaaatttccggttttttaccggtaccgg

SEQ ID NO: 40387 - DNA, 822 bp, Heterodera glycines
acttcctgttccttttccactttctcttaaactttctattccttttccactttctcttaaactttctattccttttccactttctcttaaactttctattccttttccactttctcttaaactttctattccttttccactttctcttaaactttctattccttttccactttctcttccactttctgtctcttccattttctcttccacttcctgttccttttccactttctcttaaactttctattccttttccactttctcttccactttctgtctcttccattttctcttccactttctgtctcttccattttctcttccacttcctgttccttttccactttctcttaaactttctattccttttccactttctcttaaactttctattcctttttcactttctcttaaactttctattccttttccactttctcttaaactttctattccttttccactttctcttccactttctgtctcttccattttctcttccactttctgtctcttccattttctcttccacttcctgttccttttccactttctcttaaactttctattccttttccactttctcttaaactttctattccttttccactttctcttaaactttctattccttttccactttctcttaaactttctattccttttccacttcctgttccttttccactttctcttaaactttctattccttttccactttctcttaaactttctattctccactttctcttaaattttctattccttttccactttctcttaaaactttctattccttttccactttctctttcactttct

SEQ ID NO: 40388 - DNA, 463 bp, Heterodera glycines
aaaaagatttccaaatttatgaaaaaattcaacaaattttcttaataaatttcattaaaactctaaatttttcctcagcttcgccaagtacaaaaggctaaattttttctgaaaaagttagctaaaaatcgtaaaatttggtcattttttggtgtaaatctgttaacaaatcacacacaaattttcaaaattttccccgacggtgcctatcggcaccgccggaccccccttgtcccccaaatttttttgaaaaatgcgccgtaaaaagggttttgaaaagtaaaaaaggtcgatttacaggcttgatataattctaagctaaaataaagattataaaatttttttcgaatttttaatcaaaatttcaaaaattttgaaaaagtcccggcccaaaaactgggaccgggagtcccggttcattttccaagtcccggtcacggccatttcaaaattccgggctcta

SEQ ID NO: 40389 - DNA, 1008 bp, Heterodera glycines
cttctaatcactcttgtacctcttctaatcactgctgtacctctcctaatcactgttgtacctctcctaatcactgttgtacctcttctatcactgtgtacctcttttaatcaccgttgtacctcttctaatcacagttgtacctcttataatcactgttcttcctcttttaatcactattgtacctcttttaatcacttttatacctcttctcatcactgttgtacctcttctcatcacttttgtacctcttctcacactgttgtacctcttctcatcactgttgtacctcttctcatcactgttgtacctcttctaatcactgttttacctcttttaatcactgttgtacatcttctaatcactcttgtacctcttctgatcactgttgaacctcttctaatcatcatcgtacctcttctaatcactgttgtacctcttttaatcacagttgtacctcttctaatcacttttctattactttttcactgtcgtacctcttcaaatcactgttgcacctcttctattcactgttgcacctcttctaatcacttttctatcactttttcactgttgcacctcttctattcactgttgcacctcttctaatcacttttctatcactttttcactgtcgtacctcttctaatcactgttgtacctcttcaaatcactgttgtgcctttcccttccgtggttgcacttgtacctcttctcatctctgttgtacctcttctaatcacagttctacctcttctaatcacttttgtatctgttctaaaatttaaaaaacggcgcgaagcggccgttcgaggccgcaaatcggcctaaaaaggccacaaaaagggtgcgaatcgcccgtctgagtcatcaatttttaataacgggcgcgaagcgcccgtccgactcacacaatttaaaaaacggccgcgaagcggccgaaaacacaacaaaatttaaaaacgggcgcgaaccgcccgtctgagtccatcaaattttaataacggg

SEQ ID NO: 40390 - DNA, 1383 bp, Heterodera glycines
  misc_feature (17)..(17): n is a, c, g, or t
  misc_feature (78)..(78): n is a, c, g, or t
  misc_feature (129)..(129): n is a, c, g, or t
  misc_feature (212)..(212): n is a, c, g, or t
  misc_feature (222)..(222): n is a, c, g, or t
atttttccagagatacntatgttctgaagttagcaaattaataatttatgggcaccgaatcaaaagctttttcaaatnctataaaaattatatcgatattttgaccattttctattggtttatagaaanaatccagagaaaccaacaactgtgtgttggtcgacctggatttcaaaaatccaaattgttcatctgttaaaatcttatttttntcaagatgtntaacaatattccatttccccataatctaagattattcgaaagagttcacttatgataggtgccaataaatctgcgcattgcttaatcaatatatattaggtaacccgtctggagatgtcgagtttctgttgggtaatttccttagtgcattccagaccaaggcagcatttaattcgatatcggttaggctaactattttgtcattaattggataattcatattacaatttttttgcataaaattttgttgaaatattttaccaaaaagcaaacatttctgcctatcctcaatgtaaattctgccttggtcatcgaaatgcaatcttatttctcagtcagaattaaatttgttgccgatgtatttaaaaatagccaaattgcctttattaacaaattggctttctttcttatcattaatattttttaattcccttttcagattcctacttaaaattttgtactttattttatattgtccgtgatcagggcattctctaataataacttttagctaattttatcgcgacaaatatttcatttattattctatttttattcttatgtttatactaatatatatttattataattactgttttatttttattgatttaaaaggtattgtttgtttactttaggtcgtttttcatttaactatatttataattttaaaatttattgttaatccaacttgtcttctttctcttctttctttacaattttcatcaattttaagttatttgtactaaattattgtataaggtctctttttaaaacacgaataacttttttcaaagaaaccataaaaaccctgaaaagggaaagtttactattattggagagtcgatccagcggagaatcgtcgtaaaacttccatctaaaagtgatattttctttcaaacaaaaaagattaacaaagttaattttgctaaacaaggcatcttcgggtaaaaattgataaaaaatttttactacattttctatttttctgtacatcttaatttttatgggggaaatgttcatgataaaatttctgctgtatgggcctatgcgtagtaagtgaagtgagtaaaaaaatcttgaccttataattttgcaatggagcataatacttccagttggtaggttttaagaaccaaacttattttctcctataatatg

SEQ ID NO: 40391 - DNA, 1070 bp, Heterodera glycines
  misc_feature (8)..(8): n is a, c, g, or t
ttataaancaactttttgataatttacttgataaaaaccttttacaaaaaaaagaacctacacgcaggggaaccgaacctggtgtttaaaaaacggtgactggcgcactaccactacaccacttgacactatgatgaagtgcaaataaatatttattttatttattcactaaaaaactttggcacggaataactcggcactcgggctcattccgcaaaaaataaaatcacttttcttaagaacccatgggtgctctatccactaaccaaatttcattctgaaatcccacggacaccctaggaccttcctttgtaaatgaaattttaattttctaatgatttggcctttatttaatcctttctcatttccggatcaacttgtattcttttacttatattattttttaaaaatttcgaatggtatttcattttattgtttcttttgaactccttaatacaatcttcggataggtttatctttgtacttttccatatttaaactttagtcacaaaatatttataatttgttaaaattagagttgttaattaattttttatgaaaatcaaaaagttttcgtgttaaaattttcgtatataaaatgtggctatttgtttatataaaaaattatctatatatattttgattatttaacagtagtgaatttttttctttaactatttaatagctaaataaatatttaaattaattactagctttaatatattagaaaccataaaaatttaaaaaataagaattatttttgtctggtttgagtttttaaaaattaatttaacttgtcaaaaaatggtgatctgaagatgtacaatggacaatttgtgttctgttgtgagtaaacaccgatcgacaaaagttctaatttttctcccggcagcgccaatggcaccgtccattctttccccaaaaaaaaactcacattttttcttaacaaattgacccaaaatcgcaaaaatgttgtcatgtttggtgaaaatctgttaacaaatcacaatcgaattttcaaaatttttcccggcggcgcctaaagtcaccgccggacaccccccccctcc

SEQ ID NO: 40392 - DNA, 1408 bp, Heterodera glycines
aattttttaaaatgtactaacttagaaattttaaaatcttgcagtttttctcatagagaaattagaagaaaaaaaattcgaaaattttatgttgttttttttcaaaaaaattatcgaagctgaaaaattgttcgaatttttcctataaaaataactttctagcagatttcttcacgaaaaatttctaaattagtataaaaaaaatttgttttttttcattttctcggaggaaacgagctgcttgctccgcacagagattgccaattaacgccatttctgtgtgctgccccaacgaccaaccaaatattcgttgtttacgcggtcgccaatgaacgtgcgcagcgtgtgcagtgcttggtttgtgttcagcgattgcatgtggcaatggtaggcgcgagtggcgagtgccaactgtcgcttcagctcaatgtcttctgactaaaaagtgacaaatttgcataaaaatataatatttgaatataaaagaaaagcttcagcaaattttatggaaaactcactaataaaaatttgattaattaatggtcttattaaatgcacatttactgattcttcgaatgatttcccttacctcaaaggtcatctccgctaaatcgtgcgccatcgtttgttcagcgttttccgcccatggatgggaaatgaaaaaaaacaacaacaatgtttaatgtgcaaattgtgaaagaagcaacacatggcttctaattaacattttattgatacaatttttcatattaattaattagtgattaattaatgatttaatttggcatttttgtttgtttatttaccatccatgcgcagctttgaagacgcgttgcgtgaatttgcacaagttccacacgcggttacagaaattgcgcgcctcagtgagcggcaatgtgaaatccacgcgtatcaccgccttggtcaggtcgtgctgaagcagtgagaaacggaacgcgtccaccccattgtgacgcattccgcgcggaaagcgtttgcgcaagtccgcctcagcaaccgctttaaataggaatagagaccaaacaattaatttgaaaatgctattgggagagggtacgccccaaaaggtcgtcgccgaaaaaacttcgccgggttatatataacgtcaacgcaaaaaaaaaaaaaaattgttttaacttttttttgttgttgaaattggtgtttgtgtgccttaattcaatcccacctttctcttcagatggtaaattggaggagttgatccgctcgaccatctcttcaatgccggtccctctgataatgtcgagtgggtcgaccacctaacaaataacaatccattagcaatgaataaagagcaagctttccctcccccctcctcacattgcccaacgatttgctcatctttctttcccggttgtccctgaccatt

SEQ ID NO: 40393 - DNA, 1280 bp, Heterodera glycines
aattggatgaggactacgacggcgcgccggtgaatcgcgaaatggcggctcgtaaggaacccattcatggcgctgccgccggtaatgagcaatgttcatctctcccacgccggatttgggggcagagtccgcccccccccccgttctcctccgtcgcattcttccattcccaacaacgacaccattcacttcttctcatcgggccaaagggccgtcccactggatcaatggaaacgccactcaaagggggcggttgcgttcggtgattgtggtaccgaacgccgccggcaacgggcaaaagctcggggaaacgtcagccagaacggccgggccgccggccaactcaggggaacgttcccctcgtccatcaaccagcagttcttcggcccaaccgccgaagagcccggcaacaacagcaccagagctgcgagcgagaccgacggagcaattggcaaaagtggcggagctgcttgggcaggtcggcgaggaaatggccaaaatcctggaggccgaggagaagagcacggacgggaaggaagaccttctttccctcccttcggacggggaggaggtggtgccggaaacgccgccgccgcccgccgcaatgtcgcgaaaccgcgacgagagttggggtgaaggatcgggtcaattgtcctttacccggggctcgggcgggcactacaatgcccgtaaaatcgatgaggaggaggagaaccgatgggccaccccaggcgcatggtttactgcacccccacgagtctcgggcccgaagaagaagaagccgtggtaccattgatgatcgggaacattcccgttggtcggtcggtcggagcagaagatcggagagatcacgaaacccccgccaatctggcttttcccttccttttcgtccccttctttttttctccctattattaaatcatcattttccatttcatttctcattatccaatttgtctaccatttcacatctgcattttctccatcttttcttcgccccatttgcatttttcacattcattcacattttcaaattccttttgttcggcccgattgggcatccttttctcaaaatgtttaccattatctttttgcccgccatcccctcttttcatccattttctgtactctgattccccccaacatattcagcgatgcctttttccctttgtctctcaaaaatgcccacttttctccttattcacgtgtttttacatattctgctcgggggctatttaaacagggcgcccccctcctttttttttcctctccttctcttt

SEQ ID NO: 40394 - DNA, 572 bp, Heterodera glycines
ttagtcttccctcaacaaatggtcactaatttctttgcccatttttgcctgaaattggaaatgtccaaaaaacgaatccctgccgaattgctttttgaaatttgccattacctcccttttcgccttcgatgggccaccgaccgcgtggcattggcatttgaccatttcgttttaaaaattcaatgtgtttggatgaagacagaatttgagcgccaaataaaaattgcacagaaagtacggattagtgattatgcccgaggggtatttaaaaaatgccattaaatttcagaaacatttgctgacaaaagccaagagggaattgtcaaaagtgaccaagaaattgttggatgacgaattaacgctcatatttgatcgcattgaatttgaatttcgattcgatttcgaattcgatgttgatgggaaggattcgcgcgacataagatttctagtcgatttggacttcggtgttgcggagatggaattgcgcggcatgacatccctcgaaatattcaacaaaaaaacggaaaaagtacttgccgaacgtgtcgattacgacgacccaaattccattg

SEQ ID NO: 40395 - DNA, 997 bp, Heterodera glycines
  misc_feature (907)..(907): n is a, c, g, or t
aacttggcagtttttaagaaacgcccatggtggcactttttaagaaacgacctagcaccattagcgggtaggatgaatgttttgctttagaggaatcttttttttttgatagcattgctttgttggtgccaattttggcttgttgtataaactattttaaagatctttttgagttatttttgctatttataaggttaggaaaaaattgccggaatttgttgaaactcgacttttactaacatttttttccttaatcagtgagctaaattagttgcctaaaatgtgcatgaaaaaatcattgaacttcaaaattttgtaaattgcaatatgattttttataaattttttaaaatgttgaccatttatattcaaagtaaaaaattacgagtgcggcttcgcatcttaatctgcgatcttttaaacttttattataaaattttcaatgagaaactcgggaaatttttgttctaatgtctaaaccccgaaccaaattttaattgggctccattataaacaattttggcgcaatttaaatataggctgaggcataaaaggatgagaaagatgcaaattaatggcacgttgactaattctaaattcctaatcgatctttaacaaaaaaccgaaatttggacaatttgaattttcgagtttttctcgagttcgggattggaattggtcaaaagtgatgaacgatcccgaaaaccctaagagcaagtttcacgatttcatgtcaatgtaaaagttaccaaaacatgcaatcaacgtcgttttttaaaaattcgagaaggaaagcaaaggagttataagtattttgacgctttaaaaaaatttcgaagaaattaaaaattcttgaatttatcggatgtgttgagtttttttatgatccgtcatatgtttaaaaccnaataatttactttaattgctgcctcaaggattttgccatcgcagaaattgaaggtgaaaattcgttgacataatttgcgcccaattaccc

SEQ ID NO: 40396 - DNA, 1048 bp, Heterodera glycines
gattgatcattagtaggatatccaaatctattttttacttaatttaatttgtttattatattaaataatgatgcaatatttaaaaattgggattgatcattagtaggattatccaaatctattttttacttaatataatttgtttattatattaaattatgtggaaatatttacaaaattgggattgatcattagtaggattatccaaatctattttttacttaatataatttgtttattatattaaataatgatgcaatatttaaaaattgggattgatcattagtaggattatccaaatctattttttacttaatataatttgtttattatattaaataatgatgcaatatttaaaaattgggattgatcataagtaggattatccatatctattttttacttaatataatttgtttattatattaaataatgatgcaatatttaaaaattgggattgatcattagtaggattatccaaatctattttttacttaatataatttgtttattatattaaataatgatgcaatatttaaaaattcggattgaccataagtaggattaaccaaatctattttttacttaataaaattatatatatatattattatgtaattattatgcaattatttataatagtgattgatcatcaacaaccctaaatgttttggttttaatttgtcatctgtcactttgacccccccccctacctttggtcaactatcgcatcaaattaacgatgacaagccaagctcccggaagagggtttaaatattaagaaaataagccggcatttgattccaagtgaggttctctctgattttaatatcaaaatgataaaaagtcaggacaaatcgtaaaaatcaggaccttttctatttttgagattgcccacctccaactcaggattgaactgaaattttcaaaaatgctaaaactaatatttttcaaaaaactggaaaatatggttctttctcaaataccaattaaatgaaaagaaaaagaaagaaataatcagaaaaacaatggaattaaatgattttaa

SEQ ID NO: 40397 - DNA, 1595 bp, Heterodera glycines
ctattcccggtttttaacatataattatttgtcaatgcttttccttcaataaattcctctctcttaaaatggtaatttgaaatggcttgaagccttaaacccggggacacaacagcagtgacgtgggtaaaatattttaaaggtgttctccgaaatcgacatcaaagtcgctgacccggtggtgtccttctgcgaaactgtcgtcgaaacttcgtccctgaaatgttttgctcaaacacccaaccaaaagttttactacaaattattccaaaaatacaaaaattcttttaggaacaaaataacgatgattgccgaacccctcgagaagggattggcggaggatatcgaaggcgaaattgtgaagatcagttggaataggtcggtttacagaaatgtttgctttcatataagattgaatataataaacacattaaatgattagctagagttttaaaaagttagtcaccgcttgggaaaagttaaattcttgcgcaaattaacgtttattatttgctatgctaacactaaaaatgtttaatgagttatggccttattttatgcctccgctggggaaaaaatctttcatttcgttggatttcccttcagaaaacaacttggtgactttttccaaaccaaatacgaatgggatttgctcgctgcgcgttccatttgggcatttggtcccgagacaaatggtccgaacatttttctggacgacactcttccgtcagaggtggacaaagagttgctgaagacagttcgcgagtccgtcatccaaggctttcaatgggccaccagagaagggcccctctgtgaagaacgttcgtccttcgctaattttaaggctatcaaaacaaatttcgcttgcttcagcgattcgcaatgtcaagttcaaaatgttggatgctcagatagccaaggagccgctctacagaggcgggggacaaattatcccaacttcccgccgttgcgcatattccgcctttttggtgagttctttccccatgcaattttcgtttctgatttttctttcgatcagatggcaacgcctcgtctgatggagccgtattatttcgtggaagtgatcgcccccgccgattgtgtgacagccatttacactgtgctgtcaaaacgacgtggtcacgtcacgaccgatgcgccgatccccggctcaccgctgtacacaatcaaagcgttcattccggtgatcgattcgttcggtttcgagacggacttgcggacgcacacccaaggacaggcattttgcatgtgtgtgttcagccattggcaggtaattaattgccctggaattctctgatgacttgccatcattgcctttttcagattgtgcccggtgatccgctcgacaaaagcattgccattcgtccactcgaattgcaaccggccccccatttggcacgcgagtttatgatcaaaacaaggcgaagaaagggcctctccgaggacgtctctgtgaacaaattcttcgatgacccaatgttggtcgaactcgcgaagcagcaagacttattcagtgggttcggcgtatgatttacgagcgatggatctctccgccattttaattgtttatttgg

SEQ ID NO: 40398 - DNA, 1031 bp, Heterodera glycines
gtcccttaaatgaccgccaatttcattaccgaccaaaaagttttggcaaagtgtccacgggatgaggtcaccggccgcccgcttttcgccttcgtctcgcacatttgtcacactttgtttgaagagttgcttcatttcctcaccctccgggtacatgtccaagagcaagtatttcctgggctaatgtcccttctcgttttgagccaaactcaacccccgagggtgagtgggattggaggaaaagtggtagagaaggttgcgcaactcataaatgcggattgagtaagatgatacaaaatagtcgagggcatcaggggggattttgagtagggagaaggtgaaaatgatactttcgcttttccgacgatttggcacttcggttttttcagaagtggaggaaaagcgggaaaactgttgctttttttaaattgggctggggagtatgggtacttccgaggtttgctaccccttttttctaataattttttctaggctttcagcacaacgtgttttacgtgagttaaatcatatacattgtttaatttataagccttttccttggtgcttaccgtaatccataccaataaccatggtatgtttggcaggattttgatatttttgaataaaagtttgttattttacacccctaaatttcaaacattttagcaactgttttccctttttacatcttttcagatatcagccaaaataggctttgatggccacttttccccgttgtgcccctcctccagcccacttttctgcccgtttgcacaaaaatattggattttcccaatttttttttattaaagtcacacataaaattaaaatgctaatagattgttggcaaaatgaacattgttaataattaatagagctcgcattttggggcatatgccttttttctgcgcactagcttttttggcattttgccgttttggtgcctttttttttgcgttttgccggaaaattccattaaatttcaataaaaaggggaaaatacacccctaagaatttaaaaattttctcaa

SEQ ID NO: 40399 - DNA, 683 bp, Heterodera glycines
tttttgttttttttctcaagaaaaatttttcaaaaattctcaaaatattttaaaaaatgaaaatatgtacgaaaaaaagtttaaatacattattattaagcaatatttattgtttaattaataataaatacttttaggtatttttacgttattttattaattaaaaaggttttttattaaaaaaaaattaaaaaatacaggtacaggcctggatccaggcctcgaggctttttacaaaataccgacctctactaaactccccacctgaattaatggttggattgacacgcggacaggggcctttggtgtcacaatgtgaatccttacatggaaaataaatgaaataaaacgactcaaaagccaagaaaatgcctaccgcattaattgtgcggtcattctcggttcctttttgcacggacatggcatccaaattgccaagtcattgtccatcaacggtgccgcatcggtttttagtgtcccggacattcgccgatgtcggagcacttttcccggctccacaaccataaaacgatgtccccgtgggcattcgtaatcaaaaccaatgaaaagctaaaatatgaaagaaaaactacttataaatctgaatgggtgcacaatgccttgactttctccttgctcgtcataattgcagcgcgttcaaattcccgtgctgctgctgctgc

SEQ ID NO: 40400 - DNA, 793 bp, Heterodera glycines
tcatcttccgtgcgtacaagaagaccaagcagcagaagtccgcttcattcatcaccagcagttcaagccaagccgaagaaagccgtgtcggtccgtgaaggcaaatgacagaaagtgccgccccaatgatggacgataatgaagatagagaatatgcttgtttttatgatataaatatatatttgtggaataatcattatattgtctgtctgtgctgttgtatatttatatgcgtattggttgtaaatattgtatttgttgccgcatactgtaatttgctctaaatgtactgtcgataatattattaaaagaaaattggcactttcctccttttattctctggctcattacattctttttataggatccacccaaagagatgaaagggggcgtccctttttgattttttttttttgcaataaaattttatgcctaaaaatgagtaacccatgtatccagcagggatcttggggtcgtcacgaataatttgggattatgacataaatttagaacaaaacttgaatttttgtttgaattcgggtaccgaattatgaattggcataaataaacatcacattcatgattgatctgcaccctcggaaaccccggatttgtttttttatggatttttaaacaaaaaacttttatcaaaaatcaaagtgttaatcgcccccccccccctagtttttcggcctatgctacagtatatatggcaaattaatttattcaaaagctgtcgcattttccaagtccaaattcaaaacaacaaaaaaaggatggaaaaaaccgatgg

SEQ ID NO: 40401 - DNA, 278 bp, Heterodera glycines
caggtgtttgatgataaccagagaaaaagagggaagagatatagtacgggtgtagaagagggtgtcaaacaaaacatctgccaccccgcacatctgcctccatgccctactaccaattaattaattagtaccaattagtcatcactaattaccacccaacccccatctgtcggcaggttcaaagggctgcacccctcccataggcttgggtttgaccaattagcacccccaattacaccacctgtcacttctaattagcgtcaacctccaacggtccc

SEQ ID NO: 40402 - DNA, 1400 bp, Heterodera glycines
  misc_feature (44)..(44): n is a, c, g, or t
tgttgacgaattgagcgaaaaagagcccgaaaagctcgcagaanattttggaggcaaaattggacaaagaggtggtcgtcaaagtgcaaatcaaggtcggttgagtgtgtgccgctaaatttgtttttaaactttgtgtttaatcaggagtccaaaggccatttcgaaggccaggatttcgattggataatcatgtccatgtgcgcggacaacaaagatgtcgaaaaagaggaagaagagaaggccaagaaaaaggtggagaaagaggatggagaactgaaggaagagtcggaggatgacgatggagatgaaattcagctggttggggagacgaaatcgaccagcaccgaggccgtgaaaaaggcaaaaaagaattgacaagagtgctgagtaatgatgaacctatcttaaatgatattgatgttgcatttagcatagaaaaaaacaattgttaaagaaatgtttgcacttgtaacagcctacaaaaaaaaaggcatagagaaattgccaaattatttgaaacactctgaaaaaaatttttgtttttcaccttaaataacagcacaatgaaaaggcgctgggactttcgttcaatgagcttttttgagcagcccagcccacctgaacagtcgtcggctttgtcaacaccacaacagcaactaacagatgacgataatgatgatgaacaccagcagggcgagggacgcgggactagagcggaaggcggcagccaatcgaccggaaacgacctttttcaacaggtctcacactcagtgcacagactggagcgcttttcggtgtcacgacacatcacagagtttgtgctgaatgccaacgttgaggaaccggacgaagtcttgcgcggtgcattccaaatccttatggaacgggcaatccaaaatgcaaagcagaaaagtggccggaaagttctcaaaattggtgttacgctacagggaagaggtttgattggtcggctggtagcccttttattccttatctattaaataggcttacatgacccaatcgtattgccgcttcgaccgccagaacaaaacagctgtgacacgctgatggctgagctggacaagcttggccaaagtgatggtgaagacggaggagttggtgttggagagaatagtggtgaatcgctcgacaaacgatcattgctactcagcgaaccggtgcaaatcactttgacctgtttaactccacctaccggggcgggacgaccgcgcttctacccatatcaacattggggctacaatgaggcgcatcgcataaggatcagagattgggaagacaattattgtatgttccacgcgcttattggtgctcgagcgtaccacgaccctgtgctgttcaacgagtggatgttagctgatcaacagccacaacagcag

SEQ ID NO: 40403 - DNA, 882 bp, Heterodera glycines
cttttcgtgaaaaaaacttttaaaatatataataatttcttttacaattgaaaatttttgtgtgttttgctacctaaaccgtgttagaaaaaatttttatttgcctatttgaggatttttgtgtctatttagtgcctattttgcgatttttgtgcctaaaaatggagtccctaacaatgagtcatgttctttacaataccattggttaatgttcatcaaatataacttttatatgaaagtccaaagcattccaaaaagaatttatggaaaaaggatgataaataggtctcgctacgaaaaatctttttcggtggtggacacccgttccacaacgtaaaggggtccagctggctttgccatttttgggtcacattttcaaaaaataatagtttaccaaaggtttttccggatgcgcctaatggcaccgccggattccattgtacaattattattttttgaaaatttgaccctggcataaattttttaatttttggcgcaaaactgctacaaattcctggtccagtgatgaaaatcttgcaaaaaattgagaaaacattttttggcccaaagagcaaaaaagtttaaggtttcctcctccgaaatttcttctggctacgggtctgtggcaggccaaaatatactcattctgacttacaatcttgaaaataatggttctttcaaatttgaaaactttaattaattctttttttgtctgcttgcagccgaaacgactccgtcccaaaaccccctatcccggaaaattgacattgctaattttaaatgcttgtcagagatttccacgacagtaaacccacctcagccaattgtttctgcggtgcttctcttttctcatcattattttgagctttgtaggaaatgttg

SEQ ID NO: 40404 - DNA, 996 bp, Heterodera glycines
tcatttcacttcccaattgctccttctcgagttcttttttttcattctctccccctttttgtgccgagtcgacgcctttgcgcttaaagttcgtctccaaaagggccaattgtgcgcgtcagtttttcttttttcttttggcaatttgccatactttgggtttcagtgccaattttattttgtcgtttttggcactgattttccctcttcttctgatgccattcttctccttcctcttctccagggatgacgtgttggaagtgctcgactttctcttccgccaccctttccgcctgtctctcttcttggccaatgtcatttaccgcgtcggctccgttttcagttgcgtccaatttatgacgtcatgcgacgctttgctaaaaagcgcggaggaaagcggcgatgaattgtcactggctcaatcggtgggcgattttacgtaatcagcagactttctgtttgatcaccccctccatcggtccgtttgcccccccccccctaatccatccattccacgatcatttccaatttttgtttgatccggttccttcctctccctaccatttgtcgattaaatttacttttttgatcaccttcggtcatttgccctcccccactttaattttgtttggtccatttcaattttagtcctatcaatttttgtgcttttgttcagcttttggtactgatttgcctcgtccttttgttttacctccatctgacgacaattctcaacattttttatgtttttgatcaccttcaatatgctcttttaagctttctttggtttctatttacggtaaatattgttaagggtcgaataatttcaaataaaagagaaattaattaattaaaaagatatttggtaattaagaacgaccgtaagggccggagaatattcgcctttctcaaattggacggcatcactttgctcagagtgattggatttgacgaattgctacaaactgacaatgagcatgtgaaaataaagcgaaa

SEQ ID NO: 40405 - DNA, 847 bp, Heterodera glycines
gtattttttgtgttagaatttgaggacgctttcataagttaagtcccgtattttttttagtttttgtgcatttttgtcaattgtgacaacccaaaattagtgtaaaaattatttaaaattaaatcttttattaatatttaaatttattttgcatcttggccctaataatattaattttttaattattagaatgtgaaattttcggctgcaattattgattttttgccgatcaagtcaatcgacttgggcggccaatccaaaaggtttaggctttgtccaaaccaattttgggcggatgttgtgacttgctggggtaaaacctttgggctattttttggtgcggttaaaaaagtacagaaaaaaggatgatacccttcactatttatctttatttatttattttttataatttcattacaattctcttcaaattccatactatttcttccataatatttttgttgaaaaatagtaataaaatttaaacgatttgattcgaaatttcagcgatcaaaatttcagcgattatatttttcggcgtttttttggcgggggcgagaggaaaatgttgctaaagcaatgtctccaagcagctgatcaccgattggaacggggaaggggcagcattgtaggtacaaaaaatggtcatttatttgatcgccaatttttggaggggcggggggggggggcgagagcaatgctgcaaaagcaaatggtcacaaagcagctgatcaccgattggaacggagaagggcggaattgctaaaaaatgttccttaatttgtttcgtaaattctatttattagatttttcggcgttttttggcctgaggctctttgcagcaaat

SEQ ID NO: 40406 - DNA, 738 bp, Heterodera glycines
ccaaaaaatttcggaaatcggaattccgaccccaaaaacgtcggaaatcgaaaatcggaagtcggaaaatttcaaaaaacataaaatataataaaaattttctaaatattttaataggttaaattttttaattcttaactattaaaaggtgattttaaaaatgtttatggtatattcgcatgaaaaaattaatcaaagaatttcataaaaaccttttcatgtcattttacattgtttttttgtggcgcgcttttttcaaagaactttggtgaacaggggggggggggcagacgtccggcggtgacgataggcgccgccgggaaaattctgtaatttttaatacgatttgttaagaaattttgtccaaatgaataaatttagcgattttgagcaaatttttcaagaaattaaagtttttagagtacagcggtgccgataggtgccgccggaaaaatttttgaaaatttcagtgcaatttattaacagaaattgtacaaaaatttagtaattttttgaaaaaaaaaattcaaaaaaaatttccgaaaatttccgactttttatcaaaaatttcggaaatcggaattccgacgaccaaaattttttcggaaatcggaattccgaccccaaaaatgtcgaaaatcggaattccgtgccatccctgatgtgtatattggaggaattttcgcagcagcagtgacaaaacattttgaaaggctccaccaacccatctaatatccc

SEQ ID NO: 40407 - DNA, 947 bp, Heterodera glycines
ttgcagattatcagattgcaccggctgacggcattaacgggtctcatgaaacgagaaaggccaaatacattcgtcaagaccaaaacttggaagcacttgtgcaggattttttcaatcgtgatccgatccaatttcttcgcgcttgcgcttatcatctgcacttttaaacatttataggattttagcattgtcgttttacacaattttgtcgttattttcgatatcaatttgaagttttcaaatgttagaattggcaaagttaaaattttgttcattgtcgaaatcggtcactgtcgtaatcagccactgtcggaaatgtcggaaaacagtaaaataaatgaaaatagttcactgtcgaaatcggtcactgtcgaaatcagccactgtcgaaatccactgtcgaaatcggtcactgtcgaaatcagccactgtcgaaatgttacagcaccttatggaaagatattatggaacttttggttccatctcagttgtcaacgccgcgactgcatcgttattatatcagtcgatagaattttcgaatcgcttttaaatagtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaacacgattttggtagaattgcgccagaatttaaaaatacagtttgctatggcttcgcatcacc

SEQ ID NO: 40408 - DNA, 1418 bp, Heterodera glycines
atgtggactaaaaacccataataattttttaaaaattcaaaaaaaaatctccaaccaattcgattaatttgaatcacttcacagcctaggtagcgaagctccgaaagcgcgaagcgctttttcccagctaaatagccgacggttcacgcacccgctagttaatatatacgttatattgacaaggagtttcgtttgcaaaaacaaaatctcccggccgaaggccgggagcgccctgaaaatagtggaagggtcttacaactttttgaggcgcatctgggaaaactatagaaaaaaattcagcgcggacgactgagtcccggggaccgatttctcactttttcttgcgtttgaaggcccctaactttttttctaaaacccgaatcaaaaaatgtctgctgtgagggggctaagttgaagtgttttttaaaaaacaaaaaaaattccaagcctctatctgcaattggaaaggctgtaggttcgtggactttttcagtaccaactttgtccagttcagtcccggttgaataactcattagggtttgatctgggcggggagttaccagcagacttattgtagagttttgaaagcccgatttttccaaatttaaaaaattcgaaaattttcaaaatttttcgagttaggcctaaaaaacggttttcgggttttttaattttatgattttttaacgaattttcccagaaaaacggagaccacttccaaaacatagtttttcaagctctatcgactggtatttttttcggaaaaatttcgattttttcccggaaatagaaaaaaattttggcctgagcgggacatttgagtcccgggctcataactcgttaggggttggttttagccaaaaatggcctaagagcaaaattgtagagctttttaagctctatcggatgatgtgcaacatgttcggaaattttcaaaaattttcgagctaggccccctagaaattttcgaaaattttttttgggttgaaaattggggtcaaaaatatttttctggggtattttgatgtgctgagcacgaatatgaagttcatttttcgtttcagaatttttggaattttttaaaaattctttattttttggcaattttttggccctcgggattttggcctaatatttgaaaattcataactaacctcagggtaagtcaattttcatacaacaaagctttaaaaatagcaaaaaatcaggagaattttatggcttttatttagattctctatcatgaatataaaaaaagttattccagaagttctggaaaaattcgaattttcagaaaaaaattctgaacacggttctgaaaagttattttggaaaagtaaaataatacaaaaatccgcaattttttgctctattttataaattttattttagctttttatcactttttgaaaaaagtt

SEQ ID NO: 40409 - DNA, 81 bp, Heterodera glycines
cgcgcgttgccgatgcggcgcgcggctacgcgctgtcgatgaccctggtcgggctgcgcctgcaggaactggaaatgggtg

SEQ ID NO: 40410 - DNA, 416 bp, Heterodera glycines
acaacttcaacaggacaagtggggcaattgacaaataaatttgcacctaaatgcttgtccatttcatagactaggaacactttggcctttcacacttacaattaacgcgtcattagtattcttgacattaatttgattcctcattttcggaactgtgatttttcctgtccattcagagaagaaagagcgaaacgaaccaccggagggacagtccaagcggaacctgagagcaaagcgcccgaaatggtggagccaattagggccccgatgaataggttcgtcgttttctgattgaagttcgagtcgtcatttttcttagatggttatctgttttatccctctttcagtgaacagtgtcgtatccaatgcaaatttcctgatggcagcactttgaccgatgttttcccgtccgattc

SEQ ID NO: 40411 - DNA, 497 bp, Heterodera glycines
  misc_feature (69)..(69): n is a, c, g, or t
  misc_feature (76)..(76): n is a, c, g, or t
cctccgtcctctcagcaggttcttctgatgagtgctctcctttcaaacggacgaattttatttgaaagngaacggncattgactttcgacgccttttagaatcagcctttggtcctccccgtctcttccgtccccactttccaattcgtccaacaacacatgttcccgtccatgtctcagcagcagcctctcatgcccattcgtcttcagccttcgtccatgcttcaccatcagattaaccagcaagcggagcattcgcagcaggacgggacagtcagcgactctcccgacagcggacatgtgagaaaaacggggggggggggggggagaaaaaacaatgaattatttttgaaaacgttttcagcgattttttcgaaatcatgatgaactaataagttttttcaaaaaaaatttttcaagaaattttcttactaatatcctaggaatttttttggtgaaaatttctaggtttgaaaaaattttaaaattttccgggg

SEQ ID NO: 40412 - DNA, 1212 bp, Heterodera glycines
  misc_feature (69)..(69): n is a, c, g, or t
ttatttttatggtggagggaaatgacgtcaatattgaccatatacattcattcaactgacccgcccagncgagaaaatacttggagcaaccatcagctgcagtaaaaagaccaagaatggccttcactcgaaacagtccctttttgttcggtcctgtcttctttggtctctgacgcgccgtcgatttgacaaacattcctgtgcccgttgatttgttgctgttttttcgtcgtcttttttgcgcttctttagtctgggacagttcctcaaatagaattttttaatttacaagtgtgtgtgtgtgtgtgtgaaatgattattgacaaattttaaaagattaaaaaaaaaggaaccaagcgaaattggtataaaaaaatttttttttggttttccgtttacccgacagcttgttgaccccgtcccccgttgtccaaatattttttttacaggcacggttgatgatgccaaagtgccaccgctgcccccgtcgctttcatttccattgttcgtcgggtccttttgttaaattaaattaaattaattaatgtttggtaagcccaaaaccacccattaccatcattttaactgccgcccgctttcccaattgtttttttggtgccaaagtgtcgcctccgttgcctccatcgctttcttcttcattgttctggtcctgtttatgttaaattaaattgataccgtttggcaaacccaaaaccacccattaccatcattttaaatgctgaccgcttttccagttgtttttttggtgccaaagtgtcgcctccgttgcctccgtcgctttcttctccattgttcgggcccagttgctgttaaattaaattgaggcgcttgtcaagcccaaaaccatccattaccatcattttggctgccgcccgcttttccagttgtttttttccaggcgcggttgatgatgacaaagtgccgccgctgccatcctcagtttccgattccttttgaatttaacaatttttaattgtactttgcaaaccccccccccccctcctcaccgtcattttggccgcacgttttccagaccgcaaaaaccaaagccattttaaaaacaattacgaaatggctaaaaaaatgtagcgaatttaaatgagcaaatgaaattcggaacattttttccaatggaatgacccccccgcccccctcacatttttccaacataaaaatggcgtccttttctcc

SEQ ID NO: 40413 - DNA, 151 bp, Heterodera glycines
ctttctcgcgcaggtgctccattgctggcgtgtgaagtggttccttcacaggaggaaaccctggcgcaaactgcgcactggattacagaacggcgggccaaccattttgccgggctggcactggctgtttcgggtttcgagaacgagcatc

SEQ ID NO: 40414 - DNA, 941 bp, Heterodera glycines
ctattattccgaaatgtggttggaattcatttgagtgttgagcagaaaaagagatagacgttttttcaaaattttcagagccaaactcgcccagaaagaaaatccataaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatgtgagtgttgaccagaaaaagagatagacgttttttcaaaattttcagagccaaactcgcccagaaagaaaatccagaaaaattagggtcgtcgctattattccgaaaatgtggttggagttcatttgagcgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccataaaaattagggtcgtcgctattattccgaaaatgtggttggagttcatttgagtgttgagcagaaaaagagatagacgttttttcaaaattttcagagccaaactcgcccagaaagaaatccagaaaaatagggtcgtcgctattattccgaaatgtggttggagttcatgtgagtgttgagcagaaaaagagatagacgttttttcaa

SEQ ID NO: 40415 - DNA, 1048 bp, Heterodera glycines
  misc_feature (17)..(17): n is a, c, g, or t
tagtaaagcaaaaggcntcgggatggttggaggaaaattgctattggtattggatgatctaatgattggaattggccaaaattttttggacacaattttcacacgaggctcacacaattggggggtcagcgttgtgttggtgactcagcacatgttcacgaaggagttgcgtatcgccaggaataattcgcactacctagtgttaatgcgtaatccagcaggagctttacaggtacgtaccttagccacccaattattccctggacgtgctgagcattttatggaggcatacagggacgcgactgggaaacagtttggctatcttgttgttgatatgcatccagaaagtgaggatttgttacgactgaaaaccaatatatacggagaaaatatgggcggagcatccacaatttatatggcaaaatgagaaagggcagcagcagcagctcaaataacagtggcgttcctatacaaataggcccgctaatacacaaaaatattgattttctaagcaaatttaacgcaaaatcacgtgcttttcagacacaacgacgaatgttacagggggcgacaaacgaacaattattatgttttgttgagatatgtctgaacatattgaaaggaaaacttccaataaggcgaaagtcgcatttgcgtaaattgggcgcaataaagcattggttaagaggtctgtcacgcactagatgcgcgaaaagcgcaagaagaatattgttaaatgctccgtcacaagtcgggtctggagctcctgctattgcgggactattagcaagtattttggtgccaatgttaatagaaaacataataaataaataaacgattaattgaaataagaatgagtaattaataataataataataataataatgcggcacacaatgcgtatgttcctcgtccctgaggatttgtttaattcagtgataaattctttcacggcaccggcagatggaacagcacttggtcttgtcccgcagcgtctgcaccaaattgagcgaaacagaaatatggatgagaatgaacgcttagcga

SEQ ID NO: 40416 - DNA, 903 bp, Heterodera glycines
  misc_feature (887)..(887): n is a, c, g, or t
ttttactgttttcaacaggcgggttgtttaaaaaatttgttattgatgctcgaaatctgtgaattttgatttataaagtattttatcaattaatttattattcactttttcaagttggtgatttctatttcgaaataaaagatgcccgaagcacagttcgggatcgaatagttagcgaacacagagcaatatgctaaacaaacaataaaactcatcattaattaattaattgataattaatgcaattaaaaatgtcttgaatagtttaccttttccatttccaatgtaatggatcgtcaagcatttgtcgtcaacgattttgaggtcactgtgacacgaattggcatcccaacagaattgttgagggattgaaaacttctgaaattaataatatatattattaattttcaatgagaattcttttacttcacaaattttcacacgatatgtcggatgattagcgtttaacagctctaaaatttggggttccataagagagtaatcccgaattgtttccggaatctcggctttttggctccattccaatctcggtttttcaaaacacaatcccatctaagtttaagtttttcgaaaattcaaatcacatcctgtatctgtttttcctcgagtcagggttccaaataagcacagataaaaatggggttatgaaatttggcaacattatcaatcttatagatcattttttattttgtaaaaagcttttttaataaaaaaaaaggttcaaaagccttttttaacaaaatttaggaaaatatgcttttaggtcccaaactcaaaattgctcaaaaagggtcagaatcgatgtaaataggtcagaaatgtgtaggaaaaatagaattagggcgcgcttgccctttttcaggctngaagagtgccggaatt

SEQ ID NO: 40417 - DNA, 1193 bp, Heterodera glycines
  misc_feature (1153)..(1153): n is a, c, g, or t
aaatgctccgcttcaatgacattggcttaacaaatcaacggtctccgatgaaaaaaaatattgctgaatgtgaaaagtaagaggcaaattcagtgcctaaatgttcccaccgcttcacccgcgtcgtcctgcagaggatcgagcaattccaaaggcttcttccattcgctgtatggtccgctcagtttatgatcatgtttttcactgccaaaataatttgcacagcatttgcaccaccaaacaatttttgcgcccgatttgaccaaattttcataccttagaaataggttttattaaatttggatatatttgctgagggtaaatcaaaaatcaaaatccggcggcgtacccttttctcgcttttccatactcttcaatgggtaatgattcaattgcttcctcagctttatatggctgaaggacaccattctgatggatagttacggaaaacgcacaccgtttcctggaccgaaaaacggaacaagcaaaccacttttttgtaccgtcttcatttgaaaataaaagacagggcccttaatttatagtcatcttcaaatgtaccaaccagcaaaactaccatgtttgcattcaggcaaccttgaagatcctgagttttggtgcgtgtcaattagtctcaaatttaagcgttctcttttgcaagttttctttattataatttgattgtcagactttctaatatttctctgtcttttgcgcttctttacagaaggtgcttttttcatcttcacctgtaaatacaaaattttaaaaatgtttagaatataatccaatttttttagttcaaaagccaggttaaaaagaaaaaaacaatttgaaatggcttttagtaatttaacacgtacaaaatgccaaataaaaatattttcttcattcgattgatttacactgtttcgttagttggttgtgaaatcttaggcttaagttcacatagtcttgcttacatagacacatagttaccttcattattctttgttcatgataaggtctaaaatggtcaatcaaattcttctgcttaaccaaaaatcttttgcatcgcttctcaactggacagtcattcgatatgttccaagaggtttggttctcagagtgcagactttgtttatgcgagtgaccaacatcgtcctcatcccgngcggcgtccctcttggcgatcaacttacgcattacgtgca

SEQ ID NO: 40418 - DNA, 969 bp, Heterodera glycines
tgtagatatagctgtgcagcctatgtagctatagacgatatatctaaatttacatatgtatgtaatctcgcattttttggaaactgcgggatttgcgggagcaatcccgctgaatcccgtcccacaaaaaataaaaatttactaactataaaaaacaaagcaaaaagcaatacttgatcatttcaaaaaaaaaatttgagttccaatcccgcagcgggatccgcaaatttgaaatttcctgtctctacttggatgccaagtgcgcactcggattggggttttatgcttagacattttaactgtacttatttccaatattgtaattgaaaaccggaattttggaatatgagcttaaaaatgttgtcaatttatgggaaaaaatttaaattttttggcgctctcacgaatttttgttttttaattttaaatctgttagtagtgttttggcaaataatacaaataatgtatttttgtttagcacattgctaatgttaaacaaacgaaaaaaaaaattcttttattcctaaatgggaaaaacaatttaattttatcaaacgaagtcggtaagaaacagctttttttattgcgtttcttgtcaaaaagacatcaaggtcgaatcgatgggattttcggcaataggtctatgttgaaaatttccaattttttcctccagggcgcctatctgcgccgctggacccccaaaacccttatttttctttaaaaattggcacaaagtcgcaaacaatttcttttttgcttagactcattttttgctttaaaaaattaaatggatccaaaatgttgactacacataaagtccagaattgatactaaaacgaattatgctgaaaggaatcgacctcaaaatttccaatctttttcgagttgaaggtggtagcgagacaggtgaacatgttcaatccgtaatagccaagagccttggcagtgtctgtattttcgaagcctaaa

SEQ ID NO: 40419 - DNA, 1064 bp, Heterodera glycines
  misc_feature (1037)..(1038): n is a, c, g, or t
ttaaagctatccattgcctgccggttctcgggcacagcaaagcactaatacggtgtttgactcacttcaaaaaataattcattacccaaaagttatttacacccacatattgccaatctaatttcttgcagatttgaaagccatccattgcctgccggtctcggcacagcaaagcactaatagggtgtttgactcacttcaaaaaataattccatacccaaaagttttttacaaccacatattgccaatctaatttcttgcagatttaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattcattacccaaaagttttttacaaccacatattgccaatctaatttcttgcagatttaaagccatccattgcctgccggttctcggcacagcaaagcactaatagggtgtttgactcacttcaaaaaataattccttacacaaaagttttttacaaccacatattgccaatctaatttcttgcagatttaaagctatccattgcctgccggttctcggcacagcaaagcactaataagggtgtttgactcacttcaaaaaataattccatagccaaaagttttttacaccacatattgnncatctaatttcttgcagatttgaagc

SEQ ID NO: 40420 - DNA, 1279 bp, Heterodera glycines
ataaaaaattgcaacagaaaacatttgatgaaatatttcggagaaaaatgggaagaaaaagaagaagaaaagcgaaatgagaagaaaaaaagagaaattgcaaaatattataaaataaaagagaaaataaagcattaaggaagaacattttcaaaaaaagaatggggaaaaattgaaacaaaaattgccaaaaaattggggacaaatcgaaattagattcaaaaatggattaaggaattgggcttgaataagcaaaaaagttttgaggatttagttgcgatttattaaaaattttatgcgaaaaatgactaaattttaagtgttttggatgaaaaaataatcttcgaaatatttgtgaattaataattaggtcaagcatttatcattgaaaaatataaaatttgttgattttaagctttacgatttttcgattgaaacaccgtagaatttgaatttcaattaattgaagatttattaaatcattattttaccaaatgacaattatttttgtcaataggaataaaattattaattaaattttttatttttgcttctttgcaattaagtaagattttctttttttccattaaatcaatagagttgtgcttttctgactgtttttaatcagaaaaaatacaaaatattttactttacggaagtcagaagaaaatttccatgttttatagtttgttttaatatgaaattgtttttttttgtggcattttacttcatgtataaataaatgatcataaataagaaaaagttaataattttgcaatttctttaaaaaattcgatttgagaatattgaagaaaatgaaattttcattttattagttttaattatatttttgatcgtccaaattaatcaaatgggaacagtgaagaaaaagctggaagaaaagttatttgatgaaatatttggagaaaaatgggaagaaaaagaagaagaaaagcgaaatgaactcaaaaaaagagaaataattgcaaaatattatagaataaaagaaaaaatcaagcaaaaaggaagaaaattctcaaaaaaagaatggaataaaattgaagaaaaaataacgaaaaaattggggacaaatcgaatgaaaatttataaatggatcaaggaattggggcttaatcaaaaatttaatctgtcaaaattaaaaacggatgaacaaaaattttgaaattgtacaaatattctttgaaatgacaaatgaatataaacaaaaaaggaaatattcatccaaagaatggtaccaaaattatgccgaaatttgtaa

SEQ ID NO: 40421 - DNA, 1401 bp, Heterodera glycines
  misc_feature (26)..(26): n is a, c, g, or t
ccgtctgagtggaaaaggacgcatcnggtgagaacgccctactgaaagaacgacggaattaggcgagacgggaaaaggaagtaagcgtttgctgacgtcgaattgtttgacgaaatcctccgacagattttccacagacaatgcacagttcacagtgtcgttgagctccgccaatttgtcgaagcaaactttggcacggttcgttcccacgtcgctttccttggcgtagaaatgcgccgacaaatctctgaacgccaacgcttttgtgtcgtgaagagtcaccgagcgaacaccgcctgaaaagcggcgattgtttagtcatgcaaagtaaaatcaaagaatggcggcaccaaggatcagattcttcgccacctccacgcccacggagccgaggccactgacgagaaccgacgccttgcgcaagtgttccatggcggaatgtccaagcgcataactaaacaggaaaaaccacaataagcaattatatcaaaggcatttgtcgcggcttacatctgccgagagtacaaattggtgtcgatggccgccatttgttctccgttactctttggtgcctaaacggaaaagagtcagcaagaaaatgagcaaccaatagaacaaaaagtgacgttttctgatgcctcggagttcggcagttcacagatgatttttgcctttttcgttgctggttcctcaataataaggtcagatgactgcataaaccactggaaatggaaaaaacgaatctaattttcagtggccaattgcatccgagcaattattgggtcaaaaatcatcaaaataactccgaatgttattcaatcaaacggctaatattcgactctaattgtaaggcaattgaccactgccaataaatgcgaataaaaattcaacggggcaaactaaaagaaagaattggaatgtgagcaaaaaccacttgattgtgttctttttattacaaaatcagtcaacgaaaaattttggctaggtaatttcattcacattctcagaaaaaccaatcataacgccaaagaatctatatttaaaacttgtatcccaaatatgtaagcaatctgtatttaactcgaacagtaaaaggctgcaaaacagtagcttcaaattaattgttaaacgctttatgcaatataaaatggtaaggaaaaacgaaaagtcgcatcattcctccgaactctcttccgactcattctcttctatcgtttcgcccgcttcttcagccattggcaatgtttttgcctccacttcttcagcaccttcgtcgttttggtcgtccagttcattttcgtcgcctttcttcgcttttgtcgcatcacgggccctcattttggcaagaatttctgaatttatttcccattctttttcatgcgctaatcaaagaaaaaaaaa

SEQ ID NO: 40422 - DNA, 1012 bp, Heterodera glycines
  misc_feature (911)..(911): n is a, c, g, or t
  misc_feature (924)..(924): n is a, c, g, or t
  misc_feature (929)..(929): n is a, c, g, or t
ttcttaattaaataaaaatttagcaatatgaaattgaaaaatggagatatcagtttggttgtttgacctggcaatttgatcagttagtcgtcgttgttgggctgtgtttggcattcttccccgtttcgtcattttcagtccccctcttccgtcgttgtcccctccggcagtgtctctttttgctcttcctcctccgttgtccgttttctccgcttctccaaaagtgcgtttcgcgcgtctcccatttgtttgatgtgcacgtcgcccactcgcatcgtcgctaatgcattttccatctcttcctatttttatgaatttatattgctggtaatttttgttagtttcttcgatgaggcaaaagattagattttaaatttctccaaaatttgcaccgggggaagtcggcaaaatcgacattttcctgctttcgggtcgccaaaatttaaaaaaatcaacaaacaggcgcgctaattcacacaattcacattctcaagttgatccattcgacgtgcttttgtcagcaattgtttgcggaaaaagaaaaaaaaacaccgaaaagtcggaccagtcgacctctctttcatttaacactttttgggtggccaacgcagtcgccggatttttgttggtagtgagtgatccatttgtgctgcattagttgagtgatcgtcgccctttcgtccgggtcggtgaccaaacaacgtctgatcaagtccttcgctgagaataaaacaaaaaatggcaaaaaggcaagggattggcggaaggaacctgcttctgacacgcggtcccattcggggcccgaaaaattgtattggccagctcggattcggctaagcaaaacgaaagcatcattcattcattctaaagattgctttctcttgtgaaaacccaccttttcatgcccgggngaaattggaaggncatgngtggagaaaaagggtgggtaaccgcacaatctgaaaaggggcgttgaaatgagcaaaatcaagcaaaaatatttatcacaaaa

SEQ ID NO: 40423 - DNA, 1269 bp, Heterodera glycines
tgttctgatttctcagattcctcctgaattggagaaagccatttttaaagccattaacatgtactgatttttcagatttgtcatgaattgaaatggtgatttggaaataagaaaaaagtaataaatgacaataaaataaaatatttgtataatataacaaatacctaatttttcttaaccattcggggaacggacttttattgaattagatcaagttataaacatataaaaacttttaaaatcttaaaggaattaggtccagtatgctgaaatcattatgggaatttaaaaaattaagctttttaatgctatgtatttgtaaatgtgttttgaattaattaaattttctttttttctcatcaattttcttttaaattcacaattttctactgctaaagaattctggtccccgtttcttgggaaattttagtcttgagagggggggggggaagtctgggcaccatattaaagagttaaaaaataattaaatgtataaaaaatgtaatcgtttaatttaaaagcatagtaaattttaatcaagttcggaaaccgaaagttttttaaacaaattatccattcaattaaccatgcttattttaactcattacaattctttagatttcaatgtcatacctatctatttattggtaacatttcaaggctcagactgttaaagaagacgattattttatatgtttaaatagaattagaagagtcttgactttttctggcccatttaagtcgggtattcgggcctaaacccaaaaagaaaactaaatacgttaaacccttcatttaaacagcgtaaaaatgaataaataataagaagagaacgaaaaaaggcaccaaaaatcgggaaaaaggcacaataatattcaccaaaaattgcaaaaaaggcatgaaggcacttaaaattttttattaagcttttttagtgtgcaaaacacgtaaactgaaacaaaactccataccaacaaagattagaacaccttcaactaccaacacttgaaagcaggagaaagctttctgatctgttcatggctcttaaaataatttatggccgaacagatctgaatccctttgaaatattcaaaccttctgttgaacgctttaacattcccttttatagacttaatcaaaatataaacttggcaaaaaatttataccttttgcagggcgggtaactaaaaatgggaaccaactcgataaaaggcccattgaaataaactttatagatcaattggaaataaaattaaaactttctctatt

SEQ ID NO: 40424 - DNA, 1114 bp, Heterodera glycines
  misc_feature (75)..(75): n is a, c, g, or t
ggaatttgtcatttcctgcaataaatgttttcatataaaggtttaaaaaattcgatcgggttagggacatttcancaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaactgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttagaaacgttcaacaaatgtatagataaatttttgaatattatacaattgtgcattttgctctctatcaatttattataaaaaattcacttcccttcgaaattcaaggcagaatgctcatttgaagctacgcaaatataaattaatatttgctataagaactgacaatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggattaaaaaatttgatcgggtctaggaacattcaacaaatgcatagataaattttgtgaatattatacaattggggtttttgctctctatctatttattataaaaaaactaacttcccttcgaaattgaaggcaaattggtcatctgaagctacgcaaatatagattaaaatttgcctataagacctggctattttagccaaacaaaaacaaattaatcctaaaataagaacaaaa

SEQ ID NO: 40425 - DNA, 1200 bp, Heterodera glycines
  misc_feature (19)..(19): n is a, c, g, or t
  misc_feature (1116)..(1116): n is a, c, g, or t
ttgatttccaatgatttgncatatcaaagtgaaatttcgcttaaaaagaactttctttttcttgtaattaaattaattatggtaattacagtgcagcgaattgagtgacatcactgaatttgatctcactgttaccgcctcgattataaccaaatgtgagtaaaatatcggtgaatgatttttcgttgacaataacaaattcttcaaatgtgtccatagcaatagtaattcttataatagaggaggagaatttattctttaaagactagaaaattaaatataattaagcaaaaataaacatgtatttttgtttaaaaattgactttttatagaataaagcaaaacaaaaatattacataataattgtttattaaaattatttgtgcaaatagattttattgttgccgacccatcaaacctccggatttaaggctttagattatttggaattacccctttctaggagaaggacttattataagaaaacgaatggaaaaaataaaacgcagcataaaccgtgggaatgattggatcaatattataacaaacaatctcagagcattttggatgggtcagtgaaattattattgggaagggaattgcaagggcataaaacagtggcacttacaaatgagcagaatgacccaaattgagtgggatatatattgagattttgggtacgaaagtaatggcaattctcctcaaaaaactaattttaaaaaagtgttgatttgccttcctccaaggagagagtaatgacgcaaaaggggattttgttggaggaatgaaagtgcttttagaaaaagaggcgaatgagattgaaatggcatggtaatatttgagataaaagaacacaatgatgaatggcacgggattaaatgaatggacagcagagagattaatatagtgaattgattgggagaaagtatgacaatttacattcggaaaaggtaagaaaaatttgaatcccgcggttacagcaaaggtatttttatccaacagggtttccatgggaaaaactcgctttgtagttttcaccggaatgaattttttccaatttttttttaaatttctgctaagcaatttacgcatttttcaaaaataactctcagctanatttttgaaaatttgagtgaatttgttaacatattttcaccaaacaatgacaaatatgcggttttggctcaatttgtaaaaaaa

SEQ ID NO: 40426 - DNA, 980 bp, Heterodera glycines
aagaaattaaattcggcaataagtgggttgtaaaaaacttgtgtaagaaattattttttgaagtgaatcaaacaccctattagtgctttgctgtgccgagaaccggcaggcaatggatggctttcaatctgcaagaaattagattggcaataagtggttgtaaaaaacttttgggtaatgaattattttttgaagtgagtcaaacaccctattagtgctttgctgtgccgagaccggcaggcaatggatagctttaaatctgcaagaaattatattggcaataagtggttgtaaaaaaacttttgggtaatgaattattttttgaattgagtcaaacaccgtattagtgctttgctgtgccgagaaccggcaggcaatggatggctttaaatctgcaagaaattaaattggcaataagtggttgtaaaaaactttgtgtaagaaattattttttgaagtgaatcaaacaccctattagtgctttgctgtgccgagaaccggcaggcaatggatggctttcaatctgcaagaaattagattggcaatatgtggttgtaaaaaacttttgggtaatgaattattttttgaagtgagtcaaacaccgtattagtgctttgctgtgccgagaccggcaggcaatggatagctttaaatctgcaagaaattatattggcaataagtggttgtaaaaaaacttttgggtaatgaattattttttgaattgagtcaaacaccgtattagtgctttgctgtgccgagaaccggcaggcaatggatagctttaaatctgcaagaaaatagattggcaataagtggttgtaaaaaacttttgggtaatgattattttttaagtgagtcaacaccctattagtgctttgctgtgccgagaaccggcaggcaatggatggctttcaatctgcaagaaattagattggcaataatgtggttgtaaaaaactttttgggaatgaaatatttttt

SEQ ID NO: 40427 - DNA, 1478 bp, Heterodera glycines
  misc_feature (1403)..(1403): n is a, c, g, or t
  misc_feature (1456)..(1456): n is a, c, g, or t
tgttttctaaagttttttctataagtattaattagggatgtaaaaaatatgtactaaaagtggccaaaaaggtacataaataagtaagaaaatgtacaaaaaaccaaaatatgtatgtataaaatatttaaaatagtgaatttttgtgtcaaaattttaggataagcaaaaaaattccataaaaaggaccttaacaatcttaaaataaggttttcggtgcttaataatttttgaaattcctttaaaaaaatggatttttagtggcacgttttaaccccgaaatatgtaaaaatatgtatttacataaaattgagatccctagtgatagttattatttatttcttcaaaaagccctctctgcttttttgccactctttgttagccattccttcgcttttccttttaattatataaattttctgggccatcgaacctcgtccaattcggtcgttttcttccattcatccgttatacctccaatatacacaattttattgctgatgggccgagcaaattccaaaaatttgtttgaattgaggaaaaacagcgaaatatttttggccaattgtttcaatgggggaaagtcggctccaaatgcttgtcggaccaatggcgcctaaaatgaattactaattgattagcactttggcttctttttggtaataattgaaaatgtgcggaaagataaaaggacagacaaacaaaataattataaatgataagaagggaccggatttatatggacgaaaaaattgcaaaatatggacgaaatatggacaaaaacgctgaaatatggacaaaaaataccaaaatatggataaaaaatctctgaaaaattagtttgaatttttgaaaaaaaaattcataaacccataaattttccggtcaagaaagaaaaaaatcattttaatacatgatgttagaatttgataattgtggcctccttattctttactaaaaaaattgaatttacttagaaaaaagcaaaacttagtaaatttttacaaaaaattaatttttacacaacctttgttgatgaaaaattttttgcacaatttttgaaaattttcccaaaatttttcgatttagggcgtattttccaaaaattttccatctttaggggtgtatttttcgacagggcctgtatcgggaccttaaaattttgtcattttacacccccctaaattggaaactttttaggaactattttcccattttcagtaactattttttggttgttcttgttgttggttgtccatgaatccaattcctgctgactgtttggggaacctttttttaaaagccccaatcggttaagaaaacattcaggcaattttttttattttcaaaaattttgcgaatttaaaattgataacaaataaaaagtcgaaaaagcgacgatnatttccggatttgagacttttttttttctatgcaaagttttcttcttcatgcncaccattacccacggacattca

SEQ ID NO: 40428 - DNA, 846 bp, Heterodera glycines
aaaaaatacagaatttatcagcgttcacctccacggctcccttccccacctcgcacgaaaccaaaaccaccaccatgtcaaccgaccacaaagagagagcaacacaagccaaaaaagttggaattaaaaccaccaaaaatagagcaaaatttgaacccgattcacgaccatcgacatcaaaagtcgcgcctcggtcgaaaaaagagcctgagttccagcttgacccacggccatccacatccaggcaagccggatacattcctcctccggcacccaaaattgtaccaaaacatgagccgacaaagagacccgtgccataccgtatcccgaaaagagaacccaaaattgttgaagaaacgccacagaggcaacagcaacctcctgctgctgctgtcgtcgaagaaatgtttcttgttcctccgcctaggagggggaccaaacgccgctaccctgtaatcggtgagaatgatgctgaggtgcgcataagaaaacgcgtgaggcaagcgaggagggtgcgagtacagtactcacccgagccgggtccatcaacatctgcacaaagtgatgaacaacaacatcgagaactgtttgccatcccgtcaaatcagctgaccatgaatcagcgggttgaacgactgtacatcaaatgcaaccgttatgcggatcgtatgggtgtccgtggcaatacaattaacaccgcaaacggcaagccgttggcgcatagcaatttgcgaatggccatcaggtatataattgacaggagagcgggccgccctaccattagcccactggagcgggcatatttgaagaagggttaggcaagatccattttgtattcatggacgg

SEQ ID NO: 40429 - DNA, 1316 bp, Heterodera glycines
ataaaatacatgcataatgcccaaatatggaaataaaacgcgaatttggaaaaatatgaaaaaagatggattacaaataattgacagccatattaatcactatttgtgtaaattcaatatatttttgttataataataaggtaagtttttggtctttttaataaattctttttttctataaataatccttttattgcgcacatcattaaattgagtaaatccaacactaatcaaatgcgagtgttgatattattattatttttatagaatcctactgagggttaaatttatttaaaaatgaaattttattctttatttttatttaaaattgtttcacaattttgtgtgttcgactatggtaaagaaggtacctcaataatcatttaaaaacacattaacattgttttattatttttctataaatatttataaatattcttttagtcttttgccaacaaatgccaaatttgaactgcgtggagttcgacgacacttgcgcatggcacaattgccaaacgcccgctgaccagctgatgtggtttcgcacttcggcaaacataagcagtgatcagatgatgaccacgacgggcactggagtgatgccaagttgggatttcgctatctcaaaaatcagattttttttcatttttttattggtgtccaaagaaaacaaaaagtttcgacgaattttccatgaaaatatattaaaccttctttttaaacgaccatttgctatgaaaatcacggaaaaagcattaatttaaataaaaaatttttttttcatgttttggtaaaacccttaaaaatgtttgaaggtccaaggtttttcataaaaaggacggataatttacgatgatccaacaataagcggacggggaataatgccaaatgcaagtcaagaatcactttttaaaattcgaatctccaatatttttaatagacggaagttatgccatcgcgtcaagcaacagtgttaatcagtcacttcacgcttgtctaattagtgatgttgtgccttcactaccaagcaatggttccttaatgttcaggtaaaaattggaaataacggaatcaaataaactaatataacattgatcacttttattttactattaaaaggcgcatttttcatcatttgagtttttttaatccaaaattaattgcaacaatacttaaaaaaacgagggtaattaaaatttcattcacaataataataataattgtaatttactttaagaaagaatttacaaaataaatatctcgtcttgccaaaataaagacacaagaaaagcaatatgccctggtaaaaggctgat

SEQ ID NO: 40430 - DNA, 521 bp, Heterodera glycines
  misc_feature (79)..(79): n is a, c, g, or t
aaaggaggaaaaggaaaattgaaaaatgtgtttgtttttaattttaagagttattaaagattttatataggataatttnatgtttaaattttaagttgttaaaataaaataatatataagattattttgataatttgttaaaattgtttagataaatttgaaaagtatgtatatagagttattttgtgaaagatttggtaaaatgaaggtttatgttgaatatgaattgaaggaagttatggagttgtgaaaggttagaaagtttattagaaaggtataaatggtcataataaattgttataaataaatattggtgtgagaaatttttggtggagaattaagaagttgagtaaaaataaatggtaaattttaagaattaaaaggagtaggatgagtagttgaaaggagtgtatgaaaaatttattataatttttaaagagaatttggggatggaaattgaagagatatattgaaaaaatgtggaatagggatggtaagagatgaagagttggttggattag

SEQ ID NO: 40431 - DNA, 88 bp, Heterodera glycines
cgcttccggaaattttgaactcctgatccggctctcgtaatttattttttaccggttctctattttagttcgactctattttatcccc

SEQ ID NO: 40432 - DNA, 735 bp, Heterodera glycines
gcacctcacgcatgtgaacggaatccaagtaacgtcgttgcgcaaaaagtaacgactgccatcaaaaggcgtgctgttgagacgatggaagctccctctgtaatccgtgccgtttctcttcaaagcattagttcgcctgcactttcagaagtgccgtcaaaaaaatgctgacatcgattgcttttgttccaattggcggtctcacagaagcagtcaatgcattggacgttgagtttcgaaatctgccagaaatgcaaccgatgctggaatggtttgtttttttgctatcataaacatgccaatatttacatttcctgcgtacaggttgatgaataattacacggtcgtccacgcgctgatggttcgcgaacggaaccgcgtttcaaagccgaagcttggaatgtctaggaaagaacgctaagcaatgatgacagaacgaacaattttcagaagctgcccacaaaagactccagtgtcatttcaattgtcgtcaccctactctttggaacttcattgacgttattcgaaaagtccaaaaagtgatttaactcacttaacatcccatttaagactacagatgccgattactcaaaattatcaaaggaattgagccgcctcaaaaaaagaaaaaataccgtgaagccgatgcccgaattcttgcaaaagttcaaaactattacgccgaccttcccaacaacgaagatcacaattatgttaaccgacatccccgtaaca

SEQ ID NO: 40433 - DNA, 931 bp, Heterodera glycines
gacgatcgcgaattctttgacttgctggatggagacaagtgcccacaggcttaaagataaaccgaaattggtaattttggattttaaatgaatttaaaattttattaatcgaacaaaacaaaatttttacacatgtaatttatttaggtgtttgtctttttttataaaatttacaataatataatttcgaaatactatttgcaataaccaatggataacaattctgctgatggcaagtcaaaattttaaaatttatatttcatgaaaaacttaaaaattgaagaaataaaaatattatttgaaaataaatttatttttttttatcagcgagtgaccttattaattaggcaataaaaaaattaaacaaatgagaattttatattttattttctaacagacaaattatatcataattgacaaattaaacgattttaaattaattttacgactttttgggaaaaatcattaaattttttggatattctggtggaattggaatttgttttttgaaaatagctgatgtttctgtttttgatcatgagaattgttcagatattgtacagttgtcacttgattaaagaagcaaatctgcttgcgaaaagcctgtcgatagacgtcactaatttgaaaattaatttttaaaatttaaaatttaaaacaaaaaatgccttattaaaaaaagcacaggtgccgaacttgcatatgcgaacacaaacaatgcaacaatacaaattggcaaaatcagagtttcacttatgtaaatgtccgcaccgattttgggcaacaacgaggcgagaaaaaaaagcaacagtctgaaaactatatggtaaaagtaggaatcatagcaagttcttaaaaatgtcggaaatcggaaataatttttcccaaataaattcccaaaaaatttttcttgggtttcataaaaaaaaaa

SEQ ID NO: 40434 - DNA, 1108 bp, Heterodera glycines
cagtttatattaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttgtctaattcgcaaaatttcaactccttcttctctaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctcaaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattgacgcttatcaacctgatccgtctgcaacacttaaaaagtttatatttaaagcctaattagcagaatgtgaaattctctcatttgttactttatgatcatttttgtctaattcgcaaaattacagctcattcttcgcaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgaatcctccggaacactgatgctgtttatatttagagcgtaatgagctg

SEQ ID NO: 40435 - DNA, 345 bp, Heterodera glycines
cgtttcacataaattttttcggcgcgctttttccaaaaaacttttggagaagaaaggggtccggcggtgccgataggcgccgccggggaaaattttgaaaatttgagtgtaatttattaacagattttcaacaaaaaatgataaaaatgtgttaattttaaaaaaaaactatgaggaatcatattttgtcgataggaaagccgagtatacaaaaaaaaataaaatattttaattactgtagaggaattgaacaatgggaaagaagaagagaaagtcaaggagactagccagtaagccatttgcacaactggcagtgttacttttaaagaatattaattattattt

SEQ ID NO: 40436 - DNA, 1505 bp, Heterodera glycines
gctccgtatcattaatctgatcatttagtaaaaataatgaaatgctaattagatacgatcaattggtacttttaatttcgcctcccttttttaattgtttttgcatattttttgtagtttaaaatgtcatgaaaccatgctgtttacgctgctacacaatagtacattttaattattttgtacaaattttggcatttgttcgccgttcgcgcactaattaattcacatttttcctgtgccattcatttaaaaaaaattttttttggtgaatgttggcactactgacaaaattcgataatatttttaaaagtattcattttttaggttttaggatttacggaaaaatcctcaacataaatgcaataaaacgtataggtaatacatctcgaagaattgaaaaatttactaaaaattgattttaaaaatataatttttttttcttgataaaaatttttgttttaaaaattgcccttattcaaaaaattttattaaaatacatttataattgaaatatacctaaccaaaattatggtttttgattaagtttttatgtgtttctctacctaaaaaacgttaataatatttgcctatttgtgtgcctaattaatgccaattatgcgatcgtttgtgcctaaaaacgaagccctaattatcatctattttaatgtaaagaggaaaacgatgaattccacggtttcggcaaatgatgattattcaaatgtcgaacaatttgctttaatttttctgaatgtgttcgaatttgtctcccatatatttttttttcattttcaccacttcaattttgcatttgaatttaaaattcattttattatgtcaaagcggctgtatttgcatcagaggaattggtaatcaaactcaataattagtaaacatgagaattttatgtacattttttgagaatatataaaaattttcttgttaaaaattaaaaaaaattttttttttttgaaaatgcacccttaaaaaattggtttttgtcaaaaaacgatattcaaaaattaattttaaaaatatagttgattctaagcctatttaggtaatttttatggcattttgtgcctctttcaccctaaggaagaatttttttccaaaattaaaaattttatttacatattttgtaaataattatggatttttgtttatgtttcatacatatttgaggttatttttttatatttatttacatgttttgcaaattttcttacataaaattcccatccctaataattaattagttaattaatcccattttcatcggttaagttcgcgttgaaattttgttggaagactttttggcgggtcaaattgtgacgacagatggcggtgattggcaaaagcgtgccatgttggctcccacatattttcgcaattaccttgcccatgttttggtcattgaacgtttaatggccactttatgggctaaaaattatgaaaaatcggcgcggttgggcatttcagtgccatttggtttagcattgtggtaa

SEQ ID NO: 40437 - DNA, 1589 bp, Heterodera glycines
cgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgcgtctcctattattttatttttttttcaaaattttgaagggcggggggggggggcggttgggcaggaaaaggccaattttgccaaatcggatggccaaaaaggtgacaacataagtgatgcaactctgaataatggaaaatcgattaattcttggccattcattaattgccctaattattggcaattcattaattgccaattttgattatgttcttactaaaattgcacggataataatgaggatgaaaaatggtgaagaaaaatgtttgaagttggtgacaatggccagcaacagcgagcagtacagcacggcagacggaatgccaatggccaaagcgaaaaaaagggggcacaaactcgaattggccaaaatggtcatggcggagaagaacggagcagagacggaggagcccattgggggaggatgaaatggtgtaacggggaggaaataataaattttaaaataaaattagaaaataaattataatgtggcattttgtcgtttaataaaacataatttattgtcaaaatttcatttcaacaaattataatatacaggctgagaaaacattactagaggcctatttgccatttttactgcatattttgagggttttttaaagccttgcctaaaaatattttcggagtcatggcaaaagatacaaaaggcataatgtacaataaaaattatggaaaaatcattataaatttttcaaaaaaaaaaaaactgaaaaacctaaataatatattttttttgccaatctcttattatatttttaattcttctttaatttgaaatttttaaaattttgtacgctttgccaattctcgttttgcctttgtgcgtttctaacattttaatgggtctgttcgggcaatcagcatttgaataaggcccacacaaaatcaaccattgttcaaatttttttttcatattttgcacgcgattttgtcatgtaattaatgaagaaagtattattgttgcattttgtcttcattttcaattcttagaaatgacggataaaccattgacaaa

SEQ ID NO: 40438 - DNA, 840 bp, Heterodera glycines
  misc_feature (818)..(818): n is a, c, g, or t
cattatataataattagttatcattagagaatgggggtgaacgggattcctgcgggaaaatcgagaatcccgtttcccgcgtcccagtttttcctgaattcccgtttctcgttctccgctattttcttgtctctgattttcatgcaaacttatagaatttaaaataaagctgcagtgccaactggaagaaagggaaatgggcccaaaccaaaagtctactcgctggacaaattggcccgaaaaggtgcgaacagaatgcacggactgcgggaaaaagatgcgccgtttttccaaaccacggcgcagccatgagcaaattttggccgaaaaacgcgagcaagcctttcggcgcgagcaacgcagaatttcgaagcagcgtgccgaagagaaaaaatggatgttgcgcgttttgcgtgaccaatatttggacctaaaagagcgcattaatgttggggaatatattgacttttacaatcgttcaggaggtggcatgggtctgatgccggctgaaagagcctattcatcaactgatcaagacccaagcaccgactacagcccagcctcgcctgattacacgctccgtgagttgtgatcagacggcagaaggtctgtagtcattgatcggcaatgatcagttgatgacttggcaattttactgcatctagcccaagtgttttctgatatgattagtcgctttttggttaaggaaacttatgttactgctttttatgctttattagataccgatcaattaatataaatttgataaattaatgccggtttttaaaatcacagttgctaatttaacatatttttanattcatgcatttaattaatttg

SEQ ID NO: 40439 - DNA, 1056 bp, Heterodera glycines
gcccttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcgccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcgccgcacttcctatcatgctcgagagcatttgtaacgtataaaatttctcaaaatagagatagtcatttttcttggatataagataaatttaaaattctctgtgaaataaaatggcgattgcgcaccgcacttcctatcatgctcgagagcatttgtaacgtataaaatttctcaaa

SEQ ID NO: 40440 - DNA, 1411 bp, Heterodera glycines
  misc_feature (63)..(63): n is a, c, g, or t
  misc_feature (87)..(87): n is a, c, g, or t
taaatcgcgaaatatggaaaaatatggaaaatatggatatagaaatccttctagaaagcttcnaaccaagctaaaaacatgttttcngtgcgtttcaggcctccaataatccaggaaaaaaatatgattttccatataattacacgccctacttattagcaggaaattttctggctgaatagtcgggtcgctaagcgcgcacacaactgagctaaatttggtgggcgtttcggtgccgacgtttcggcgccagccgggttttttgattgtaacttttttgcattttcgactaaatccaagaatcttattggtatcattcgaaagctcttcataagatttattagccgtataaaagcaaaaaaattttctagcaacagaaaaattattaagaaaaacttaaaaatttcgactttttcgcaattttcatgttataactagggtagcaacttttagtgacgaaaaatcccgaaatagttaactaaaatagtgagtaaaaatgccaaaatagtgaagaaatagtgacaaaaagtccgaaatagtgacgaatagtgacataattttcagccaaaaattgagcaaaaataatttttattcactgattgcagttgcaaatgagtaggactgggatttttaagaccaaaaaccccaaaatagttacctaaaaaaatttttgccaagaaagtaaatttttgagaaaatttttttcatttcttaggagtatattttgaaaaattttagctcgattcttaggggtgtattttttgaaaaaatttttaggtcgattcttaggggtgtattttttggttttattgcatttttgttaaggaattttccaaaaaatgccgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttctacattgagcaaaaaaaaagttttttcactaaaagttgcttccctagttataacttttttggtaattgtcgaatccctaagcaagagcttagaaacagcttctaaatatgtaaagatttcgaaagataccaagattgttagatttgatcgacaaatgaaaaaagttacaatccaaaaactcgggctggcgccgaaacgatacgacccttgaaaaatagagtcatccccctgaaataaagcaaaccttccgaggaggttcgaaatagagccctcgggggctgtattttaggaaaaacggtaatataaaaatttaaagctcatttgcaagacggatttatttgtgtttttttaaaattcgtttgtgttaattatgttctttaaggacatttataaaaaaaatatgtaaaggttcaatga

SEQ ID NO: 40441 - DNA, 145 bp, Heterodera glycines
gggacctctagagtccacttcgcggcgctgcgcacgctgggtcagccccttgagtacggcgaaatgctccagcaggtccagcgcgctgacctttggatacacgccaaaatcctgcggcaggtagcccagccggcggcgcacggcg

SEQ ID NO: 40442 - DNA, 1428 bp, Heterodera glycines
  misc_feature (15)..(15): n is a, c, g, or t
  misc_feature (66)..(66): n is a, c, g, or t
ttatattatatttanaagttcaagcaaatatttatttttagagtgaatgatcaaatattttgtatntaaaaaatacactatttttaaagctatttaaatagaaaagaaaatagccaaaaacaaggattaaaatcaatttggaagacaaaacaatgcaattcacatcttttagcatgcattgctttataatttttgtaattttgaagtttcttatttaataacataaattttaattgtctagaaattaaacattatactaatcgtttttaaaaacaataagtaagagaatttaaatttattagtacgaaagcaaaaaaaactattttatagcattaaaaaacaaaaagttacgattattatcattaaaaattatgcattacttaatttataattaattttgttgtcaattcatttgtaaaaaagcttgtaaaattaggaacaaaatttggtagcttttgtatttaaattctgaaggatgtttcctaagaatactattaatttggattatcgtacaaattataattattcttaggcctgaaatctataaatatcttcccaaaataatgaatttaaataagaatttaaattgaaaccatttccttaataaataaaatgcattaatattggatgacgacccttgtttcaaaaaaacgcaaataaaaaattaaaattttgttcacctaacaataaaaatataacaacttcttcttacctctaaataaaaaaaacctatacagaacttacacgcaagcaggataatcgccgaataaagacccaaaggaagaaaaatatcgattaatatttatttacttgcagtcgacctggttgagatttatttacattttggatttttttaatttataaaaaaattttcaaatttcttcaaccactgatttttagactaactcatctaaagttctcaaatgacagatttatacctgtaaataaaaaatttaaattgcaaaaaatgttaacttatttaagaaaaagataatctgaattaaaataactataaatatccttaaaaaattttgcacgataaaatagagaaatatagcataaaataaaataaaaattaatgattacgtaatttacgcgacctatagacaagaacacattaaaaaaaagtaaattctaatatttctttagtttaatttttttcaataattaaaaaaaatcattagttctcgaaaaaacgaagacaaattgatggtcatttttttaaagaaacaaaaatttactattgttgcaaaataccatatatcaaaaaatgttcttgaacagaaatttaaatatcaaaatatatactgacaattctttatgttaacaaatatgccaacattagatatacaaaaaaatttaaataggaaaactaacatattataaaaaacattgcaaattaaaagaaataactttttaaaaataata

SEQ ID NO: 40443 - DNA, 836 bp, Heterodera glycines
tcagacttgttcgaactcggggacccatgggttggttctaaattgatcgaaattagcccctcctccacctgcggtgaaattcatgcacacagcccatggtcacacgcgtcatggagctcacattgcccaggcacatcatgcacttctttcgtgcgatcgcattgcgtgcctgaaaaattgttggaaaatttaaaatgagcaattttaatcaattagttaattaattgcccccccccacgcgcttcactcacatgtccggctcgtccaattgcggcacgcgcaaccatggcatttcgacgattgattttgatgctccgtgctcgcgctgctgatgcccttgtcctggccgttgttgctctgaccatccttgaaaaagcgcacaaaatttatttcattttaaaaaatgaaacaaaaaaaaactgacgggaattattttattgttcagaagcaagatgaagattcgaccgatgggggaaagaatggaagtgaatgcaattgaatgaatggatgcatttggtggggaattcagcgcttaaatacggagaaaatttcataaatttgtcagtcatttttcaaaaaagtataaattgtagaaatttttaggattttttgcattttttttttgtttgaattcatcaaattcactcttccgctctgtccatttctactgcattttacgcgtccaatcaaaagtacgcgtccaattgacttttacgcgtccaatcaaaattttcctatatcgaacatccttttgacataaggtaccaaccattgcaaaaagaaataataatttaaatattaaaacgtaacaccaagagaaataaaaaattactaat

SEQ ID NO: 40444 - DNA, 951 bp, Heterodera glycines
gaaaaaatcggcggtgatcattgatcaccaactttgttaactttacttttttaccgtattcataaatttttcttaatgagagccactttttgaaattaatctgagaaatcccttaaaagtggtcatccatggttctttccctggccccttaatccgtttttccccattttttcttgtcattgatgtccaccatttgccccatgcgctcttcaacatgctcatctgtgcgaccgccccctttttggatccacgcccaagcccaagaagaacccgtataaaagaacgaaggaagacccactcgaccgaattaaatttcccattttaactgccctccaacagttatcaaacgatctttttccaaacgatcaaccgatccaattttcttcacacatttcaatttttcacttattttcattgcgttttttaataaaggttttatccaaaaaacctttcacttttccttcccataaggaaaccccttttttccaaccaattgccctcattcctcctacaggaatttggagcttccatcccaaaccataagccataacattttccaatttattcttttccacccaaaaatttaaacgcaattttccatcccttttcccatactttctgaaccgccgttcccactccgaaaacgggggcgacattgcctagtttttagggtaagcctattattaaaatcaaaatgggagaattgaaaaagaagtggatcacttttgccatcgccgagatcactgcccggcatttgttcgaatcgagtcggccttcgttgccggccccgaaatgtgagtccacaaaatcgccaacgtcgaacagcgtggagttgaccaattcggtgtccagcggagaatgacccccggtgcaacagactgagtttgaacgccagccaaatggaacgcaaagcgaacagacggacagagccgagcgagcgcacaggcgggg

SEQ ID NO: 40445 - DNA, 1714 bp, Heterodera glycines
  misc_feature (1683)..(1683): n is a, c, g, or t
ccttattttcttctagcctggttggtgctgggatcctatttgaaaaagcatatcaaatcttgctcaaaagtaactaaatatttaattcatgttttttatttggcttcaaattgcaaaagttttgttgactttcaaaaaaaagttatggcaagaagaacctaaaaactagttttttcgaacattatttatcaaaactttttttgaaatttggctggataaaagagaacatttaattttgaaaaatttatgtccatattttgacatttttgccatttatgtccatattttgctatttttggtccatattttatggccatatttcgcattttatatccatatttttggatgccctacttatcaaatgatatcaagaattaacattttatttgttttttagcaaagttataagcaatattttttattttgatgtttttttagtaagtcataactgttaaaatcttaacattttttaaatctgtttaaacaaacatttattttacttacaacatatctagcagggaaggcattccgaggctcaaaaattttcggaaaccgggtttccgtgccatccctgatatgtatggcccagagtcaaaaaaaaatatccaaaacctcctttacaggttttcatagggacggaaaacgacagaaaacccaaaaaattactgggcaaagcgtttaaatcggtttttgaaaaggttcaaaacttgaaaatggacaaaccggaccaattatattccttttaaaaaggcaaaacccggtcaattaagcacctatttgtgggcaatttttggcctttttaatacttattttggaaatttttgcttttatggccaattttgacaatttttggcgtttttgggattatttggcatttttaagccctagtttatgcatttcaactgggtttttaacatttttcaacatggttaaaccaaatattttattcaaaattttaattgttttttgaaattttgagatccaatgggcgctttgatgcgtcggtttggcgaagaaccgttgctgagaattttggagctgatcggtgaggccgaacgcatcgatgtgctgattagtgttcggcaatttgctgaaatgtaagaaaatgtaaaattttaaaagatagtaaaacccaccttttaaaaaacgtcagtcgataattcgtcagaaaatttattattttttgagcaatgatcaaaaatcttgcaaaaattattgatcgatttttaaaaaattacatggattttcacatttatagttacttaataattaattaaattaattattatatggaagtagaaaataaccctaattctttaagaaaagaacaattgggcgtcctgcaattatcttataactagggcatccaattatatggaaatccatatttttttcctggactgtgggaggcctgaaacgcacgaaaaacatgtttttagcttggttgaagcttctaggatgactccatatctatatttttccatatttcacgatttatgtccatatttccatattttggcatttttatccatattttatgtccatattttaaattttttccaaaaaacctctattataactgcccctatcaggtaaattggcatttttgacccctaaaaaatttcagaaaaagacgtttttagcaaaattttgtcgaaaattgattaaatttaattttcttanaaattgtgtaatttatattaaaaataagcaa

SEQ ID NO: 40446 - DNA, 1216 bp, Heterodera glycines
ggggggggggggggggggggggggcccccaaccaaccatatttgcatttatgtattatatatgtgtacatatatgcgcaatcagagcagaatgttgcgctgggcgagagttgctgctgccgcttttttgccgaattgaaactcgagaccgaaagttgagccccgaggggtcgagagtgagatttttgccctttcgcgactctatacaaaactggagcccggaccggatcgggatcctgccagggttttccagagattccgatgctggcgtttttgaaaaagggtcgggatcgagattccggcctgattccaattgaatccataccccaactttttcaaaattccgggctatagatacaacagacttattgttagcctttttttctggttctcgagtctcgaaaaattttggcacctaacaggcctataaattatactacaaaacacattaattgacattttttccgactgatcaatatcaccgttcgatcagttaatttttgtttctcccatactgatcaaattgccgttgttcctgtgctccataaatcacttttttgcactgatagtacacgtgatcgattgaagacgagtgattactgatcacaatcactgctttttggcttccgatcaccgatggttttccgccgccgattcagccgcctcgcgcgtgctgtagcccattttcatgtgcgtgatgatgtaatgcgccaggcgtcgccatgtccgcgtagcgtccgtccgctgctgtgccgagaagtcagccagcgaccgaatgtgcttcgtcagcgcctgttccatggcatcctggaattttttttattggcacaattgcacattccgcctcttttgaaacaatctttcctattttttaatataataaaaacctccagactggactaccataccgagacttgaccaccagactacactatgagaccgaaccttgcccacaagcctcgagactcgagaccgagactctcgagcagcactagctgttactaactgagctaacaataagcatggattattctttgttttccaatttgttttgggtttctcgcgagaccctccctagcgagttctgactatcaaaaattcggttgtccattctcgagccgaagaaatctctatggttttttggggtcccgatctcgattctgggtaaaattcaaaacatcccagtgagacggcacgaatttcgtagcgatattgtg

SEQ ID NO: 40447 - DNA, 821 bp, Heterodera glycines
tttttgcggcgcacttttccaaaaaaaaaaaattagagtataggaggccggcggtgccgataggcgccgccgggaaaaattttatgaaattgggagttttggtagcatttatatcaactaaataaatcataatcacaaataatttaaaaagtttggggaagcctgaaaataaaggacaatcttagaaaaaaggacattttagctttctaagatccggcccctccaaaaaaggaaaaatctttaaaaaaaaggacacttacgagccctgaataataataatgttttcccttgggcacaaattccgatcgctaataataatgtgacccaaattctccgaatgttcggacctccaatggcacttgacaatgtcaacgacgaccaattcgcccgcatttgtggccaccaatcggagaatgaacaactgaatttgtaagggcggtggagcaaatatgagagaaaaactggacaatcctactgtaataccaccgtatcaaacaatacgacccatgacaacgcataaaaattttaaatttttgtgaatttttgggaaaatgcccttctgtgttatttaaatggcattctctgctcaattccgatggttttaccccgtccgatttgagggattcgtccacaaatttgtccaccgaatgcgcactcggcacccgaaatggtcttttgatgaattgtggcatttcgtcctcctccgccatcgcccacttttgttgcgacagttttggcgttctgccgctgcttcgctgttgttcgctgtgttcagcaatttgcataaacttcagcacgtagtccaccccggccatgtgcaa

SEQ ID NO: 40448 - DNA, 1667 bp, Heterodera glycines
gatcacattcgttgtggcctcgatcagaaaacaatgcccaacgggcgcattgggagtgaatgtcattacagcctaatgagttttattcataaaatattaaaaaaaaaatttatttattttaataaatgatgagaaattcaacaattaattaatattgagtttcttttttaaaatatattaaaataattaattcagttattaattagggaatttatttttcaagaaattattgaaatttcctttttaaaatataattaaaatattgatttatttaaccgtcgtcatattttattattctttatttcatctaatctattaaaaattattaaaaacatttaaaatatttcaaagtccaatattaaaatgagatttaaaaaaaaattaattttgactattattttttttgaatttttaattaatgttaaaattcccttttttaaatatatacaaaaaactttttatttaatcgttaatgtttgattattctttatttcatcacatctattaaaattcttaaaaattttaaaaatttcaaagtccgatttgttaaaatgcaattttttaaaatattttttcattttttacttaccaggtttgccataatcggcgtacggtcggcacccgtcaaaacggcacgaaccctggcaccatgtgttcatgtaacgtggtgccgttttacatgtgccattcgcggcccactgaatgcaacacacatcattgtcataacactcgcgttctgtcggtggcgaaggctttacaaaaatttaaaaaatttgataaagaaataattgaaaaattcgattaaaatgtatttaaataaaaaattaaattaattcatcattataatttaaaaagctcggtatttttttttcgaatttgtttcagcctgcttttggttggtttcttacttttggtctgagattattgtagtaatacgaattcttttttattaatagaacttatggttgaagaactaaaattttttctgactcctttcgaaattagaatttttaaatgattctaataaaaacaattttttaatgctaaatttttccagctcaagcaaattgtgtaaattcaaattttcgtgggatctcaggccttacttaccaggaccgtgtttttctgcatttttaatcgctcacttttgtaccaaatttaattgaacatttttaagcgctcatttttttttgttcgtaaaatatatgttaaacaaattaattaaaaacattaaaaatattaaaactaaatacaatttgcttacagtaggcgatggtgtcgtgtccatcgcagcccttatgtacggtgtcaatgttacagtacccacatcatcgattgctgacgctacaatttgcgtgccatgccgatgcaactgtagtacattcggtttttgctgctgcttctgctgctggcatatgccttgaacacaggtcgagttgtagcacgactcttcttctaatcgaaaaataaaattttattttatttttgtcattttaatttttaataaatatataatttataaaaaattattattaattttcttttttaaaatgtttaactgtttccaacaaaaaaggaacaatcgccaccaggtcttattttggcacaacatattgggtcggcataacgttgtaatgtggtatcacagaacaaataaactgtaagca

SEQ ID NO: 40449 - DNA, 1337 bp, Heterodera glycines
cgccgaccgatgcgccggtcgcctcgccggcagcggacggttgtctaccaccaaaaaacattgtccgatgttggcccgcggcgatgccgacgccgctgggcattgctcgcggcaaaatttgagggcggacgacgccgcggggcatcagcggacacgcggaagagttggaggcgcagaatgaggaggtgacctcttgggaatggtggctaacgtagtgatgctctcccgcttcttctgctgagggcagcaccaaagtgttgacgaacaaagggctaaaaccgcggcgatttggccgaaagcggtgccattgccttgaggaggaaataaaccataaggaagaagcagatcgaggcctaaaaaggcctcttgaagcaagggatgataatatccaaaaaggaagggcaaatgccattggtagctaacccaagtggtgaaactgaactcggctacgaaatggacaaagtgttagaactcgtatttggatcgaacatcagtccggttaagttagcaatcggatttcaaactggatttgaaaattagaattcttacgggaagttgcacaattccatgccgccgtttattttgccgttttcgtcgcttttcgcccctttctccgcttcatttgtcgctgcctttttggccaataaaatcagcagttgttcgttggccgatacagcaattattggccgactgtcaatgttttttttgccgatctcttcaacaaacaatggaaattgcgcttcaaatgccgtcgtcgtcgtcctcgtttggcactccgtgccattgtttttgtcattcgcttgtccgtcgcttgtgaataaatttggtgacggaggcggcgcagcgcattggcgacaaatgctgaaatttaaaaaaaaataattcgcttaatttaaatcactttaaattcacccgttaaatcacttttaatgaattatttttaaattcacccgttaaatcacttttaatgaatcatttttaaattcacccgttaaatcacttttaatgaatcatttttaaattcacccgttaaatcacttttaatgaatcatttttaaattcacccgttaaatcacttttaatgaatcatttttaaattcacccgttaaatcacttttaatgaatcatttttaaattcacccgttttttccgtttttatttttcgctgtgttttgtggcggcccaaagcagcgattggtcacattttttgtggtcgacagtttattgaatgttctgccgctggacgaagaggaaaaggacgggcgcaaaaagtgctcttcgccgccgctttggcgcaacaaatgccatcgtcgcaataaatttctaaatttattttc

SEQ ID NO: 40450 - DNA, 1182 bp, Heterodera glycines
  misc_feature (149)..(149): n is a, c, g, or t
  misc_feature (1028)..(1028): n is a, c, g, or t
  misc_feature (1039)..(1039): n is a, c, g, or t
  misc_feature (1125)..(1125): n is a, c, g, or t
  misc_feature (1161)..(1162): n is a, c, g, or t
aaaaaagttatggccaaaaaatgtttgcaaaccaggttccctgggtactcttggtcatacttttgctcaactttggtcaaattttttgaaacttaggtgagctaatagagaaatgttaaggctatcgaataataccaagaatgtttatntagttggctttgtcaaaagttatggacagttttttggttgaaattttcatttgatggttttttatataacgccctttttgatggtttttatgtaacgacatagcaccgtttttctaatggctttctttctgttttctttttacatattttccgaattatattttattgtttatggaatattttacgaatgttctactgtgccaattcgtacttttatttcgccatgttccaagcaaagatcactacaatgtacgagtactttgattatcgatttttttcaatccatattttcggacccccccccccccgccccatacctattggatgatctttgatcccttcagtcgaaacctattggatggacttgtgcgcgagaatttaattaatttaaattaatttaaatttaaattaattaatttaaatgagcgagagctgcgcgactttttccgataaattgtggaaaatcaaaaacatggtcgcggtctcgaaccgttgagagtggaagtgaggagcttaaccactaggccacaggggcagttgaaaggtatgggataattgttgactttatgatgaaaattccgaaaaattgtgaaaaatcaaaaacatggtagtggactcgaaccgttgagagtggaagcgaggagcttaaccacttggccacagggtgagttgaaaggaatgggataattgttgactaaatggtgaaaaatttcccctttgcttcaccacaagcgctgcggaggcgggcgtgtggcggcgagagaccaaactttttttaataacaggaattaagttttattataaacaataatttattatttttaaacagttaaatgtttaaaaatttgtctttaacaaaaaatttccaataacaattanaattataccanattcttataagaaaaaataatgcattgtaaaaaaagtaagttacactactttgattgaaaaatatttggtggtgtctttgaatatntttcatttctttcatcatggtttccgcttcgcttgnngatatatgacctctcctctt

SEQ ID NO: 40451 - DNA, 404 bp, Heterodera glycines
aagcacttttctagggtagttttaggcgctgatcaagaatctgacgtctaaactgcaaaaatctgattttgtcagattttttgaaaaaacccaaagaatctcttttttttgaaaaacccagaagcagcctcatcccgggtacattgggctataatttttgatagaggcatcgtagaatcctgaaacaagtaccattcgttttctctccagtataggaatcgattgatatatgataagactcgttatttctttttttttaaatcacttgatgaaaagcattgattaaatcatcgatttttgcagttttgacgtcagatttttgatcaccgttcaaaactaccctagaaaagtgctttcctttgtcgggattatgacatttttacggggggtagcaaaacttacaa

SEQ ID NO: 40452 - DNA, 1079 bp, Heterodera glycines
cagatttatgggggagaccgaatcctccgggaatagctttcctatagcctgtactttaattctgcgttggatttttgctctccataattgtttgagtaccccaaacggacacttgaaaaaatcgatttttttgttttcggggcagtccccccgaaccgatgcgcccagatttatggggagaccgaatccttcgggaatagcttccccatagcctgtactttaattctgcgttggatttttgctccccataattgtttgagtaccccaaacggaaaaaatcgattttttttgcttttcgggccgtccccctaccgatgcgctcagatttatggggagaccgaatcctccgggaatagcttccctatagcctgtactttaattctgcgttggatttttgctccccataattgtttgagtaccccaaacggacacttgaaaaaatcgatttttttgttttcggtgcagtccccccgaaccgatgcgcccagatttatggggagaccgaatccttcgggaatagcttccccatagcctgtactttaattctgcgttggatttttgctccccataattgtttgagtaccccaaacggaaaaaatcgattttttttgcttttcgggccgtccccctaccgatgcgctcagatttatggggagaccgaatccttcgggaatagcttccctatagcctgtactttaatttctgcgttggatttttgctccccataattgtttgagtaccccaaacggacacttgaaaaaatcgatttttttgtttttgggcagtccccccaaaccgatgcgcccagatttatggggagaccgaatcctccgggaatagcttccctatagcctgtactttaattctgcgttggttttttgctccccataattgtttgagtaccccaaacggacacttgaaaaaatctatttttttgttttcggggcagtccccccgaaccgatgcgcccagatttatggggagaccgaatacttcgggaatagcttccccatagcctgtactttaattctgcgttggatttttgctccccataatgattgagtacccaaagggaaaaa

SEQ ID NO: 40453 - DNA, 1330 bp, Heterodera glycines
aaggaggtgttttgcagggataatcgaaacccaaagccggggaccctgtttgatgtacaaaattttgtgtcataataaattgtgaaaattgcttgcggggttttcggagacgctgaaatcacgaatctgagctcaatttaccaacccgaactcgaaccaaaagcataaaattccaaatctttcgcatttcaatttttacatgcaaattttgattagggacccggagttgattattcctcggtaaatttgctttccaacaatttcttttttttaatttatgaaaatggcaatgtctaatttgcacacaaaaaaggaaagcacttcgggccgtttcttcgccgctgtgatcgacgccggcacgcggcttcacctcttcgagttcagccacgagttggagcaggagccgagcacgttcaagctgtaggccgagatttacaaggaggtgagcagaaaatgatttcataatttttttttaattttcagtttttcatcaacgcaaaacttttcctataatttttcgtagcttttatatttctaatttttgttattttgcatttttctacaaaattttggctactaatcccctcatccctttgccccatttgacagattaaacttggcgtttcgtgctgcgccaaaacgcccgaataggcggcggagaatgtccgcgaattgttgctgaccgcaaaacggcaaatcccggccgaactttgggccaaaacgcccatcgctttccgcgccacagcgggcgttcgtttgctggcggaaaaggaggcggatgcattaaatgaatttttggcttacaattaaaaaggatacgaaaatgacagataaaaatttgtgaatttattcaaacagtccataataaaaagaggagagcggaaaattacaactgatttttggccaattgacgattattctgtgtaaaattaccccaactagaataaatttaagccaaaataatgggactgtgtcactgcgcggaacaactcgtcccccatatggtttcctttcgatattttttttttgtttaaaaccccaaaaatttttcataaaatcaaagcgttttatttgcatttcttctttccaaaataatttggcacctcataacccggcacattggcaaaaattaaaaccactttgatttttaaattgaaaatttcaaaataaaaattgaaaaaggtttaataaaagaaaaatcgcatcttttacagcccaacgtggtgcactattcgctggaacagctgggcggacaggcccaagtcggcgactttcgcgtcgcggccgaacgaggcgcgcttcattcatttgttaatcaatgcattttatt

SEQ ID NO: 40454 - DNA, 1684 bp, Heterodera glycines
  misc_feature (63)..(63): n is a, c, g, or t
tttgacgaaacgccagccggacgatttttatagtgggggggggggtgaatttttggcattttntggggcaaaaaaaaaatttcatacatacaaatgttgaaggttcatatcatgcatgcatttttaacaaacgcggtgagacgaaatgggtttcaaaacgccaaaattaaaaagtgacggcattttaaagtttgaaatgagtggcccgagtaaggaaggccctatgcagtgtgggcctgatttggtggagccttgaaaataagaaaatccgggaaaccaattaataggcaattaattcattatcccccgattaaaattgctcaatgtcaaataattgaaaaattggggatttttgcaaataaataatatatatatatatatatatatacaacaatacaaataaacatttatttatttatttatttacgatttttgtttgccattattgggccaagaaaaaataaataaataaaatgatggcttttttgggcaaaaaatgatgaagattgcttatgatggggaaagaaatatgaatgtatggggaggagcactactcactttccaacacctaacattataacattccatggccaaaaaaatgattttttggcgctggcagaaaatgcaaaaaatggaaaaaatgcattaaaaaaatatttaatggaaataaaaaatggaattttggaaaaagtaaaaaaaatgcaatttaaaaaatattaatggagcaatcagtgaattttacatgaaaatcattgtttaaagtttgccaaatgagaaaattcataaatattttttaaaaaatattagaaataaaaatgaataaaaatataattttataaatttcatgaaaatatttttaaaaaaagaaaattcttgaaaataaaaattaaaagaaaatttaataaagttgcaaaataaataactaaaaaaagatattttataattccaaattaaaaataaattgttaaaaaggatttttttataaatttaaaatgaaaaacgaaaaataaaaattatattaaaatgaaaaaaaatatttttgacttttattaatatcagacaatttacaaaaaaattaagaaactaatttaacactctaacaaaaattacaaaaatctttcattacatttgttatttaattaacaaattaaaaaaaaattatttaattcaaaaattgaaaaataaaattaattccataaaaatgaaaattcaatgaaaaaatttaaatatttttatttacaaattattgtcttaatgatgatgatggattttgccaccagcagcttaatttgcttttcagcagcagccatcaaccacccccattagtgacgttaatatgtaatgttaactaacgcaaatgattcgacaaattctgacaaaaataaagcaaaaatttttttttttgaattatgccatgaaaaagtgccaaaatctgacgtaaaaaggggtgcaaaatatatgataggtaataattatgtgcgtaattgctgtcaggagatttaaaaaaatttagacaaaattatttacgaatttaatacactcacagaggtgggatttttaggattcaaattagattaaaaagatccccaattttcgggttttggcacgtctaaaaaatctgtttttaccaatttcgggtttggcatatcgaaaaatctgtttttatcttctggcatctattttt

SEQ ID NO: 40455 - DNA, 995 bp, Heterodera glycines
  misc_feature (981)..(982): n is a, c, g, or t
tatagtctgtactttaagtgtgcgtgggattttgctcccacataaatgagtgagtcccacaaacgcacacttgaaaaaatcgatttttttgttttcggggcagtccccccgaaccgatgcgcacagatgtatggggagaccgaatcctgcgagaatagcttccctatagtctgtactgtaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatcccttcggggaccnntgcaggcccatgc

SEQ ID NO: 40456 - DNA, 999 bp, Heterodera glycines
  misc_feature (945)..(945): n is a, c, g, or t
  misc_feature (982)..(982): n is a, c, g, or t
tgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggcgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaattatcttatatccaagaaaaatgactatctcttattttgagaaattttatacgttacaaatgctctcgagcatgataggaagtgcggcgcgcaatcgccatttaattcacagagaatttttaattatcttatatccnagaaaatgactatctcttattttgagaaatttatacngtacaaagcgctcgagc

SEQ ID NO: 40457 - DNA, 990 bp, Heterodera glycines
  misc_feature (758)..(758): n is a, c, g, or t
aaaaaaaggttagaaaatgaaaaaaggaaagatgaaaaaaatggcagaaaatacttctgctttcataaagaaaataatgcaaaatggtacataataatttctttaatacataactgaaattaaaattaggcagtatttactatttgtatttataattattatcttatttaaattaataacttgtaaaaaaattgaattaatttaaaaaaatcattcaaaaaaaaataataaaataatgaataaaaacagctagaattggtgggacccgaaccctcgaccaccaccaccaaaggcaagcacactaaacactccaccactgggtcgcttgactcaagcccatttaattcccttttccctttccttcttttttggaagaaatcccgaccaaaagtgcttgtcctccctttttagagcacttcccggacccggtccaaaacaaccctggtatcattcgaaagccaagagtttgttgatgtgcacaaacatattaaagttttgatttgacccatttaaggtatgcaaaaagcattcaaaaatgagagatccaaaaaaagtcatttttgggacagtttttcgaatgtagttcgaatagttctaaaccgatcgaaatggctatagttttgccttataggcattgaaaaactgcgtggattgaccccactctcgccccaaatcactctgtagaaagccttaaattagtttttaagcttggatcaagggtagaaacttcttataaggtgaatttaaatttacattanatgtatatccagccaaaataatttgatcgtcgagattaatgccgagaattgccgcgacgtatttatcgtccaaaattgcgtgatcagaaggaggggaaaagcaaatgaagacattaacgcaataagcaaatgggaaacaaagcatcagaaaaagcagcaaaaaatatttgagggacgaaatggttttgtcacttaaacttggaaaattattttgaataattaaatattttga

SEQ ID NO: 40458 - DNA, 967 bp, Heterodera glycines
aactctgtttttctctctcttcctctctatttttttctttcttttttctctctcattcatgttcttttttttatcacttttaacaaaattctgtataaggtcaggcatttttttaaatttctcctacttcccacatgggtaagctgaaatgggtgttataagaaaaaaaccatcaaatgaaaattttcaacaaaaaaactacccatattttgcttaaactaattcttaatatcattcgatagccctaatagttctctatgacgcaaaatttcaaaaaaaattttcgtcaaatttgaacaaagttacggccaaaagtgcaccagggactaggttttcaaacattattggccataactttttgaaacttaatgaaatttcgaaatttgtaggcctgtaaaagacacttagggctatcgaataatatcaagatcacatatttttgttggttctaagaaagttttaatcagaatttttgatgatcaaaattattttaaaattttgttataaattatttttattttttattttcttgctatcattcgatatccctaaatcttttctaatcgcctgcaaaattcaaatagggctatcgaatgatattaagaattaaaagtctaactcatgctgtctgtctctcatttggcaggcaaaaagcctcatttttacaaatttattcaaaacaaatttaaaatgttcaaatgttatatttttgattgtccatgatcaatttgagcaattttttgttagaaatagttaagcattttgtgaaattctgagcatgaaaaatcgaagttgatttttttgtggcgcttttccaaataacttttagggaacaaggagggcctggcggtgccgataggcgccatcgggaaaattttgtaatttttaatgcgacttgttaacacatttgtccacaaaaatggccaaatttttgcgattttgagcaaatttttaagaaaataaagga

SEQ ID NO: 40459 - DNA, 919 bp, Heterodera glycines
  misc_feature (488)..(488): n is a, c, g, or t
gggcggaggtaaacgcaaaggggttttatgcattcattggtttttcccctacccatttttcggttcctgtcgtcgttttcaacgattcgcccctttcgcccgccaacggaagtggcggagaggtgtcgcctgtcgaacggtgagcgcgtggttggccattcccacccggcgatcagccgagtgttggagattggctgtgtgtgcaacaactcgcacttggccaatggcacaatcatcggacagccgacggaaggggcacttttggtactggcgacagaggtggaaaacaaacgataaaaaacaacgaagaagacagagttgcaaaaatagacccaattggacatttctcgctcatatttccgccgtctcaacgaaatgccgttcaattcggacaacaaatggatgggtgttcaggtggaacccatcaatcgggttagaatcattcttataatcctatataaatcatattgcgctccccgatcccccgngtcggtttttggaaaaacagaaatcccggtcccggtttttggaaaaacagaaatcccggtcccggttttgccagtcccggtcccggcgggactaaataagcactggtaagaatgggggtctgggtgaaaagagaagggattggtgagggatcagaaatttttgataaaaataaattaaattatttattttcatttatagcatgtgttcatatgcctaagtggtcaattgtctaaacctttttactttcattatttgtctcttcggttcaattccctgatggaatagaaaatttttttatattttctttaccattattttaattgaatttaattaataaaaatattttaatttaaaatcattattttttaaatttttaatagcctaaaaacccataaattaaccaaatatttggttattttttgacaaattc

SEQ ID NO: 40460 - DNA, 864 bp, Heterodera glycines
aattttatttatttattttttggttggtattttctgttcaataagattacacattttctaaatttgtcttataaatattcgaaaatgataaattattttttcttatgaaattgattctatttgtaaaagaaagccaagcatgtaaaaaataaaataaataaaaatccatttaggttaatttaataaaagatataaagaatccatgcgcttaacaaaaaaaaatatataaaaaatgctaaaattagaatcacaaaaaaacatattctaattcaaaattatttcaaaagaatatttgatataaatccaaattgatttagagccttaacatctggtaggtttatgtccaagttaaagaaaaaacattgaatgtatctttatatataaatttgataatttgaatagacataaaagatttttcaaaagcattgaaaataacaataaatataaaatatttgttcgaatttttgtgagtatcaaaaaattaaataaatttataattactaggatatatgaataatttttccagttttttttttttgaaaaattcgtagaatatgttaccttataagagataaaaatttaaaaattaaaaattaataaaaattataaaattgttagaaaggaaaaaatttaaatatttataatgaatttatttaatttttgaaaaaaatttaaaataacattaataataatttatattttcaatcttacaatggataattaacaaaaagaataagttttttaatttaaatttttaatttgtttgacaaatttgagttaaaatataaattgtaataccagaaaaaaacagcagttaaattcactaatactattttgcattttaaatattatctttttttatta

SEQ ID NO: 40461 - DNA, 89 bp, Heterodera glycines
gtgctgcgcacgccgcaggactacccgcagctgtatcgcaccctggaagaggtgaagcagaacgccagaaacagcggcctgtttatggt

SEQ ID NO: 40462 - DNA, 1396 bp, Heterodera glycines
ttgcaaaaacaatataataaggataaatcattatttatcctacggtgccacctgcttgctgttgcccatcagtttggtgccggacacggacagttggccataggctggcgccacagccgaaagagcttcagagtttgccgagagacagcagaggagcacgagagcagcaagcagaacttggaccatttcgagatgagtttgaacttgttggatgtgaatttcgaagattgggtggcctttttatattcaaattggccggggattggcgaagtgatttgatgaaatatttgtttgttcactttaatgatcagaaccattcccggcggaacacaaccacaaaagtatttgttcacctttttaacattgaattcgcatagaaaattcgtcaaatttcagtacaatggcacttttcaaatgttcagcttatttatatttgaaaggttaaaaaacccgatttctttaaagcgtttttataaaatatatgtccatattttcggcattttatgtccatattttttgcatccctatagattacatttgatttttttgttttaaaattcaaaaatattcaaacaattgtttttaggaaatctgtgagtttatttaaatttttataaggtaatttataatatgaattaaaatttgcttaactcagcttcataaccacttaattaattcccctttttcctaatttatccgttgttcgatttgccaactgagacaatgaaatgtttaaacacaataaaaataataagcatttataatcgagacgcaaaatcatgacaaaacgcttggcgaaagtacagaggccgccaaaaatgtttcagtcaaaattgccggagaaccgacggttggggaaagaatggcaccgccaaggatttgtggggataaaatgtcaggactgagaacctgaaaagcagcagattaataaattaaataaagaattaagttttataaaaaagataaatgaagctttttgtcgtcgattttgattttatatttcctaagaaaataatgacttttactacaaaagctaagaaatgttttccctgcgacgccttacacaacagacggatttactctattttttaaaataatcttttaagcttgaaaaaacaatttccaccaatttattttttgggccattttattgaaatttcccccaaaaatatttttcggtttaccgtcggactgagaatcagcggactcatcgcaaaagggttaagaatattgggcgaaagaacgtaaggcgtaagctaaaataattaacaaaaacattaaataacacttaattgctttacaatgactggtgccattgccattggtgacaaaatgtacggactaagcacatagggcgacagaaatcacggcatcggtgccgcgggcgacagaatga

SEQ ID NO: 40463 - DNA, 1367 bp, Heterodera glycines
acaacgacttaagttccaccgacgtggcggtcggtattcttttaattattttattcttcggttatcaattcgcaaatgtttgccacttttcagatgatccgccgaaaaaatcgaaagttcaaaatgcgtgagctgaaggcggcgagctacgcaacgcggctgcagcaattgcagacgcaactgcagcaaatgggggcgagtcaggggacgaggtcgggcgcagatgcgatggagcaactgatgtccagctgatcggagcagggccccttttggacgcactgatttagggacgatcgaattgtccgattgtgaaaccgatttgtcgtattccctccctttacccaaatatttgtttctacttttcgcttcacggatgacttattttcgtgttctaaataatgaaaaacggacaagtatattaagcgaattgttccattatccctttttctggtccaaactttattaaggcattcggtctgcccgttgatattcagaagtgttactcttaactgagcaagataaaaaatggctattacacttttgtcttccggttcatcattttattgtttttttttgaattttgcttttagtatcgccagttttaaggatttttattatgaaagtaacatttgaccagtaataattgtgaatgtggtagggtgtaaggcgctactgtaaaagttggcctttattgaaacaaaagggcgggacccttttgttttgcaaaatttttttaagataaaaaaccatgataattttttatccggggtttaaaaggacgctaatcacgaatctgagatgaattttgactaatttctaatccctaacccgaactctaataaaaatcaaaattttgaatttctaaaattatgattttttgcgcctgttaaattatgaatatcgattaatgattaaattatgtgcacgattgccgatttttgcgattctgagccaaatatcggagaatatttatattttatttgtatcaccgctttaaattgcggcgttgatccttatgcatattctgaattatggtgggtttcaaagagaaccagcctattaaggattgcacgcggactctcgcgaattatcttatgctatttgagtcctttttcttttaacagtcaatgtttgcccgccatcttcagggctggggcgtaaatatattgctggccggtcatcatgcaaaattgcacatttgccaaacgtgttggggaaaaccttttttacatttccctttacgattttaaacaaggacgcccacagtcatgaaactgatactttgaaaataatccacgcactttacgaataaaaatagccccacccacacctgtcatttttatttggctcgtcgggaaatatgtgcc

SEQ ID NO: 40464 - DNA, 70 bp, Heterodera glycines
ttcatcagaaaagggcgacgggctggcgtacactgtcaccgacgccagccgggagcggtaaaagcgcccg

SEQ ID NO: 40465 - DNA, 691 bp, Heterodera glycines
tttttctttttcacttaaaaatcgattaaaacatataagaaatttaaaaaatcaatctttggaggtttattctaacatttttgcttttttacttatttaaaatatcgtcatttttccttttcacatgatgattttttataccatatttttgtcgcgcactttttcaaataacttttcggtaatagtgtcaggcggtgccgaaaaggaccgccggggaaaattttgaaagtttagtgtactttgttaacagatttcaacaaaaaaattaccaaatttggcattttgagctaattttttaagaaaaaattagtggttttaggagacgctgagtaaaagtgcaaattttagccctatttattaaataaaccataattatcataatatggatttttattcttgatttatatttaaaaagcactaaaaatttattttgaattttccattgaaaaatgggtgccggcggtgccgaaaggcgccgccggaaaaattttgaaattttagtgcactttgttaatagatttagtccaaaaatgacaatattttatgattttaaaaatgttagaattataattgaattcccatcgaaaaaggaataattttgaaaaattagaagaaaaaacaactacttggaggggaactgatccaaggcaaaaattaggaaccaaaccaataggacaatccactggaccac

SEQ ID NO: 40466 - DNA, 805 bp, Heterodera glycines
tcttatgtttttgataaaaaatagtgtttgttctgtcattttagtgtgaccaataatgtgtcttatgtttttgataactttagagtttgttctatgacttcattatgaaatttctttgcaatatgttaaaattaaccaaatataattatttaagcaatgaagtgtgtactgactgggctgaccattggatctcttcaaaagaataatgattttgttattggttaactgatcgtaaatagtaaaattttaaataaataataaattttatgttatgaattttattcatctgattttcatttcaaatatcttcaactttttttattttaaattaatttttaggtatttattattatggcttcaataaacgatttagattatgttcgagattatgattatgtttatgattagattttgatgaaattgaagaatgtgttgagattttagatcaagaaaatgaaagaaatattaggaattatgatgtgtttgaagagcataactatgctaagagacaaagatttgtggatggtggtcccagtcagggataaatgaatttggatgctgaggttgcggggtcatcccgtatgactgacagtcaatttgaagataggagacttgagaatttgcgaaagaaaagagagagagataggattagatggtagaataagtcacaagaatccagaaatgtgcgcttagaacagatgagaaatagaaattgtaatgcaatagcagatgaatctgtagcacaaagacggatgcgtttagaacaatgagaaatagaaattgtaaatgtatagcagatgaatct

SEQ ID NO: 40467 - DNA, 1137 bp, Heterodera glycines
taggaaagatgacagactagggaagagacataatcttagaaagagagagggagggcggaggggaagaaaacgacgagataaaaaaggatgacggctaattgggaggattatacattacgccaaagaatgggagagacattgcgtgtaaggaagtgacgacagaccgacagacagacaaagataagtaaaagcatagtttggcagagtgacacagagaaaaaaagaaaacggaacggacaaggcagagaacacggaaaaatgccctagggcaaacaaacagagcgaaagttgaagaaggaaaaacttttaaatttaaatagcgaattggaagtttatgggggagggattgtgggaaatgttttaaaaattgagaagagatttggagaaaaagcaaaatggcatggcatttcgtagaagggaaggattttgccaatcattcattcaatcattggcaaaagagtaattatcattaattaatgatcaattcgcttcgttcgcttttccgtgcctttgtccctcccggggcacgcttcttacatttagccggccattttaagcattttatggaccctcaaattgaatttcgaagtttggagaaagggagggtccttaaacattcattcgcccaattcggcgccactcattggcacttcagcacattctcgtttggcacggcatttatttacgccaaaacaaattgaaaaaataaatgatacgctgaaaaagaaacgattggtacgatgagtcatttttggcacttttcatttgcctttttcgccggcatttcctttcatttgccttcgatttgccatgtccaccaattcgttgccgcattgtcatttgtcattttgcatttccccggctcaatttgctgcggaggactcagatgtcaatctgaacaatgaatgagcgaatcccccgcccgagggcgtttcgaattgcaaagatttctttcggattgtcccggaattttcatggacaaacagccattgcatttcgaagtgaatgactcctcaaaaatggcgaaaagtgccagtttttgtaggctgaaaccacttgaaaaagaaatatatttttactttttacggcccactatttaccgcctccctccgaaaatttatcggctcatttgtcctt

SEQ ID NO: 40468 - DNA, 903 bp, Heterodera glycines
gattggcagcgaacatcggaagcaatgacatcgcaaatggcacggtaatgggaggaatgatcagtgaaatgggaggcgtcgagcagataaatgggcgacaaagccaactgaacaacggaggagggcacaaacggacgaacggactcaccgcggaaatgctaacgcaagcgaaggacagcgcccaaaggggggaaggaccaagcggcggacagaacaaagagatcggcgacaacacggggcaacggagcggcagcagcacgtcgagtcggaacagcagaaaacgtctgaacagcttggagttgggcagcacggaatacgacgcattgggtgggcagggaggcgaagacgggggggggggggggaccagcgagcatttgtccttccgaaagtgccggatgaaaaagtgcgattcggcactcttcggttggcttcctttttgattcgattgtctttcttcgtcgggaatgtccactcctttttgagtttttaagccgattttacgattcttttcagaaggcacttcctccgccgaggcaaaagttgcagaaaaaaaccatcaaaagttaaacgaaaagaatgaaacggcgtcggaacagaaacaaaacgaattattaaacggtcaaatggcaaacgacggcacgacggacaaaaaggacggcgacaacggcacagtgaggagaagaggcgaaaacggtcgtattgcctatctctacggtcagtgaccattcttcggggtcggtttttacgcctttgatttccgcttctcatcaggcatttatggagcgcatcgtgacgcgtcgacgacggcattcgccgtcactgaagaaagccacccgcggcagcagcggcggtcggcgtttgcgaaccaagcgaatacgcccggaaaccgcgacgcgagttggg

SEQ ID NO: 40469 - DNA, 829 bp, Heterodera glycines
tgttttccggacgttatcgagaagtcgccgatcaacttttttctttgcctcatctacctgtttggagctgctggcactgcgactgcgggattttacctgtttttgagggagaaacggattcgtcgcaggaatggacaatcggttcatcgacagagctctctttgagaactcggcgacgaaaaaatattttgttggcacattcccggccgatcgattgccaaagtgcaccaaatttccctgcagtctaattgtcaatttagttagtacccataaaatacattaaaatacatcttgccattttaggatccatcgggaatgccgggaaccaaaaagcgctcaaatccgcgtattccattgtatttttcgtagtgctcgagcatcacttgtgtatttcccgtcatcattttcaatgtgtcccttaacctgcggaaatttgtttatttgctgtataaatattcaatttttacaaaaatacctgaattttggctcatgatttttgcgtgcctaaattttataaaaattattactttaaagaaaaataaatattatatctattgaaataaagcaaaaaaaaaattgatttaaaaaagtggtcataaaaaaatgtgcacaatttggactgaaagatgtaatatagatcacaataaatggagaaataaaataaattttagcaaaaggaatataaactggtgtcaaattacataaatgaaatggggaaaactaattccgagacaaatcttttaatttatgacaaaaatattaaagaagtggtgtcaaatatgtgcaggtgtgagggaggggcaacgcaaagatgtgaaattaaaaatca

SEQ ID NO: 40470 - DNA, 682 bp, Heterodera glycines
  misc_feature (54)..(54): n is a, c, g, or t
  misc_feature (113)..(114): n is a, c, g, or t
  misc_feature (137)..(137): n is a, c, g, or t
  misc_feature (149)..(149): n is a, c, g, or t
gtcaaaagtgaccacgcaaaacaaatggactttaataaagagaaaatatcagcncaaaaataaaaagatacttatcaaacgcaattaaagaaatgttcgcattttgatttatnntaaccaaattatgaagacccatntagttttgcaanaatttcgtctagtcatagaaaatttttttttttccgtagtacaaaattttcggggtcgcttaatcacgaatctagcatcccatttgacctatccgattccgaactcagaaatttaaaaactttgattcgcacctttaaaaaaaaattttgtaaaccaaatgtgttaaattttagaaagcatatctttttaattatggccgcttatcctacacaaaattcagcaaaatattcaaaaacactcaattcaaaaaactgcttaattaaacacgacgacacaccattgacgaaagcgtttccagcacccagaagatgtctccggcacactctcttctatttcatctgctgttgaagccaatttagtgacaggtggagagcatttccccagcattgtcgatgaatttgtttctgcattattttttattattggcatatattgaaaatataatataaaattttcaatttcaatcaaatttattatattaacgaaggaattaattgtgcatgaaaccattcaatttaaactgaacatttga

SEQ ID NO: 40471 - DNA, 1393 bp, Heterodera glycines
atttttgagggcttttaggggaaaatccttcagactctttaaaatttttgattaaattggcattatgtttggcaattaaaagaattttttaaatgaaaaaatatgctaaaaatatggtcaaaattcttaatttttctcccggcgggcgcctatcggcaccgccggacagtaaaaatccttaatttacaagcaaaaatttgctcaaaatcgcaaaatttggtcatttttcggacaaattctgttaacaaatcgcattgaaattacaaaatttttcccggcggcgcctatcggcgccgccggccccccgtgcgccccaaaagttttttgggaaaagcgccgcaaaaaaatcaacttcgtttttctttataaaagtaatcgataaaggacatgaaaatgtcaaatgtctgatttgatggttttttgactaacgccccagcaccatttaaattaacaaatatttttaaattatttaataatcaatatattttagttttttaaattaaataatattacatatttgctatttattattcacttggggtagtgatgttgcggctgcttcagcctctgtccccttttccgcctttctctcattgtcctccaaatcgtacaatgccaaaatggtcggtgacaaattccccccgtttttttcttcctccgctgcttctggcaacaatggcacaaatcgtgggctcatcattttgaagttcgaattggcgccgcccgtcgcgcttcgcaatttgttcagtaattggatgcccatttttagaattccactgccacttttcttaattttaaaataataattattatttaagtatcttaattagggtaaaaattaccgtactttttcttttggcccaagtgtaggttcgttacgcgcaagcaccaacttcatacattcgcgtctcataagcacctaattattttctgtttttgtatatctacggatttactcgcgcgacaacatgccttacccgtttctgatcgtcaataccaacaaattgacgacgatgaatgataatccgagatggagtaggaagaaatggctcaagcggagtcggcggaggagacttacgagcatgcaagtgagtttcaatcattttatttataaaaaaatatcaaatattcaatttttagtggacttctactttcagttggacaattatgtccaaatgtcgcagaatttgaccattgatgaccaacttccgccgggatgggacgcaacagcagaagtgcgagtttattgcgcgacgccgacagtggaagcctctaccccagccgggtggaccatccatgcggtagcttcaaatttcactttgctcggatgatacaggggcatattttgaacagatgaatccttctacggatacaagtacaatttttaagtgcc

SEQ ID NO: 40472 - DNA, 801 bp, Heterodera glycines
tatataaattatttgcttcctcttacaggccatggctttctattgacgggttgattttccgcgcttcgttccacgaaagcggtcacacgcttctgctgtatctgttgagagatgccgataaacacattagagtaaattgttttttaatttctgttttatattagcattttcaatactgttcacagtgtaaatgggcttcgaccccccccccccccccgcgcagtggtgcaccccaaaatcacgatggccgaaatcacgccgctagaaattaaaagattttagaaaatttctagaaagaattttttgaaaaaaatcgaaaaacggtaatttatcatcaaattccaaaaaaaaatcgcttaaaatttttgaaattttcatattttttccttgaaaaaattattttgaaatttttttttaatttctagcggcgtcattttgtcctagcgtcattttgttctgttacccctgcatacgtatgtccgtagccagaaggggaaaattcccaccgctcccgaaatgaaatatttttcagtaaaaagcgacaaacttgaaaaattttctgaataagtgtttgtatttcaagaagtatttaatgccaacgcctatcggcaccgccgagacttcattttatgctatgttcgatctaatttgaatatttaggtggattttatgatctttttaaaaattttcttcaattttctcaaggaattccctcctttgtgtgagggggacgggggataagatatcaaacaacaccccggaattataaatttttcgagatgtcttagaaattcctttttt

SEQ ID NO: 40473 - DNA, 1038 bp, Heterodera glycines
atgataatgaggataaaaaagataaatttgtgagtctgacagtgatttttggttaatctttgaatgcctaaatttcggtatattctttttttgaaatgaaaaataaaatttaattatttaaatgtgtttccaagagcccatcaaattattcaaaagtgattattaattttgtgttgattgatgataatgaggataaaaaagataaatttgtgcgtctagcagtgattttttggggtaatttttgaacacctaaatttcgctatttattttttttaattgtaaaaaaaattttaattttttactaattttttaaatgtgtttccatttttaaactaaaaaatttacatgggaatttatacggaccgatgagcttatacgaaaaaagaaagaaaccttttgccatttccaattaacgcaaaataaaacgccattaaacgggcgtaaaattgccatatttggacattttttaggggagagggaatctgccggaaatgtgtgaaaattggttcttatttaggaacgggattaattccaaaaataaaacggaattataaaacaaataaaaagggaataaaaataaatttaaggaataattttaatttaaaatatattataattgtatttaatacaagaagccggtttttttattaggtatattattgcaaatcggtccaactttttcaaactttaacaaaaattcgcgggaaattttcacaaaaatttatgcaatcgaattgaaagcaaaatttttaaggtaccgtatccaaagacaataaataccatagcaattttgaagatgtccatgttaaatgattttaaaataagcaaattgaaagagaaaaaaaacacagagaatgataacacgacattactgtaattctgaattacagtatgtctaattaaataaacacaaaattttaccacttcttttttctttaatcaaattaaatttcatgttttctttttttttttataacatttcacccattttaagcaacatggcctgatttttcatacatactcactcatacagatgca

SEQ ID NO: 40474 - DNA, 1623 bp, Heterodera glycines
atttcgaaccgaccgatcagcaccaaacgaatgccaacttcaagggccgcctctacgacggccaaatcgagcccaaatttttcatcatccgcatggtgaacgtagtgaaatctttttgaaaaaaccaaatttcaatttttgaaaaatcaatttgaattttttgaatttttgcaaaatttgtttgcattattcgtcgattgactcactcactcgccaactgtggtgatgccagctgacagcatttcgcgaaaagtgccgacgcaaatttgaaattgtatgcaatttaagtgtgaaaattattgaatgccaaaaaattcggcaaaaattcaagaaaatcattgaatttctcgagaaatacaaaagtctgggaggtaaaatgttcacttttttcatccgcgcatagtcaatgtgccgcaccaggttgtacatgtcttggcgccatttccaaaaattgttggtcccttggccaccgatttgggaccggcctcgcaaacagcggtgaaacgcgtgcgaatgtgcgttcacaaagccaggcaacagggcctaacaacaaattcgtagttcgctcggttccgagactcgagaaaggtttttttttagatcgcagttcgttgatcagtgatattcatttcgaaaaatttccgaacccctggccaaattcgaacaaaaagccgaataataaattttttgaatttttcatttacatccaaggctgcatggaaagataataatttatgcttaatgccttttgaaatattcttgagtatttaaatcatttctaagccaaaatgaaatcggaaaattccctgggttcggaaattgttcgaaatgaattcatattctgatcagcaacccccgaagtctttaggcattgtgacttttcgactcaggaaacaatactcttgagcagtcttcgaaacctcaaaaaccgggaatttctcgactcgagagtctcggaggcaccacaaggcacctaccgtattgtccaggcgacagtatcccgccgccattccgtcgtcgcactgtttttcagcttcgtgatgcccttccattatttgcacaatttttcccttgtcatcaattttaagatggacattttggcgaaactgtccgtccaaccaaatccatggcgccgtcaaaattttgccccgaaaatccactaacattggcgcaatttttgaaaaacaattttgggtggcaaaatgtattattaactctttttataagggatgattatattaatttggttgcaaattacctaatcaattaacctttaagtgattgattaattatggaaagggcgtctgatgatcaatgaatgaatgcattgtgggttaaaatgatttttcattacgtaaaaaataaaaaattattaatttttgctgaggtcagaaccgaaattgaaaacgttgaatgatcaggtgagaatttggtaaatatatatatatatatatatatataatatataattaaataaataaatatatttgggttatttttatttaaaaatgataaaatagtaaaaaaaaaattggccgattgcaagcagttaaatcaggcagaattgtatggtaattttaaaaatatgattatgataatatggcgatgaatagaagaacaaaa

SEQ ID NO: 40475 - DNA, 902 bp, Heterodera glycines
  misc_feature (812)..(813): n is a, c, g, or t
  misc_feature (824)..(824): n is a, c, g, or t
  misc_feature (831)..(831): n is a, c, g, or t
  misc_feature (850)..(850): n is a, c, g, or t
catcgtgtttcatcactttggcctatttaaccatcaaattattatatttgtccaatgtttttgcgcagctttactttatgatcaagtaaaagagaacaacaaaagtcatttagtcaattaattgtttattaataaataaaataatcaatcaaattccaaattaatttaattgtttattatttccaattttttagatttcttgaaactgaccgttacaattggtacggattgggtgttttccttgacattatggccggcattccctggcaaacttcgggctattttccgcgcgtttcgctttgtgattttaccgtattatttttaatcaataattattttatttttaattactaaatatataatattttaattttttaggtccgccaagtcgcaaacattcagaaatattctgtccaatgtgttctagtaattaacatttttaacgagtaaaatgccattgaattggatggcattttctttcattttccaaatttaggaaaattttcatccttttatggttttggtacgcccttttgctgctggtcacttccatttccttcatttattggtcccttaaaagcgtttctcttctgattcttccattgttttaggcttacaatgctaattttcccccaatttggccgttggtatgtggcccaggcattggagcttaattacctttacccaaaagtcggacaaagacaaattgacaaaagtaaatgatgatgatgatcatccgtttgggttttaagaaaccatttaaaaattagtaacctttaggggagccagggtattttaaaacatttcgtcgnncgcttttctcnggcccgncggcgtttttgcgcttcgnttggttccgtttttctgcccatttaaggttttttcttgttttctcccttttt

SEQ ID NO: 40476 - DNA, 883 bp, Heterodera glycines
gtcgctgaacgcgaatctaacatctatttcgaccaatttcctaaacccggacccgaattcgaacaaaaaacgaaagttcaaattttcgatttttcatttcgatataaaacattagatgatcttttattgtagaagtgatagattttagttgtttccgtgtgtttaaaccgattttagaccaaaaacccaaaattcgaaagtttgaactttagatttttctgtaatagttcaggtccagttttaggaatttggttgaaatggatgtcagattcgtgatcagcgatcccgaaaaaccctaccccgaaaaccacctagaatttttatatgattaaaaaaaaatttttttgggtggctaaaccatataagtacctgataggtatgtggttttttacccacgaaaaccaacagaaacacgttttcatgaaaacaagcctttttcaaggttttcacaatctaatctgattaaattgttggcctcaaaaatactaagttatctcccgctcccgctaaccttttttgctccgcacataattttttctcctcattcaaaaaaaatttttttgttttttgaggctagagtgtcaggctggaaaattttgatcatgaacatttttgagtcatttaaaaaattcaaaggaaattttgaaaaagattttttagattattcaaaaatgagacaagttaggttaggattgccagtcaccgcatagttctttttcccctgcttcaatggtgcagcgggagggcagggattaatgttaatggttgtgagcagggacagagctggtcaaatgcattaactgcactatttgttcgatttttaataatttatttagctttaaaatctgctaaatttcccccgttttgttcttctttgccgacc

SEQ ID NO: 40477 - DNA, 1342 bp, Heterodera glycines
cggtcgaggagtgaaaatccaatgtgacctccgcttgtccatgtgacatcatggcattgtcatcgcccggaaaattcaatgaagagatcggcgtcacataaattgacaacgcgaagtgacggaaaatcgtagagaaatgatgggatcaatctgcgcaagcggcgatatacatcggaaagcaaaaaaatgccacaaatgttttctgcgaagatgggccaaatattgcgtacaccacggcgaaaacgtcctggcccgtttttatgtagcttaggcgacatttcgacgcagcgaaatttcgacgcggcgacattttgacagcgcgccgggcggtgccgtcggaaaaaattttgaaatttgaggcattattctgtacttggggcccaaacgaccccggggcccaaaaacgagggcccaaaaacgggggcccaaacgcgggggcccaaaaacgagggcccaaaaacgggggcccaaacgcgggggcccaaaaacgggggcccaaacgaccccgggcccaaaaacgggggcccaaacgcccccgcatgtcgattggagcgtcagaacagaaatctgccaatttaaaaaatggcacttttcaccgtttccagacatttgtgcctatgtttaaaatcggattcaaacactgtcatttgtgtaattttctttaaactaccagggactgaaaaaaaacttaagtttgaacccaaatataaaaaaatggatcacttttggaatttctgttcataaagacacgggatgtttctaatttttacaccttttgcgcaactattttggcattttgtgcgtttttagttttttagcacatattttcactttttggcaactatttaccgtagaaacaacttctaaatacgtaaatctttcgaaaaataatattaaaaatagtgtatagaaatgaaattctctgtcgctatttttagcgactgccaaatgtccttatgtatttttgtaagatttgtccctatttcggcttaccgatcgcaatttgttgttttttcttaaaattactcataaataaaagaaaggtctcaaaattgcaaaaattgggtcattttctggacaaaatctgtaaacaaagtgcactcaaattggctctaatgctgttgtttacccgtctaatcgacttttaaatcagtgaacgtcctccatttcttgaaaaacaaaattaattctcatcggaaactgtttgttgattgataaatgagttagattttttggctctttatccgatgttcggatgggaaacataaagataaaaaaatttgtttaattttaataaaataaaaaatttatggttctagtcggttttatgcgccccatgaat

SEQ ID NO: 40478 - DNA, 987 bp, Heterodera glycines
caaattccccttcccccccgtgtctcgcctatctctgttctgatcaagatcaaatcactcgcattccctctgttgatcacttttcgtctttgtacgccctcgccgagccgatcacttcgctttgcttctgacccatctgacccaatccatcgtttgatcattttaattatttagcgtcacatttatttattcaataataaaaatattataaattttcaaaaaaccaactaaaaatggaagggacactccaaattgaaaaagttttcaactttaaaaaaataagtacatttttacattaacgttaattgagggtgactttttgtggttggacaacaaaaattacgggagcgatggcgttgcgattggcgcccgagttttatcagttttttgtgacaatcgaacggcgtcagaggaaaagcgcattttgttaatggacgacgagggaaaagtaaacgaaaaaatatgccaaaaattattattaaaaagatttttttaaactaaacataaaattaaatttaaaaaataaataaagtaatcattagaaaccgactaaaaaggcaccaaaaatcacgaaaaagtcactataataggcaccaaaacattgaaaagaaggcattaaaaggcacgaaaatagacatttaagatttttttattaagaattttaggaagcaaaacacgtaaaactaaatcaaaaaaaaccaattttggtgttcatttaaataacgattattaatatttttatatttgtattagatgtgtattttctaaaatcttttcgcggcatttcttaggggtatatttttcttttttattacatttttgtaaggaactttttcggaaaaaaacgccaaaaaaggcaccgaaacgcaaaaaaggcataataaaagttcggagaagcttcaaaccaagtggaaaaatgtgtttttaagcttaatatatcggaactaattcgcagaaaaaaggcatatgcctcaaaagtcagtctct

SEQ ID NO: 40479 - DNA, 880 bp, Heterodera glycines
tttttataatcattttttatttctcattaatttttaattatcattttagatgcaattaaatcgttagtttaattagttaattagaaattaatttaacaaaaagattgatctggatatgtccattgatgataaatcaccattttacttccgaattgcggaccatcgcctggggcgttgcgcgccgccgcggcagagagcgccgccgccgttggcggcattgggtatgttttgcaatggcattattatttttttttaaattaaattccttaaatttaatctctccgggggaataattagggattaaacggtaattcattaatttgttagacagcagagcgagtgatccaccgacgactgccgggccgcgaatggtcgccggacgcttcggcgcccatggatgagccggagctgaaggcggccaaaccgcagcaggcgtcggtggtgtgattggtcagcccggccgtggacgacagaaggggagggatgggattttctgatcaggcccgtgaccaggggggaggcgaggcgaggggaagtcagttggccaccgcccccccccccccccgaaaagagaatatctctttttttacagaaatatatacctcacaaaagcgcttgcgtctgatatcgaagccatatgcacaatcgccattttatttcacaggaggactcttatatttacaggttatcccagaaatatggttatctctttttttgataaattttatacacatacatatgctctcgagcatgatagggagggcggtgcgcaatttaccttttatttttgagggaatttttaaatttatactctatcccagaaaaatggctatctctttttttgataaattttatacacatacaaatgctctcgagcatg

SEQ ID NO: 40480 - DNA, 455 bp, Heterodera glycines
caaccccaaatacagtccaaagacatatgtatagagcaaaaaatgcgtgtgaagagctaagcgaaattttggaagaaattcagagaaaacgcgtagaaatggcagagtttgcaaaaaaattgcagttgcagcgcgcgaaaataaggaaagagattatgtagacttttgtacacagcttgacattgaggcaaaaattaatcgagcagtgattaagaaaaatgaatggcaatacaaaaaaagaacaattggaagatgtttttgacataaaccctcaaaattcgctaaatagcacaattcttacactccaagaaatcagccaatcaaaagagtgaaaattccacaaatacaattgaaaaaatttgatgggtcagttgaaaatggataccattttgggagacattcagagtacatgtccacgaggatgattcggttaccaaaattgaaaagcataattt

SEQ ID NO: 40481 - DNA, 1044 bp, Heterodera glycines
attgttttgcaaaaatttttttgagataaaaaatcgtgaatatatttttattcgccataattatgctgttaatacttaatattcatcattatgtgtcaaaaaaacaaaaaaaaatttttccaaaaaaagtgaaaaaattttcaaaatagtgctctttgcaagtagcgcccaaattttctaatttagcatttttggttcaaaaacagcataaatgatctcttatgcagtattgatggcttatagtttgtttccgtgtattaattaaacagatttttaagaaaaaatctaatttcgaaattttgacttttcgattttttgttcgagttcgggtccggggttggaaattgagaacgattttcttatagaagtttagtcctatattacaatactaatgccatagaaatttattttaaaatatttgtatcactgacgcattttccaatgaccgattcgcgaaaagatttcttagcctttaaaaaaaatgaagaaaaaacttcaaaatttcgaccttttcgattttccggtcacgaatcaaatgcaatcaatcaataattagtcaatcgtttaatgaacaattaagtagctcgatcacctccttgaaagtgttgatccatgttatttcacaaaaataagcacagcaatacaattcattcgcttttccatttttgctcggcgtgtgcaaccatttggacaacgcttggccggcagttgcttttggcccatcgtcagaaattccatcgggtaacagagcaccagaatcaattgaattcaattgatcaagatcagtgagaagtgtcggcgaagtgtgacgacgcaaattgtaaaaatgattggcattaggaaagcacaaatggcgaacgtttgtcgcaaaaataggcaaaatttcgcgggtaaaaacatcccaaattggttggacatccgtatcaattgaatgcacaaacacttccaatttggtgccacttttgtcaaagaatcgctttttggagcggagaaatttgatcacggaatggtcaatgtagctgaagaaagataaaaatgctttag

SEQ ID NO: 40482 - DNA, 764 bp, Heterodera glycines
aatctcctcaaaccgtttcagaattcaataaaaataccttccccggtgcaaaaaaggggttttgaaaattttattgggaaaaaaagactttacaaaataatacccctgggagaagggagtgggaaacatgatttcaaaattttcaattttttctagtctaatctactcaaaccggttcagaattcaataaaaatacaattcacggtgcgaaaaatggggtttgaaaagtttattttgaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgaaaagtttattggggaaaaaaagactttacaaaataatacccctgggagaagggagtgggaa

SEQ ID NO: 40483 - DNA, 1092 bp, Heterodera glycines
  misc_feature (109)..(109): n is a, c, g, or t
  misc_feature (124)..(125): n is a, c, g, or t
  misc_feature (127)..(127): n is a, c, g, or t
  misc_feature (1051)..(1052): n is a, c, g, or t
tttaattaaatttaatgcaagtatatattaaacagaaaataataaattttcaatatttgtaattttcatacttaaaaaacattatcataataaatttaatttaaatganaatggaaaacattcnntntaattaatgatcaacgtaagaaatgcatagccaaaatactcagcagtataaaagtgtacaataaaaaatcatcgtaattatcgtaaagatattaattattttattttttctataaattccaaatgtttgttaacaatataaaaatatgtttttaaaagtatataaatatgacaagtaaatacattttttatgctatctatattcgaaattcatttaattattcttcattttcccgcaaattgatttgaataatttcacagactcatacgtgagagagtgaactctaaaaaatttttaaaaaataaatttaatttaaaatatttaaacaatttgctatttacaaatttttaaataaaataacaaaataattattttgaaaggagataaagccgacaaaaatttgtaatttaaagttataaaaatgaacgatttcgtaggagaagcgatgtcttccttacactattaaaaagacttgaaagcaagaattataaatgttatttatttatccataataaaacatattaaaattctaaagcctaaaactgcatttttaaaacacatacaaataattatatgtcaaaaataattttacaaataaattaatatgaaagaaaataaaaaaacaaaaataatcaaaaacatctttttatacactcttgaaaaaatactgttaaatataaatatatttgcaaatacgaactttattaaaatataacgagtccatagttgagatggaaaacgaaagttaataactttttagaaattaaaccttacaatattatcttaaatttaaatacaaatcaaaaaattttttataaaatctaaatatttgctaaatattataatactgaatggtgaattattgagttatttcaaattagtagaggcgtgccgtgattgaaaaaaccgtgataatgaccgtgnnttgtttatttctctggcgccgaattttttaataagttttg

SEQ ID NO: 40484 - DNA, 831 bp, Heterodera glycines
cccccgccacgccaacgattgctcaatgacaaatccatcattgtttccggatatcatttcattttttgccttaactattttacgattttggtggtactcccgagaggaagaaaagttaattaaaaatgttactaattgttgaaaaacagttgagtaagttaaaaaatagagggaggagagagaggggggaggggaggaaagaagggaagggaataagggggagggaaaaaggaggagaatgaggagagaataggaaggaatggggggggggggttaaatggaaaagaagcggccgattggctgttcttctgttcgtcctcctttgcgccgacagtcgtcgtccgtccacccttcccttatcacttccctttgctgtcctttccgatgagtccccaaacatttgggcactttcttctgacatttttagcttttacctcgggaattggaattatttcacgataataaaaaagaaaatgtgtgtcttcatttattcgtttctttcgctgtaatttcttagaatttaaaaaagggaaagtgacgcggcaaaaacaatgaaatgaaaaaaagaaaagaaaagggggaaaaggggggggggtaagaaattggcgacatgaagtttgggcaccgggaagtttgggcaccaggaagtttgggcaccaggaagtttgggcaccaggaagtttgggcaccagaaatttgggcaccgggaagtttgggcaccagagggagggatttcaaaaaaataaaacaatataaatatataaatgttatataaatcattaaaatttagtaaatttaacaacccttgtgctcaaaaatttctatgttctt

SEQ ID NO: 40485 - DNA, 1316 bp, Heterodera glycines
cattatatctgttaatattgcgaaaatttaaagcttctccatcaccagttgacaaagcggaagaagatgaattcttggaaaaagattatgcagatccaaaaacatccccaccaatacacaaaaaggcccacaaatgaaccttgaaacaattttaacatcacccttatttttgtatgtgatgattgatcggaattgtttggattgaaagaataattacccttttcaaaatgcaaaccaattaaacaacatatttcgcttttacatatttatttttttattgttttcgggatttttctatctctatgattattctgttctaatttgtgctttttaataatttcattttgctttatctgtggtaaatgcattttaattaacgataattgagtgtgaaaggttcaatatcaatgactcaagaaaaaatgacccaaaacgaaacattaaaaacccaagaataattggaaaagaaactgagaatctcgagtatcataattgaggtggtttgtttgtgcgataaagccttcggttttacttataaatatctaaatgaaaaaatataacaaaaattagacgaaaacacaaaaaagataaaaaattagactaaaaacaatcaattttgcatatccaacaacaatgttaaaattataattaatactaggcctaccactacgggggaaaattcgggcgatcgtgaattaaatttaaaaaaaactttaaaaaatgaaaaaagcaatttttgatttatttagaataataagatttgaaatattttgttttatttatttaattttatatttcattcttgaaaatttttaatgaacattttcaaatttcacttaatattaatttaacgcgaattttgccttttttaataaattctcttgtgaaaaggcaaaaaataggcttttttaaatatgcctatttaaattactttaatttctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttataaatttatttaaattttcaattttttttggcttttttcaaaaaattttgtctattttttcggcaggcactgcctctgaaaatgttttttatttatttagaaaaataaatttattttttttctttttgattattttaattgtatttcatcctgaaattttttaataaacattttcaaactttcaccttattaatttaaggcgaattttgccttttttaataaattctct

SEQ ID NO: 40486 - DNA, 1175 bp, Heterodera glycines
  misc_feature (44)..(44): n is a, c, g, or t
ttattgttagaaatttgtttccagaattttattaaaaaaaaatntcgggaccaatgaaccgaaagattgcccaaaacattttccgggcgcctcataatagaaatattggagctctttgtattcaataaatttacggaaattgtgcataaaaaccttttactctagaaaaaaacacatttaacattatattttccagggaatctgaaaagccctcctctgacagagccaaagtcatcagttcgtcgtccgccgattcgcaacacaagcgacgttcgtctcacaccaaaaaacacctgccttccccgccgcctgtccatcgcgatgcttttcctcccgccaaaaatccttccccgtcgcgcgctcgctcaccgtcacgtaacggtaaaagcggagacgctaaacggacgccaccgcgacgaacgcatccgttgccaccaaagacacacggcgaacgcagcgtaaatattaaaaaaaacggaggggttgaggaaaataaattaaaataatcagaaaaatggcaaaattgaaatgaaaaaacaaccgaaaaatgcaatgaaagggacacaaattggaagaaaagagacggaaaaacggaaacaatttgggaaagataagcagaaaaagagtggcaccaaagaaaagcattttacggtaatttatgagcaaaatatgatataattcaaatacactggtaattaaacccttcattagtctaaaagttattcgcatggaataaggaaaatggcttttatgaaaatcaaccttattcgcattatttcttttatgacaattttgaaagtttattttatcactttaccaatgtttccatttttccacagatttcccctgccgccgatcgcaaatccgtcgttttgcccagcaaaggtccgccagcacttcgttccgtcgtctctgtgcctgtccaatttgtgcccaccacgcatccccgcgtccgtgccgtcgcccgttccccatccccgccgccctctcccccgcttccgtcttcttccccgctccgtctgtcggtcgcatcaccaaaaataatgcttagcggcggcgttgtgcccgtagagacggcagcaccaaaaagtcataaaagaattgtcaaccaattggacatcgcagccgtcggcaaggaagaaacggagaacgacggccgagggaggagcaaaagc

SEQ ID NO: 40487 - DNA, 801 bp, Heterodera glycines
gtgattagaagaggtacaacagtcattagaagaggtacaaaattgttagaagaggtacaactgtgattagaagaggtacaaaagtgattagaagaggtacaacattcattaaaagaggtacaacagtcattagaaaggtacaaaagtgattagaagaggtacaacagtcattagaagttagctctggttaaggagatttggaattttttaaaaaatatctgggacttttaggccgcttcgcggcctcgaacgggcgcttcgcgcccgttttttaaattttgttgggcttatacgggcgcttcgctcccgtttctaaatttgttgggctattaaggcagcttcgaggcctcagacgggcgcttcgcgcccgtttctaaatttgttgggctattaaggctgcttcgcggcctcagacgggcgctacgactcttacctcagattgaagtgaacattttaaggattccgcgaaaaaaaaacatttggaaaagccatttttacaagaattctagagatcggtattttgaaaggagccccgatatttgcggtcccgacatttgtggcccgacatttgcggaccaacatttgcggccccaacatttgtggccccagacaataaccgacatttgcggccccagccaataaccgacatttgtggccccaatcaataaccgacatttgcggtccgacttttggggcccgacattagcggccgatttcttaagggttatttccccgacactttgcggcccgaacatttgccggcccccaaattactccatttaaaaatttaacaaaaattaa

SEQ ID NO: 40488 - DNA, 1236 bp, Heterodera glycines
  misc_feature (83)..(83): n is a, c, g, or t
taaatcgtccgttacgctttcccctcattttcctccatttcttggcttttccccttttaatttcctccccaattttcacttgncagcaatgcgtttggccgtccctcgcactcgtcgcgcagcgttccttggatcggtttttgcgccacattcgcaccgccgggttgcgcggttcggagcgcgtgaattcgtatccgtcggggttcagacagggcagcaccaaaatgtcgactctctccagacatttgagcaacctttggtcattcccaaggcgaatttggttggcaaagtaaaagatgaagtaagcggcggtgtgcacctgcggaggcgaaaacaaaacatcaaacagccgatgctgtgcaatgttcttacggctgtccattctctggcgtggattcccgcgtcgatccaaacgacgggccgacttttgtccgatggattgccaaactgccaaatgaatgaatgaatattaaataactttcatccccccccccttccaacgactccctctttcatcccttccctccgttcttccccctttctccacctgaatgccctgcagcggccgtccctcggccgtccatccgatggtgcgcaactgtgccctgctcggcatcgcgttttgcacattttgcataaatgccaacaaatcagcgaagctgtgatagtcgcccatgcgtaggccgaacccctcaaaacgatcgaaagtgtcgcggagaattggcccatttttggacaatttggcgtacggagaaggcccaatttccttttcttcaataagtctaaagaaatgtaagaaaaacttgccaaaatcctccaaatgatttctcactttgataaatcgtctaccaacactttgaattcgacttggaatttgcgtaaaaagtccaaaaaatgtcttccgttgcgcaaaacatcgaccataacatccccagaggaattgacgaagggcggcggacgccaaaaatcaatctgaaagtcttctaatcacccattattaaaaagtcaggcactcactctccgctcccaataattcattcgtatttatcctttccccaaccactcggtccactttccccaattttcgattcacttcccctgcacccttttcgccaatcaatttcccctaattcaatctccaatcacttttctcccctcttcactacacttttctccgccacttttttccccaaatccaatcacttttccctcactcacccgcccccttgctgctcc

SEQ ID NO: 40489 - DNA, 228 bp, Heterodera glycines
aaatttttcaaaaaatccacaaatttttgatgaaaatctgctaaaaatggctcaaaatttggtcattttttggacaaaatctgttaacaaaccgcatttaaaaccgtaaaaattttccctcgcggcacctatcggcaccgccggaccccctgtcccccaaaaatttttttggaaaaaccgcgccacaaaaaaaagggtgtaaaaaaaaaaaggtcgtcgcccggaggg

SEQ ID NO: 40490 - DNA, 238 bp, Heterodera glycines
tgcggacatctacatttttgaattgaaaaaaattggtaccttttctttctttttctccacattgaccatcatactcatattctccccacccttttcttcttccgccacccacctccctctcttgatagtttaaactgaaggcgggaaacgacaatccgatccccatcaagctagcttctgcaggtcctgctcgagcggccgcccggggatcgatccccgatctagtaacatagatgac

SEQ ID NO: 40491 - DNA, 1039 bp, Heterodera glycines
  misc_feature (1008)..(1008): n is a, c, g, or t
atccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgcaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtcaaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatgggtacaaaaaatacgggtccaaaaatgggtgtaactccgcttggagatgcgttagaaaagagagaaaaatatgttcggacagcttttgaagagctgcattgaatgctgcagtcgccgctgctgtacgcccacgcgttgctgagatagggtcgagagcggcatgagaanagacaaaaaggaggaaaatgagacaaattcg

SEQ ID NO: 40492 - DNA, 975 bp, Heterodera glycines
  misc_feature (19)..(19): n is a, c, g, or t
  misc_feature (43)..(43): n is a, c, g, or t
aaaatttgagaggggctantttatatgtaatattcgaaagtgncaagataattagcgattcatgcgcacattgaggctgaattaagccattttccctttgatcggtacaaaattggccgaaaaagagatagccattttttgaggccagaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttcagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagctatattctgaggcccgaaggaaaatttgagagggctaatttaggggggatattcgaaagtgccaagctaattagcgattcagg

SEQ ID NO: 40493 - DNA, 938 bp, Heterodera glycines
  misc_feature (31)..(31): n is a, c, g, or t
ctcagaattttgaaaattttttataaaaacntgatgaccactcttatgtgataaaacaggttaattcttttcctttcagtatccctgcaaagtttggggcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactggtcccagcaccccccccaaagcaaaaacaatataaccaaaatataaggaaaaattttttcctcccacttccctttttgatactaa

SEQ ID NO: 40494 - DNA, 1582 bp, Heterodera glycines
ccttggggggagagggtgaaggggaagaagacaaagcagtagtagaaattggagaagttcgggaagaagaagagacactccatggagatggtcctcagtggtaatgtccgccacttttgcccgcctcgacgaaatatcctggcggagtgcgcggctccggacagtggtcgcagctgcccttctcgccgtcttggccggggggtccggaaggtcccttcggtgtttggttcggtgagaaacgcgtgaaaacacttacagttcctccgggacgcccttctcgaccaggtcgaccagcatctccagggggtccgggaggaccttcgaaagattgtccgtcgggcccgggctgacccttcggtctgaaaaagaacataaatggtcaaccgtaagacacaaacccttgttctccgggaggtccagaaggcccaggcggtccttaagatggcattaaaatgataataatggacaattccttgccttgcggtccagggacgggaatgagtcgtccgggctgtccgggggctccacgcggcccctcgcggcctgggcgtccgacaggaccgggctgaccctgcattccctgctctcccggtactccgtctttgggcggctctcctgggcttcccttcggtcccgggggtcctttcggtccggcgggtccttggggaccggcgggcccgggcgggcaaatctgtcaattagtcacacttatcacagcacgcactttctgcccgccaatgcttacgatgcatggctcttcaagaggtgctgggatggactgcgcgtccctcccgggggctccgtcctttccgttgtgtccatcgtctccatccgccccggcggctccctccggcccaattggtccgggagggccctggtgacaagtgcctaagtccaacgtaaagaagagatacacatttttttaactcacaacagacgggcgacacttcgggagcttgtaccggctgatatccggcggctccttgcccatattgtccacctgccggctgagatgggccagcagaaaccgcggcagaagggccagcgggcacagccccgacgggtgccgaagcagaagacggagcacctcccgacggagcaccgccggatggcccacctccttaggggagcgaaggtgacaaatggaaaagaaacccaaaaaagcccaatgaaggctcatcagtcgagtgtttacccgcagcgtaagcatcggcgccgctctcgggcacccattggccgaacaaccagccccttttgatgcggttcacatgtcccttgccaatttggagggcggtcatctccagccacatgtcacgagcacgggcctttaaaaagtgcgagtggtctttgaacacttcgaaaagggcactttgcagtaatccgtctcaaccatcagatgactttggaaggactggacgtaattgtaaagcattggcaaagtaacgacggaagcaatcacagcaaccttaaaagagaatttggtaaaaattgtccgatttcgtcactttttcgcaccgtcgaaacaacgaccgcaacgaaagcgatagggcgcatctgacggtgctcatccgtctctttcatg

SEQ ID NO: 40495 - DNA, 690 bp, Heterodera glycines
accatgacgaaaacatgtcgaataatttttggacttttttggcacaatttggctgtcttaaaacagcaaaatttaatgaattttttttgcttggataataaagaaccactcacaactcttaaagctattgaatggataataaaaagatttgcactcaatcactcccacctcataaatcatgaccaattcctgatcagcttcaaatgcatcatgcaaattgatcaacactggatggagcacttcgctcattgtactgcgcagtgaaagctctaaagatacatacaattcttaaaaaatgaaaataattttttttctaattttacacgtatttctagaaaattccttttttaaatatctttatcattatgtctccgattcaactgttgaattatattgttattattttgcacgcacgaaatgcttgttagcttaaaatacatttgcagagccttatgcaaccgaaaaaatatttttacaaaaatttttacacagagagacaaaaacttgaaacacaccgtatctcactgcgtacaggatgcctctcctgatcccctcctctgatcggcacaaatttggccgcatacacatgccccgtgcctttctccacacatcggtgtaccatgccaaacgcgccggtgccaatctcctccaacacggagtattgctcgtacactgatgcctttttgattt

SEQ ID NO: 40496 - DNA, 216 bp, Heterodera glycines
cgatgaatgtgatatatgcaaaaatatggggggggggggaacgagttttgtgtccagccaaagcccaagcaaaggcaaaatatgcataaaaagagattatgcgtgagtgtactatcggattgccgacgaccagcagaacagtcagccgaagaatttggggaaaattgggggtgatcagtgggggggggggggaaagaagcagcaacagcagctgat

SEQ ID NO: 40497 - DNA, 1021 bp, Heterodera glycines
aagcggaagaagaagacgaagaagaagcggatgaagaagacgaagaagaagcggatgaagaagacgaagaagaagcggatgaagaagaagaagcggatgaagaagacgtagaagaagcggatgaagaagacgaagaagaagcggatgaagaagacgaagaagaagcgtaatcagcggaagaagaagaagcggatcaaagcaactaaatgtacagaaatgattaattaattatatttgttgaaatgatcaatctcactaattggaatttgatttgatgctcattttatctcagaaatgctttgttgattctttcgttcgaattcatatatatgtatattattttaaattagggttgcgactccgaaatgtcgggattttatgaaagtcgtcatattggattttttgtaggtatttatgcattttttctgtatattttgtgtaaaaaaagaagacgaagaaaaattgtcggcatcagcggaagaagaagaagcggatcaaagcaacggaaattaatttatatttgatgaaatgcccatctcactaattggaatttgatttgatagaattatttttttatatttacttaaaggcaataggcaaaaaataattctcgaatatactcggaaaaaatgaatttcgtgttacataatttattttttaatgccagtacttgctcttttcttgcatttataaaatcccgagactttaagcttggtaatactggaaaacaaaaaagccattagtaatcattgcaatttactgaaagtttcgaggacacatcattttaaaaagttaaataattccttcacaaaattatatcttcgtcaatacataatgattagggttgtaaattatatggattaacatatattttctgcgcatatgctatgaagaaaggggctcaaaaatagcctttttacgttaaaattttttgatttagtgaaggtttttagtctatataaatcaatatttttggggggtttcgggaaataaatccatatttagccatttttgccttttt

SEQ ID NO: 40498 - DNA, 69 bp, Heterodera glycines
gaacgaagaaggacacatgccggccagcctaagtgttccagagcagtagcaagctaccatggctcagcg

SEQ ID NO: 40499 - DNA, 688 bp, Heterodera glycines
ttttgattatttatttttttcttgaaaattttggacattttaacatacttaaatttaaatatatttaaataaaaatggaaatttccgttatattgtaatagcgtccacccggtacatctcattgaaattcctgaaaatttttgtgaaaattaaaaattttgaaaatgcacaggttgaaactttaaaattttcccacgtaaaaaatatactgaactaaaagatcacaggcacttcttgttaagctagtaacaaattaaaaattttattttcataccatataatttaatacccaatttattatctattgaaaaataatttcaccgggttacgatcaagggcatagccagacccttggctttgaggggggctgaagtcaaaaattcgatttttaggggtgtatttttcttttttaagtcgatttttaacggtgtgttttggttttttgaaatcccttattatggggtgtattttacaaaatttttcgccgcttttcgccaaaaaattaatattttttgccattttggcctccatttttcaaaaatatggtaaaatggtggtccggcggtgccgataggcgccgccgggaaaatttttgagtattttaatgcaattttgttaaaaaattgcttaaaatttcaaaaaatttactgaaaattttttactttttgggttccgggggggggggggg

SEQ ID NO: 40500 - DNA, 750 bp, Heterodera glycines
ggcgaataaatttttactcgttcctcaagaaatttatcgtggtctcacctccgtgtctgacacgggtgacctcaatctggatgctgttcgacacgatttgaaccgagccaggggtgagcgaacaaatccctcaacaaaaaatgtccactacaaccaacagctaaggcgctatttgaaaatgaggagggatcttgccgacagaccagccaaagttgagctaaccaaaggcatgagtgtgttgttaaggagaggtggtgaagatgaagatggtgaggttgtggacactacaccccgaccccctgctccacccccaccacctccaccgccagggagacgtcctccgcgtggaccccctcctccaccgacggggagacgccctccctctggaccaactactcctcgtccctccccacccggaagtcctccgcctcgtcctgaacgtccccaaagaccaagtagagcttctcggagaggtggtcgtctggagaaatggaggaaaggtcgatacaatatacagcaacggcagccggtggtgcgggaccttctagcggaagcagcagctgccccattgcccgaaagtgacgatgaagatgactatatgctggagagtggattcgcgctgccagcgccgtcacaatattatggcgatttgcctgtgctacccgacaacgcgaacgaaattgaggagatggacactgctcagcacaggattgccaccagaagaaattacaaaaggatgaggcaaatgat

SEQ ID NO: 40501 - DNA, 1061 bp, Heterodera glycines
gacggcgaactgtatttgaaaaacagcatttcatgaaattctgatcccgttgttttctggtttaccgactccttttgctttttttgttatcgattttagatatttacagaccattaaaatatttatctaatgtattcataagtcggtatttgaaaaaagcgccgaccaaaaatcggtatttattgaaaaatttccagaaaagcacaattttttgtaggtattttgaaaaaaagagcgttgaacataatcaaatatagctctttaaaataaaaataattaaattcaattaaagtagcctctcaactcttcaattaaagtagcctctcaactctttaaaataaaaataattaaattcaattaaagtagcctctcaactctttaaaataaaaataattaaattcaccctgggctcctaatacaactaattcaaaaagcatggtacattttatttattcggttatcattacttgttctatttaatacaattaaaaatcaaattccttataattctgtcaatcgtaataattccgaaaaatacttttttaattaatttaatcttatgcaaatggttctgtattttatcatataaagaatttttgttttagaaaattccttctgttctatcatataaagaaaaaaaatttaaatgttattctaaatttgatatatttattttacaaaatattcttatctcaatatatataaatgcgatttagataatttcacataaaaataaattaaccttaaatcagggtgtgagagaattttttttaatatcattttttaaattttattatttattcagactagttttttttgtcgattaatattaatttttaattcaatacaaatagcaattttgagttgacaattttttaatttatcaaaattcgtatttttagttttagaatataaaagaactatattaatactactttaattatttctatattctcatttttcgaatacttgttagcaaaataattactttttcatgcaatgcattagatttagttgcaaatttatcatggtaaaatattaatatagcttattttaattct

SEQ ID NO: 40502 - DNA, 162 bp, Heterodera glycines
aatacaggaattagtagcgcttttgcgccgcaaaatcacaacttttgcctttattggctcaaagataacggcctggttttgagttaattttatttcaatttaacctagaaataattagttaccggtcggggtcgttttcgcgtggtcgttttttttcgggga

SEQ ID NO: 40503 - DNA, 1069 bp, Heterodera glycines
ttttattattttttaaatttaaatttaattactttttgttaaataaattttataatttaaaattaattatttatttttcatgttttacttcttctaatcactcatccaatcactgttgtacctcttctaatcactgttgtacctcttcaattcactgttgtacctcttctaatcactgttgtacctcttctaatcactgttgtacctcttctaatcactgttgtacctctctaataactgttgtacctcttcaattcactgttgtacctcttctaatcactgttgtacctcttctaatcactgttgtacctcttctaatcactgttgtacctctctaataactgttgtacctcttcaattcactgttgtacctcttctatcactgttgtacctcttctaatcactgttgtacctcttctaatcactgttgtacctcttccatttacttttgtacctcttctgatcactgttgtacctcttctaatcactgttgtacctctctaataactgttgtacctcttctaatcactgttgtacctcttctaatcactgttgtacctcttctaatcacagttttacctcttctaatcactgttgtacctcttctaacaattttgtacctcttctaatgactgttgtaccacttctaatcactgttgtacctcttctaatcacttttctaatcgctgttgtacctcaaaatttaaaaaacgggcgcgaaacgcccgtatgagttcaacgaatttaaaaaacgggcgcgaagcgcccgttcaaggctaacaaaaattgaaaaaccgggcgaagcgcccgactgaggccgcgaagcggcctaacaagctaaaaaactggcgcaaagcgcccgtatgagttcaacggatttaaaaaacgggcgcgaagcgcccgttcaaggccaacaaaaattgaaaaaccggcgcaaagcgccccgactgaggccgctaagcggccttaatagcccaacaaatttataaacgggcgcgaaacgccccgtctgaagccgcgaagcggccttataacccaacaaatttataaaacggggcgaagcgcccgt

SEQ ID NO: 40504 - DNA, 977 bp, Heterodera glycines
cggggcagtccccctgaacctatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatcctttcggaatagcttccctatagcctgtactttaatctgcggtggattttgctcccataaatgtttgagtaccccaaacggacacttgaaaaatcgattttttg

SEQ ID NO: 40505 - DNA, 916 bp, Heterodera glycines
ttttatttattttttgcaaaattaattcttaaatatttctttagaaagggttctgaaacgcaccaaattttatttacatgttattttaggcactctgatgctttttctatcaaaaagggagatgaataaaatttttaaaaatttttaattcctttttaaacaggccaaaaagtttaggcttaactttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatgttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtccccccgaaggaatggatttaattaaattctctcctttcgggattttttttcattaggtcgtccgttagcgttcgattgctctagtcatttttaaaaattttttgttgaatatttgtcgtgctctgaaaggcgggggggggg

SEQ ID NO: 40506 - DNA, 1002 bp, Heterodera glycines
ctctctctctctcgctctctctctctcgctctttctctctttctctctctctctctcatctcttttttttatcatttctcgtgtccttttctgcccatggtccattaaaatgacctttgcccactcaattgctctttgtttgatttcccctttttactttttaatcatttttttaccttttagatggctttcgaaatttcataatattagtctttcgttaatttcttgtcttcatccccctcacttttgaggcgtttttaaattatttctccgcaatgattttttctccgatttttccgatcattttccaatggttttgtctttcgttcgttctgtcggtgcaaagctcaaaggttagttgtcattttggttttgttaaattggcacattttgctcatttatttttttgttttaattgtttttcttctttcccttttctttctttgctcatttgccatcgttttctgaattgcttaaatggtccataaaatgtgagatgacttttctcaattcctctctttttttcctcccttagaatggcacaattacttgcatttggcatttttgggtaaatttgaaattagctatgatttgattgaaaatattatggaggggggggggcgattagcgctaataattcttcctgaattaataaaaatgggagtaatcgctgcccatagatcattaatttgcattgcccgtccaatagttcggttgcgtgaatggccggcccccttggcccatccctcccctttgtgtccttccctttcccccattgtctttttgcccaacatttgcatcgttttccctgctggacatccccgccggcgattcacttctctcacttttgccccgtttataattcccattaaagagaaagcggaagaaaggacatttataaatgaccaccaccaccattcaccctttctttctctttttctcccccccccccagccaaagctctgctgataattgtgcccatctgtgacgacgaacaaaaat

SEQ ID NO: 40507 - DNA, 943 bp, Heterodera glycines
  misc_feature (721)..(721): n is a, c, g, or t
  misc_feature (753)..(753): n is a, c, g, or t
gaattatttgtcctttgtttcagaaacgtgcacaattttccgcaccctgcagcaatggaaacagccaacggtcgaagacgacggcagacaggaatattattacaacaattcacgtagaaatgattattactgattggttgtgagtgagtgacatgggattgttacggaaagtttttctttgcccatttctttttatttttaaaattcaaaaacccaccatccggtactttttctccctcgctctcctcctcctcttcttcctcctcctcgtcttcgtcctcctcctcgtcttcttcctcatcttcctcttcactttcctcttcatccaatgagtcatcctcctcctcctccgcttcgtccattgcaatttccgttccttgtacgataccgtcgcttggcaaagggtatgccgaacgtcgaatggttgggtcgggctgttccgacggaaagtcaggaagttcagtgtaaccattgcatttctaaatgttgaaaaaaaactaattaataaaccaaataaatgaatggattctatcagtgtaagctaataatcataattttcgcctggttgagcaggtgagaaagagtgcccaattggaaatgctcagcccgatcagtgaaagaattattcacagcaggcgcaggacgttcttgcaggaaaatgtccaaaggaaattttaactgaaaataaataaaatattttaatttaacatttatatgaganaatttaaactcactgaattttggtctttgtcnaaccaaaaattgcgcagaaaacggcatctgtctcggatgtcataagaacggtcatagcgggcgagttggacacatatttgacgagcagagcacatttttccttcgcggttttcggaaatcatagcccaaattcggacagccaaattttcatgctggagctaaattgggaacgaagttgaaataaagttac

SEQ ID NO: 40508 - DNA, 857 bp, Heterodera glycines
  misc_feature (779)..(779): n is a, c, g, or t
  misc_feature (836)..(836): n is a, c, g, or t
ttaaatccggaataagagcaaatttacaaaaatttaattaaaataaaataacaatcctatcgaataaaatttaaattgccttaacaaaaagtaaaatataaaaacaattgattactacatacttaatttccagctacacgtaaaatattcatcatccaaaattcaaataaacttattcggtataacacagggttgccagatgaagattttcaaaatcatcattttcaaataaaaaatcatcatttggggtcaaaaatcagcatttttgaaagtttaaagatcaataaacaaaatgtttttgcggcgcgttttttccaaaaaacctatggggaacaagagggggtgggttcggcggtgccggtaggcgccgccggggaaatttttgagaatttgagtgtaatttgctaaaagattttcactaaaaacgacaattttttgcgtttgagcctttttatgaaaaataagtttcgggggctcggcggtgcaataggcgcctcagggtgaaaaatggaaattttgaccattttaaacaaattttataaaaagtcacacacagaaaaatcaacatattgccataaatttgaaaatttgggagttttggtagcagttttacataaaatggacaaaggatttttccaaaaaatcagcataaatcatcaaatttctcaaaaatgatcaaaaatcagcaaatcatcatctcaaaaataacatcatcattgacccctcgaaatcattaaaatgatgataaatcatcacatctggcaaccctgatttaacanttcattgggggtgtgagccggccaatccaggcatagaaagcacactttccgagttgngcacattttgcacatggacac

SEQ ID NO: 40509 - DNA, 277 bp, Heterodera glycines
cggtgtcatctatgttactagatcggggatcgatccccgggcggccgctcgagcaggacctgcagaagctagcttgatggggatcagattgtcgtttccgccttcagtttaaactatcaagagaggagcacgaaggggaggggagcggcgcgtagcgggggaggtgggtggtggaagaagaaaagggtggggggagtatgagtatgatggtcaatatggagaaaaagaaagagtaattaccaattttttttcaattcaaaaatgtagatgtccgcag

SEQ ID NO: 40510 - DNA, 1332 bp, Heterodera glycines
ttttatactcagaaaaactttcaattacgtaaaaaaatattctttatttaagcgtccaagtcagtgacactatcctcagtttcttaggccacaaattttaagaatgtttgctctattctttatttaagcgtgcgtcaaagtcagtgactaccctcagtttcttaggccatcaatttttttcttgcttcgtaaaaatttcaatgagaaaacctggaatttaatttaagagtatattcaagataattttttgtcttttaccttttgtccataatttagttatataaaaattcggtagacttagggctttcatttgatgccatgaatgttggcactgacccagggaaaaaaaaagttagggccaaagaaactgaggatgctcattgatattggacgcgtaaactagaataaagccaggaatatttacctaaaattagtgcccggattcttagttttttagtatttattttttctgcggcttaaattcaatgagaaaagcacgaaaaaaaacctttttagcgcgaaaattcttcgttttaaggctcctctatacgtccctaggaatccctatttttgaattgtcgcccctaaaatagggggtacctattttggcacttttggcatatcgcccttattttgacccctatttcggcatttttgaaaaatttcttaccaaaaatgcaattaaaaaatgcaccataaggaccgacttcttgaaaatttttcaaaaattgcaaaaatagaaataatttttaagattttggacaaaaaaaaattaaaaactttctctttgaatatagacttcaaatgaaaaataagctgaaaaatcgaactttcattaagcaaatttttttttgctttttattcaaaaaaatgaaatttaattttttgtgaataaaatttgttgaataagttatttacactgggtcttaatttatttttcattgaaaaaaagcacaaatttttttaaaattttccccaatattttaccattttccgcactatttagggggttttttcgccttctatttaggcctccaaaattggggttttccgcaccctaaaaatccaggcccttagggggaatgggattttggcaaggatttttttggaaaaaatacgaaaaaattttggctcagtttccccaattttttgcccaaaaaaatttttgtaacccaaaggaatttttttcaaaaaggggaatttttttatttttttattaaaaaaatttttttttatttcccccttatttcccccccttttaaaaatttttttttttttttttttttattttttttttttttttttcccccccttttttttttattttttttt

SEQ ID NO: 40511 - DNA, 1259 bp, Heterodera glycines
atccctgtatacaaccgtcctgaaatgtccgtttcgtttcggttagtctcgtttaattttaataatttgcctgctgtgcatgtgttccaagccgagaatgacttcggacccgtaaaacatcacttccgtctcattgaatacgccgtgctgggagagatggtagtgcaaatcgccgccgttcatcaaatccaaaatgaagcacaatttgtcgggagtctgataaaatataattttgttttgctgtgcatttggcgttttgtttgcctgaaatgcgtatgtcatgcagacgatgaacggacagtcctgccccgtgctgaccaaactcagcattatccctgcatttggtcggaggcaattagtgacaaattttgcgccgattggcactcactttcgtttagagcgagtgtttcccctgtaaatgttctaataaatgtttggtttgtgctcgtcacttgccctgcttgagtttgatccgctttttgtccaggcatttcatcgcgtacattttgcccgtgtccgcctttcggcagccgtacacttcgccgaaccctccgcgtccaattattcgatgaactaaatgaaggccaaatatttgttgttttttttctcctttttgtgctactaccggaaaagtcgctcatcgccaattgcatgttcagttccaaattctgaaaatatgctattattccttccaaattcaaaattatgttttttgaatagggattgggtcaaaaatgaatatttaagaattttgcttttcccattgtcaaatggccgagtgttcgtcccctttacgctttgctcttcgttccgaccttccattggcaataccgcgtgaatttgtcactgtccaagaattttgggaacacgtcctccttcaactggtcacagatttccgtcacatatggctaaatttaagttgccattctcaaaatgccattgaagttggacctctaacctgaaacaagtccggcgccacattgtttttcatcagattcctttgtacgtgttgcaacgaagcttttgtgtaattctgaaaatagggagaagaaaacggaattaccttaatggtaatttggacacttttcggcactcacatgcgaatgtgctagcatttcgacctgaaaatggcaaaagtttattcccacggtccgatgccctcagcccaccattatgtgatggtcgtaaatttcgcgtgctttggtcagccgttcctccggcgtttctaacttttcgtattctttgatctataaaattaa

SEQ ID NO: 40512 - DNA, 1421 bp, Heterodera glycines
  misc_feature (1002)..(1002): n is a, c, g, or t
ctggaaaatttttttcatatttaatcagaaaaaccaaacaatacaaataaattctcctgatttttctttattttttaagctttatccactaacattgtccaaccctgaagcgagagcgcgccgtgagtttcactgccgaaaaccttgagaaatttttgatttgaaattgcaaaaacaaccagtaaaattatgaggaataaaattttttaaattaatttacacccctaattttcaagttttttttttgtgcatattgtgcatattttacgatttttgtgcatattttggcccttttcgtgcgtattttgcagccctgttaattagacttatgtataatcatcatccggtttggggttcagaattggtcaaaaataaggtcggattcgtgttcagcacaataaaatggccctgtaaaaatttttccatgattcaaacaaaaaaaaaacgggaccagtaaactacatgattggggaaaattaaatacttgacttctcaatagattcactagctcattcgaacgctctttttaagctctacaacatctgtgtatgagttttttacgcccattaaatttcttaaaatttttggaaaaattcaagtacttgataaaaagtcatagacaaaatcaatgattttcaaaatctgagttcagattcgtgatcagcgtatttttctaccccagaaaaaaggctttttaaaattttagtattttttcccatcgggaccacaattctgcacctttgccttaattttctatgattttttaaaatttagttattaatccctaggggtcatatgagttggggtgtgcgttcgagcccgcttggctgcagtttatttttttatgcttattggtgaaaaatcatagacaaaattaaggttcttgcaaaatcagagctcagattcgtgatctgcatatttttacccccaaattcattgggaaaaaattttttacagagattaaaaattaaaaaaatcaagtaatgtacttgataaaaagtnctagggttgccaccccgaccccgccccgaaccccgacattttaggccatttttcggggttaaccccgaccccgacgcttccaaccccgactcggggtcggggctaaatatacacccctaagaatggcattttcgtgagagaaaaggcaaaaaaattacaaaaatttgaattttttttaaccattttgccaaatttttataacctaaaaatattgctcaaaatcgaattataatttttgggcaaaatctgttacatatctatccaaattttcaaaaaaaaaatttcccccggcggcgcctatcggcaccgccggacccctttctcctaacagtctttataataagtgcgttgcgaaaaaaagatgttgaatactaaaaatgtttcgggaaccatgtgccggcggcgtcagtaagcgccgc

SEQ ID NO: 40513 - DNA, 779 bp, Heterodera glycines
gctgcaggtctttgaaatctgcatgaagttgtaaatgtttatttaatcttttaaattgaaagaattatcaaaaagcattaaaaaataacttttaattaattaaaaaataaattacctatttttaaagtaaaaatttatcgttagagcattgggaggaactcaatatggaatatgaattcaaaattctctgcattaaaaaaatttacaatagaaatcaataaaatttattaaatctgaataaaataaaaattacatatttaattttaaggaacatttaatttataaaataatccaagaaagtacctaactttaaaaaaataaaaggtttaaataaacaccttttcataaagtacaagtatactattaactctcaaaaaatataaaaagtatataaatgtagaaggggatcaatctatcataaaatatgttaaaacaaatttaaattctaactacctttaataataaaaaaaacaatacttaatgtaatgaaattaaattaatttggtgtgaaattgacttaaatggtattgattttataaacaataaaatatgtatcaaagtttttaaactttgggatcatttttcaaggggtattaaaatgcgtgacataattaatgccgaccaatctgcttttgaatttgaattatacaaatagagagatttaataaaattaatttggatataacattaactctgatttcttatagtgtaataattaatggatcctgatgcagacataaattccaatacacaagaaagtataaataaaactttttttt

SEQ ID NO: 40514 - DNA, 1179 bp, Heterodera glycines
  misc_feature (75)..(75): n is a, c, g, or t
  misc_feature (187)..(187): n is a, c, g, or t
ctatataaatttttcaaaaaatgattcatctttttatgggtagcgcatatgtctctagctttatagaaacggtcnccgaatctgcgaggaactactttttagagaatttctatagattattattttgcatgaatccttcgcttaaattcccatttatcttataaagtcagattaaattaattacccngatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagtagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgattagcaaatttagccgaactatataaatttttcaaaaaatgattcatcttttttatggttagcgcatatgtctctagctttatagaaacggtccccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggcttagtcttctttgcaagaagcagcacaacttttgtttgggccaacgaccccaaaccattcgaatagcaatcgattgggctgactagactgcatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattctgcatgaa

SEQ ID NO: 40515 - DNA, 998 bp, Heterodera glycines
  misc_feature (890)..(890): n is a, c, g, or t
tttttctagcgacgaatttttccgtttttcaaaataaagaattttcgagctaaaaatatgctcacaaccttcttggtcattcatccttttcttgccactttttttcattgctgcttccaaaattttgtttaattggtcttggaaaaaacggtttttctgcattattttcgatttgttaatttcttggtaaaaggcgtaaaagtccgatatgtgttgtttcgagtcaattttggacctcttcgaatttcgcaatcgatggtacgtttcacggaagagactgaaaaatcttaattaattaattagctataatcgataatcttagtgggttaattcgacaaataaaagagacagataatcagagcgtgaccgggaaatgggtagtgaaaaaatagtcaatagaaaatgcgtcatagaatcagaatttcttgaaaaacgagatacggtagtattatttttggagataataagcgtgggttggtatgtaaacattctaattatttttagagatttgggtaaattttcaaagtgaaaaaattcagaaccaaaatttttatacaatttttaccttttataatacaatattaatactacagtacattattttaaaaatgccatattactgatgcttttccattgacgcattttcggtgagccaatcaaagattaatggattttttaaagtaaaacaaaacgttggaaaattctattgaacagaaattgttgttattcagaaaaaaattccattttaggagcgtatttttttttaattttataattttcctgataaatcattttccatttattgcaaagttttactaaggctagagacaggatttttaggtgctaaaaaacttgaattttgctcaagttgattttgcccattcgcttgngagttatcagtagggcgtccattatatggaaatccatatttttttttggactgtggggggcctgagacgtacgaaaacatgtttttagcttggtttgagcttctagga

SEQ ID NO: 40516 - DNA, 1360 bp, Heterodera glycines
  misc_feature (1326)..(1326): n is a, c, g, or t
aaaattttcaaaaaaccattctttgggtattttctcgattattaataggtaaaaagataactttctgaaaaaattcaaaatgtatgccaaaaatgagtcttttttggggcaaaaattgaatatttatgcaatttgtgcccaagttgcagtacgattttattcagtatgctaaaggaatgcactaaatttcaagaaaataattttaaatcattccaactatagtttgacaaaatgttgaaaaaggtaatcaatcgccaaaagaaattaatcattaaatttcaaattcattatgatcgataagattggaattcgaattttagagagaatgatcaaaagttattttttgaataagagagttttgattaatgatttttggaaatttttctttttaactcaaaaaaattttaaaaaaagtcatttaagtaaataggccaatcaaaaatgatgaaattaatccggcgattcatgttcttcgatttcttaaaggagcctttctgggtatttgaagacaggcccaaaattggcctcaattttgtcaccaggccaaaacaacgaaacacaagggaacagttcgggtgaagaagcattggcagaaatattgacagaacctgtgtaaaaatcaaaattaaaatttttgtgaaaaacaaataaaaactttctcttaaaattttgatttaaaaaattgtaatccccaaaaattgttattcaaatttaatcatattgagaatgaacgtaacaaataaacagttaggttacatggatacggtatttgggcaaaaaccaggtccgggtatcgccaggcccaaaaaagccgggttcgagtccaagtttttaaaccgagcccgggtatccggttgaaattgtatattcgagtttaatcatattgagtacgataatgcgtacaaataaaaagagcgttatgattggacggtgttaaaaggctttaataaagcggagacataaagaaaggcccacaaaaagaaaggcgaattgaattttaattaaaaaaatattttatgtaattaaggtccgtgtaaattaattacactaattagaattactctaaataggccttgaaaattattttctgtgtcgttgttttatttatttatttttatattttaaattacttttattgcactttcccccattccattcacatacccaagtgttttccattcagtgtgtaagtgattcggccgccaactcggttaacaccacagccaacaatgtcaccgacatccaacgagggtgtgccatcaatggcactgctggcaccatcgcgggtgctgccagctgccgatgtgctctgcccactcgtgccangcgaaaataggtcgtcataattaagtgcttaaat

SEQ ID NO: 40517 - DNA, 795 bp, Heterodera glycines
ttatatgcacataattcacgaagtttaaaaagctatttttttttactgaaatagcattttttgtaaaatatgaaattaaattgaaaaaatttgtgcctaatcgaaacctttcgaaactctttatgccaaatttgcaaaaaaattgaatggtaagaaaaaaaattttatttgattttttgtttgatttttctgatttttggatttatggataatttttaaaattcattttccatccaaaatcgattcgtttccgatggaatggccaactattggccgaccattcttttttccgatggttttattatgcaaaacaatcacagaattggattttccatctcatttattaaattggagttgaaaaattaaacaaaaatttgtataaattatgatcatttaattgtgcaattataattgctttaatttttgaaagctcagtgagacccgaataaatagatgaaaaatcatagaaaaaataaagaaatgaaaatctgagatcggattcatgatcagcgaactcatttacccctagaaacatgtttttaatattaaataaaaatttttggatcaaaataatttggtggatttttgcgatacttctcagacgacaaatttgaggggcggtgttgagtagaccgcgcgggattttgcgggatcccaatccgcaatttgcgggaatttgcgtgatttatacctgtgggatcacgtcccgcaaaattttgagttcttaatcccgcagcgggatccgcaaatttgattttttgtgcgggattttaatgattttttttgaaaattttt

SEQ ID NO: 40518 - DNA, 1398 bp, Heterodera glycines
tttatctctctccctcccgttctctctcctcactatgggtcaagcacactgtgcagagaaaagcctagtactatctcgtcgttttctttttctttgtaatttctctcactttggcgtactatctattcattttaattatgtaaaaaacaacattcacttcgctctatagaacttttttttcgccttacggattttctttaaattttgcaaatcgatagacaaaaaaatactgaacatttttaacgctcgaagttaatttttttacgctccgatccaaaattttaactcaaacaaaattaataatttcttctctccttttggcgtactattttcatgtctctaacacatgaaaaaacaccaaattcgaaaattctaataattttggttataagggtacaaaatcactttgaacatttagaatcaatagaaaaaagaataaatttagcatttttggtgaaaacagcagtttaggacttgagttataacgtgataaaaatttgaaagtatcacaacttttttctgagatgtcaaattgcttagcattcgcttagaaaaagattctccttttcaaaaactttttttagataccaaatttgttcagtttagttgggaatgaagcgagttatggcagaacaacaaaataaaaaatacgaaaaaggcattttccagtataaattttgaaatagcgcgcaaaaatttacgccaaatgcgctatttggcgttatgagcaattttgtctaacactgggcttgacccatagtgcatatacacacataggtattattcgaaaataaattggcttaatataaatattatatattttgttaaacaattcaaattcaaaaaacgaataaaaaattggaggacaaaatttaagagcaagcatatttatgtagcaggattggccgacatttgcgccaaaaaatgcaaattttcagtttgtatttacaattatcatttatcattggaattttccaatcacatttacaattgtaatttaattaccgtaaactgagcattttcaattcgtgtttacaattattatcatttaatcattggatcattttccaattacatttacaattgtaatttaattaccgtaaactgagcattttcaattcgtgtttacaattattatcatttatcattggaattttccaatcacatttacaattgtaatttaattaccgtaaactgagcattttcaattcgtgtttacaattattatcatttaatcattggatcattttccaattacatttacaattgtaatttaattaccgaaaaatgagcattttcaattcgtatttacaattattatcatttaatcattggatcattttccaattacatttacaattgtaatttaattaccgtaaactgagcattttcaattcg

SEQ ID NO: 40519 - DNA, 1424 bp, Heterodera glycines
gggcgcttcgcgcctgttttttagcttgttaggccgcttcgcggccttggacgggcgcttagcgcccgttatttaaattttgaggtacaaaagtgatgagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtactaaagtgattaaaagaggtacaaaagttattagaagaggtaaaaaatgataaaagaggtacaatgattagaagaggtgcaacagtgattagaagaggtgcaacagtgattagaagaggtgaaacagtgattagaaggggtataagtgattgaatgtggtacaaaaatgattagaagaggtacaaaaattgaatgcaatttattataaattttaaaaaataaatgaattattccttttattaattaaaaagataattttgaaatgtacaagaattgaatatttaaattaatatgaaattaatttttataaattcaattaaaaaaaatatgaaattctttattaaaagataattattattttttacataaattcttttattattaatttacaacaaatctttaaatataaattgatacaacagtgattagaagaggtacaacagtgattagtaaattcattaaattaaaacgaaaatattttttaacaaatttaattaaaaaaatacatgaaattctatcaattaaaaaaataattaatttaaacttataaaatttatttatcaataaaaaattaaattaaatataattatttatttattaactcaacaaaatattttaaattaattaaaatcattgaaaataaaaccaaacatttaaatttattaaaagtaatgaaaattaacccaaaaaatacaaagaaaaataatttacaccggccggattcgaacctgccgcccccccccccccagaagtgtccgatccccatcccgggatttaggctaacgagtcaagtaaatctgatcacgtttcgtgatcagcggcccgataacccctaaagacgatgtttttggaagatttttgtcgaaaaaattttttcgcacgaaaaccgtgtgcgcccccacattggtcccgaatctcgaaatcacttttatttttataaaaattcttaaaagaagtgataaaaatgccgaataaaatttatataagagagcgaaaaactgcggatttttggagtattttatttttccgagaatatcttttcagaaccgagttatgaatttttt

SEQ ID NO: 40520 - DNA, 1267 bp, Heterodera glycines
tgcgatgcggtgcccagtgtcgatgttcctccagccggtgccgctgcggtcttctgcgatgcggtgcccagtgtcgatgttcctccagccggtgccgctgcggtcttctgcgatgcggtgcccagtgtcgatgttcctccagccggtgccgctgcggtcttctgcgatgcggtgcccagtgccgatgctcctccagccggtgccgctgcggtcttctgcgatgcggtgcccagtgccgatgctcctccagccggtgccgctgcggtcttctgcgctgcggtgcccagtgtcgatgttcctccagccggtgccgctgcggtcttctgcgatgcggtgcccagtgccgatgctcctccagccggtgccgctgcggtcttctgcgctgcggtgcccagtgccgatgttcctccagccggtgccgctgcggtcttctgcgatgcggtgcccagtgccgatgctcctccagccggtgccgctgcggtcttctgcgctgcggtgcccagtgccgatgttcctccagccggtgccgctgcggtcttctgcgctgcggtgcccagtgccgatgttcctccagccggtgccgcttaatgctgcggcagtggacagaaggtagcgatgcttctgtcgtggctgattttttaaaatcatttcccttttcattttcagaacacggaagagccgcaaatgccggccggaccggaaggggcggaggccagcgccaaaccgacgggacagagcgcagcacctggtggaacttccgcggtgggacagccggcacggtgatgactttgagcacaacatcgcagaaaattttccgactttttcactaattttcggcttggcgacattttgactcaaaataattttttttttttcgtgatcagtagggatgggatttaactcgacgagaaatgcacgaaaaacacattttttgttcggaaaaccttcgttttcacgccactatccgaccctagaaatccctattttggatgttcgcccctaaaaatccctattttgagtgttcgaccctaaaataagtttttatccctattttggcgtttcgcccttattttcgccctatttcgcgatttttgggaaatttattaacaaaaatgcaataaaaacgaaaaatacacccctaaaaatcgacaaaaaaatttcggaaaaatatacccctaagaatcgacctaaaaattttcaaaaaatacactcctaagaatcgacccaaaaaatttcgaaaaatacacccctgagaatcgacccttaa

SEQ ID NO: 40521 - DNA, 556 bp, Heterodera glycines
taagcggagcggagcagcaccaggacgaccagcggaaagaaaggtgagcaaattgcgcacggaggacggcggcgaattggaaatgcattttaattcatttatttatgtatttattggtcgggattaagcataaagggaaaagaaaaagcggaggaaaagccgacgaggacagctgaaccaacactttgacagcaacaattttgttggccaaaaaataggagaataaatgggaaaattattccatgcatttgtttatgggacgaaaacccatggcgagaaatttatgtgcaagatggaagagatttttggcatttatttgattgttatcagtgatcactgttcaaatcacattgattctgtcgccaaattttctatgccatggggcattttgcatgtgccaagggcatcggcttcaaggggtcaccgcccactctcaactcaatggcgcacgcattcctcgggggacaataaatccaacaaagtgtcattttttggggaagggatttgtcccaaaaatgtgtccccattcgaaggcacagataaaatctttaacata

SEQ ID NO: 40522 - DNA, 1035 bp, Heterodera glycines
cagaaaaatgtctatctcttttaggacaattttctatctcgtaaccccgatgcttatccgtccggagagcctcttcaaaatttttccattaccataagagctgcggaaattgtgaattacccctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaagacaattttctatctcgtaaccccgatgctaaatggttatctctttttaggacaattttctatctaccccgatgctaatccgttccggagagcctcttcaaaattttttccattaccataagagctgcggaaattgtgaattaattctcagaaaaatggctatctctttttaagacaattttctatctcgtaaccccgatgctaatccgttccggagagcctcttcaaaattttttccattaccctaagagctgcggaaattgtgaattaattctcagaaaaatggttatctcattttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttcccattcccataagag

SEQ ID NO: 40523 - DNA, 1641 bp, Heterodera glycines
  misc_feature (1622)..(1622): n is a, c, g, or t
ctcttaactttaatgaccatttgtcatgggttcggatcctctcgacagatgatgaattattttgaatttttttcaatgtattattccacttaacatatttttattctgttattttaatttattttatgatgctatttgatagcaaattgtttgctgatcatttttaaaagaagtttatggctctatcatttgttttaagttttttatgaatttttaaaaattttgtcattttcatcgattttgcagaacgttgatcacttttttctgatcagtttgggggtcagggccaaaaattcaaaaattaacaatagcaaatcgactatgctctacacgatagaaatggttttaaagtgatctgggtggttacagttcggaatgttcacttgtcagcacctctatgcatacatttgatgccaactgacatttgccagaataggtatattaattttatttatgctaaatagtaccaataattaaacgaaaattataataaagaaaatattattttaagagtatggagttggtcggcgatttgactgtatgcaaagcataagccttaaaagccaagatattacatattcttttaaatattattattattactatattgcaaattttctttttttttaatgtatcagcagatgtcatggtaaccttgtctgcgttaattatgaaaatatgcgtatttatttctttataactttactgtagttgataacgtttcaaaatttaatcatggggtggtataattactggttcccttgtcgcttcgcaataaaggtccaatgatattttttcaattcgcaaccctggctcttttttcaattactttatgaattcgatctttaaaatattctttaaatttcttttacaccttcactattttaataatgaatctcgtatgggtgtggagttggtcggcgatttttacagtatgtcaaacataagctgaattttatgatgcattcttgaatcgcaaatgttttttagattagccagaaagttaagttttataataatttagttttttagtagtttttttttattgtttattaatttcttttcttcatagaaaataagatgttaaatacatcatattgtataaataataattgaatattcttatcattgaccatttttattatattctatgagtgattgattgttcattactaaaataaagcagtaaagcgcaccagactcttattccttcggtggcaacactttcatcaatgacgagtaaatcaaatcttcccaaagtaattgcatttgaaaataagaattaattttataatttttctcacttacattgagtatttttctattcgtttttataatatacatttttagagttaacattttttcacatcatttcattccatttttttgttctgtaattaataatactctatttttattacacatcagttcttcttttccaatcttatatacctaagaaacataaaaatttgtatataaattcagaataatagtttaatagcaaacacattcttttgattctttattcgtgaatttattaaggtattgaatttacattcaatcaaggtgttgcatttaagctttctctgtttatccagaacataggcagtcatatttcccantaattttcggaggttttca

SEQ ID NO: 40524 - DNA, 1032 bp, Heterodera glycines
tataatttaaattaaaaaagtgcatttgtgtgcttcttcctcaattattccttggccctcggcgctttccataagctcttttgcgaacaaaatattatactgagttgtccgcaatatgaattcatcttcaatgtcatccaactttgccaacactgacaaaaaattatgcaatttttaattcccctcactctccacaccttgtccaaatttaggattggtctggagctcatcagctatcgaagctgggacgctttcgcccaatagcgcagacagtacagcgtcgactgttgccactgtcccaaatctttcaatgtactctgtacagtcggtgtcctccgacaaacaccatgagttgcgaccgcgaaagcctataattgcgagaaaaaatgagagaagaaaatggattggttaatggaaaaagaaaaagaaaatttaaagtgaaatagcaagagaggtagcgaagctaaactgtgttaactcggcccacaccctcaaattattccgttccaaaagtggcgaagctaaaccaggttaactcggcacacgtttggaattttacaataaattttcaatttccttatccatccgtccaccttttcattcacacattttttctttcaatttcatcatcaaactcaccgagccactccaagaaatagcatttcctccccgatgcatgagtgaattgcgccaaaacgctcttgacctggtactggcgagtttttgggttcggcagtacaccgggcggaacattggggcaatcggcattcacatttatctaggaagtgaatgtgtgtgtgtgtgtgtgtgtgtgtttggcttgaatttgcaaattttttcttaccggtacgcgtccacttttgttgtaattcttcctctgtcttcgggaggcattggacgaagtcgaagaaagtgcgggcgacgccgtgcgcgagactgtgctgcgcgagccggacgatgaaatgcattgattggccaccgcccgccgcaacaatggttccccttcaaattaaaggaataattttttggaaa

SEQ ID NO: 40525 - DNA, 1089 bp, Heterodera glycines
aaaagacgagagcgagagttcggtgagaggcgagagtccccaaaaacacgagagttggcgagagtcgagaggacgagaggcgagagtttttcaattttttctgtagccttatttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtccatttttccacctttttttttgcggtgcgttttttaaaacttcggggacagttggggtcgggcggtgccggtaggcgccgccgaaaaaattttgaaaattgtcttcggatttgttaacagattttattcaaaaaatgaccaaaacttgtttttttaattttttgtttttaagtcgctttttttgtggcgctgtttttccaaaaaaaatttttttggaacattgggtgcggggtccggcggtgccgaatctgcaccgccgataggcgccgccggaaaaattctaaaattttgagtgtaatatattaacagaacttgtcaaaaaattatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttggggaattgaaccaaagagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagtttaatctttaggggtgtattttcaactctcgcctctcgtcacaaaaaacgagaggcgagagacgagaggagagagtaccaaaaatggcgagagttggcgagaggcgaga

SEQ ID NO: 40526 - DNA, 959 bp, Heterodera glycines
  misc_feature (33)..(33): n is a, c, g, or t
  misc_feature (877)..(877): n is a, c, g, or t
ctagagtcaatcatttgaaattttacaaacacnttagaagaataaaatttgaatatttctttgctttttaaaccagactaaaaattcatattgatctttttagctgcaaatcatttttaacaattgtgcaaaatatcccggccgcattaccgatccggtcgatccgtgtccaaaatacacgggtaaatggcgaatctggggcaaaattattgacagaaattggaaagggaattttagttaaataaattgaatgttttatttaaaatatttccttctattgttcttgtagcttgtcatcgaaaaaatgtggatttccatataattccgaatccaacaaataacacaaaagacaagcaaatcaaacaatcagtgtaagcgaatgactcatcaatcataaaccttaattatatcattaaaatatcttcggcatactggacattgtttctttgatggttctctgtttgctatggtcattaactccttcttacagtcaacgcaaatgcatttgtgtccgcagggcacaaaaatgaattttggcttaatttcaaagattaattacagtatattatgtaaaagtcgaacacataaattttcaaaaatcaatccaaaattctccaaaattcatcaaattcgttaaatctaagttgtcttcgcgaaaattgctaaataaagtatgaaaaatcattaaaaaaaatacaaaaagcttaactttattaatttgaaagaaaatccataaattacgtttttgagatacatttttttataaatattttatccagaaaatacccaaaaattatttttctgaagatttttcagtctccttagggttcaaaatggccgctttaataaagagatttgttttaatagatgcttttanaaattgccaaaatatgcacataaaatatacatataaatcgcgaaaacacaaatatgtatggaaatattttttgaagcttcaa

SEQ ID NO: 40527 - DNA, 808 bp, Heterodera glycines
ctccttttccttttcattctcccttttcctccattccttctgtactttttctccaatgttggcactgtccttctcccactctcttttttcttccgccgcttttcctgctttcttcaattgctctcttttcaagacactctctgtctcctcttccttctttttctcttcttcctctctgtttttctcttccccttttcggtttttctctcctcccttcgctctctcttcctccctctgtctcttttcttctctcctcttctcttcttcttgcttcctcttctcatcattcccattaattccgtctccattttgcgtcccaatgatcggctgacggaagaatccgccgccccttccgcctctccccgccagcagcgcaattgcttccgtttcagtcgggcgtataaaagagccgtccggcccaattatcggacccctccctccgcggtttgtgcccgcccctccggcgatattccacgatgtgcgaaatggcactgctcgcgcaccattcacgcgccgtggtaaaacaaattgtcctgctcggaatgacaccagcggcacaaattgcgacggctgccgacccccgacaagcggcgcacttttcttttcttcggcagcgctttcttcctgctgttgttgttgttgtgtttcgagtactgcttgcggcggtgggggagcatttgccaaaacggcggaatggacggaatcggacggagagcgaagttcggaattggcaatactcttttcctcttcagcacccaaagcaaaggaagcaaatgacaaaattatgcccaagtgaatggaatgaaaa

SEQ ID NO: 40528 - DNA, 1571 bp, Heterodera glycines
gggaggcgatgtacaataacaataattaattaattaccgtcagagaaaatcataaaccctctaagaatgtcatttttgtctctattttggatttttattaactgtcaaaagaatctacccctaagaattgaaaatttttttctcaaaattgatcgccaaaatttaattttttttattgtaagaattttaggtttaataatttttcttcaaaaaaaaggttataaaataattaataatcatttaaatgaccaaattaaagtttttttttttgaatttctacgagttttgctccttaaatattgtattatataattcaatgtcatggaaatgctaacacttttaaaaatacatttaaaatgaaaacataggaaaagaaaagaaatagagaatgaagaagaaaattattgaatttccggcatcaaaaataaattgccctcagacaaaagttattcgacatggagcgacctctaatgattttgtcattaaataaattctacaaattaaaatgtagaaatgcaacagcagccttctcatatccgagatcgatcgttttcaaaggacataagaggaaaatttgcgaattcaagaaatttcaaaaaaaaattatcaaatgcaataaataaatgtaaatttaaattggcgcccggcggtgcccatagggcaaggctgagaaaaaattgaaaattgataaaattttataagttttttgtagatttttttttttttgattttggaccaatattttttctggtgatttggcgttagtcaaaaatttaaatttaatttaatttatcgagcaaaccaaaggcacattagcgctcttacatggtgccaaaaaaatgaaaacaaataaaaatttgatcaaataaaaatacaaaaaaataaatcaaatgttaaattcacaggtgattaaatatagtgtaaatgtggcacagaaaatgcatactaatagtgaacatatgttctatcgaattaaaacaaattttgaaatttggtattgatttcgagcgaactttaatataatggtttaaaattggagagcggctttaaattttctaattagcatagtggcaccgagttttttcctttcaatgctccgctatttatacactccgttgtgccgcggatggtcctgttctacccaattatttttatagcgtttttaacgcctcacttatttgttttaattggtatggagaagacctgttgtaatatttatattaattgggattggaaacttccttttgtaatgaattttttcattttttttcgttttgtatttatttaaaaagcgaagttatttcaatttaaaaaaaattaataaaataaattaattacacatttaaaaattgaggcaaaattttgcgtaaattatctcatttttaccaataattggtttccccacaaaatgatgaaatatgattataagtttgtatatatcatgcaaggttttctctgcttctctgatttacagaaaccttaattttaaagtatgtatagatattatatgtttctctaattgtacaaaaatgtaatttttaagtattgcaacgtttctctgcttctctgat

SEQ ID NO: 40529 - DNA, 641 bp, Heterodera glycines
aaaaaaattttgtgtgtcttcataggtcctgcctgctttgatcatccacaccatttttttgtcccttattctacgatatatatattttttttttattctgctgaacagtgtcgtcacgagtacctaccgtatttttctctgattatatgcccgccgcccgtctccattaatctacctatccgtctccaattctctccccccccctttctgctgaggaggttgaaaaataatatacccgggcatataattagagaaaacacggtaagtggttttcgttgttcgccctcccgacgacctcttttttttaaatctacgaaattataaataatactaatgaatatatcatattattacggaccaggccgttttcgtttggatcgagttcttgaactataacttttttcattgtcaaccaaatcccattcgatagccccaagagtccgttattaatcaccaaaattacgaaaaattccgtttagattcaaaaaaatatgaccagaaaacttcaaaaaactggtttaatgacaccaagattgttcgattttatagctcttaaacttggcccaagcgaaaacgaccccgaccctttgctcatcaaaatgtttaatgcgtgggctacccaaaaaaatttataaaaaaaa

SEQ ID NO: 40530 - DNA, 1165 bp, Heterodera glycines
  misc_feature (175)..(175): n is a, c, g, or t
  misc_feature (213)..(213): n is a, c, g, or t
ataaagtcagataaaataattaccccgatttgttttagaattgtccaaacacgcttgctaatagcttttctttcgaaaagagaggcgaggaaaaataaagggtgcatccaaatgtaaattttttacatgaaagcatttggatggcttgctgtttacagttggctaagtcttattngcaagaagcagcacaacttttgtttgggccaatgaccncaaaccattcgaatagaaatcgattgggctgactagtctcaatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttagagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttattttcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactactttttttagaatttctatagattattattttgcatgaatccttcgcttaaattcccatttatcttataaagtcagattaaattaattaccccgatttgttttagaattggtcaaacacgcttgctaatagcttttcttttcgaaaagagaggcgaggaaaaataagggtgcatccaatgtaattttttt

SEQ ID NO: 40531 - DNA, 979 bp, Heterodera glycines
  misc_feature (20)..(21): n is a, c, g, or t
ttttggttctttcgactttnnggtttcaattggttagaacatgtataaaaaaaattatggttcaagaaacccagggctgctagtaattagagttgtaaaatgccattggactgataaactcgaattggaattataaaatgccatcggactgataaactttaattggaattataaaatgccattggactgataaactcgaattggaattataaaatgccatcggactgataaactttaattggaattataaaatgccatcggactgataaactttaattggaattataaaatgccatcggactgataaaccctaattggaattataaaatgtcattggactcacagttcaatagaaccccgattttcacgttttccgtatttttccaagtttttttaaattgccccaatttttgccagttttttttgttaaatgttttatatttttgcttttttttaaacagtgacgaaaaaacgcaccaaaaagaattggaagccaagcaacagaaatgtgtgtgggaaatgctcagcgcaatgagccggggggaacgtgaaaaggccaaggaatgtgtgaagggctcactgttcattcagatgttcttccaccaggtgttctccaaagaaacaaaggaaaaaattattgaaacgaaaggtaattaacgaattggtaatggttacggtaatgagggtacgagaggggggggggagttggagtcgaaaacacgaaaaattgcttgaaaaaaatccttgtcgagaggcgaaatccgttgactggctggaacagaaaatcccaaacagtgaaaatcctttttttggaatgacttaatttgaaattttaaaatagttaatataaataaaataccgactggaaaatctaaaaaattggaaatcctgtacacaaaataggaaaccgaaaattccgaaactagaaaatccagatcaagagaaactcgaaaacacaaaatcataatgaccgctgcaa

SEQ ID NO: 40532 - DNA, 1504 bp, Heterodera glycines
gataaatgttcaaataaatgtcagaacaaagaaataagtaaaaaaatgaaaaacattaatttacttcagccctaaatttatgccacgaggataaaatttaattcattcgattagttaataattaaacaatggatatgaataaaaggtttataaataatgagatattggtaatttatgaagaccagaaatgcgcatataaaaaaggaaaataacagaatcaagttgatatattttttctatttaacaccatcaattcgtttaatgtgtatttccattaaaaatattgaaaacaaatatgaacttatgcatagaaaataaaaaatgtataatattaaacgaaagaactcatataaaattacagtcatttaataatacagaaatgaatttataaaaaaaattaatatatttataattgcatacttaatatcgtaaccaataaatatttattcaataaaataaaaatttgttatgataaaataacttattttaaataaaggaatcgagaaaaaatttcttttaaataattaataaataatcgggaaatatacgttcaatctttaaggatttaataccaaatgcaataaaaacaaatttaaaagataaaaacgatggaaaaataagaattaaaaagctaagataataaatatttaaaaaacaatttgaaaaaataagaatcgaaaatgaataaatgcataaaaataaaataattttacacattactaataaaaacaaaagtaagaaatagataaatgtgcaaaacgcttgcaaaattatttaatatataagataattaaaactttacaacatgtaaaatcataaaaattaacttttttttaaatttcgatgaatataagatacacaatttcgtgaaaattaatgtctttacaaatgtataataactcaaaaggctgattttaagtgctgaagaaccagtgccggttcatgattaaaaggatgaaatagaaaataatttattaaatgatattgagaaaacaatattaataagtattaaatatatattttttaataaaaataagtcttagaaaaaaaatatattaatataatattattttcgagagagcaaactcataaatttataaaacaaatatattcatttataaaaatgtttaaaattaattaacttgaatacctctaaattataataaaaagttatgaaatggatagaatatgctttaattcttgtactggactggaaataatactaactgattaaagtaaatttgattatttcaaaattatagtgaataaacgaaagaaaatacaaataactatcaaaattagacaaaacaaaataagcaaaaaaatcgataataatatatgcaattcttttttaatcgaaatttaagttgaaataaaattatcaacttctatatttgatgccttaaatataaaatcaataattaataattaaataaatatatattggcttattcagattaaaagtttacatgattttaaattaatttaaaactaataaatagaa

SEQ ID NO: 40533 - DNA, 964 bp, Heterodera glycines
cagaaccctttctgaaaaaatatttaagaattaattttgcaataaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcgggttcggggggactgcccccgaaacaaaaaaatcgatttttttc

SEQ ID NO: 40534 - DNA, 1750 bp, Heterodera glycines
  misc_feature (179)..(179): n is a, c, g, or t
aacaaaaaaaaaatgtaaaaaaaacttgtatgcaatttagaaattaaatatagttaatcgtcgtcatttttcatgcttgctatgcgagaaaagcatacgacaaagcaaaatttgatcaagaatcaaacatttcatattggtcgataaaaaacattttattaaatacatgcaaaattgtntaaagaatttttaggaaaagaaatttactttgtgtcaaggaaaccaagaagaacactaaaataaatatattattaagaaataaattatttagcattaaattctttttaatgattttttatgttcaatttttattaatttttaaataagacgatgaaataaacaaaagatatttagaatgaggaagaaaggcacttcctctaaaaaacatcaaaccaaaaaacaccctaaagaaatttaaaatatcataaaattcaataatttttcaaaaaatttttgatcttaaagtttaaaaaatatattaaaactatattatacaagattaaatagaacagcatatcgcaattataagttaaaccgaaaatgacgaaaactaatggttaaataaataattaaaccgcaaactttgattgttatgcggcccgatgggaaggggcaagagaggattttacatggggcagagggttaaccataatggtttccttaaaatattagtaaaaataaaaacaaaatgattatgtaaataaatttctttattccttttttggacaagaaatgcttaggaaaattttttactaaaataaaataaaaacgaaaatacatcccgctaagaaatgaaaaattctcgaaaaatttaaagtaatttgttaaaaattgaatcgaatcaagatgtccattaaaaagcgttaataaaacttttatttgcatattttattaatgcatattagcccataaattagtgatttctaacagcgctgctttctgctgcaggctaattgattagtcacgctcaacaaattcaagggctattaacccatatttaaaaatgaataatgaaatatttgattgaaaaaataaaaataaaaacaattaacaaagaataaagaataaaaaaataaagtaaattttgaaataaatcttttgaaaattttaaagattatagtaatagtagaatattccaaaataaaatgactgaagtaaacactaaactaagttactcgattaataaaattcattcaaattaaaaatagattgaagacttccttaaatttaaataatatgccgccgatgaattgagcaattggtctagtatttaaaaaatgcatcgcttaaaatgaaaaataaaaaaatagaaagaaaatattaatgaaaacgccaaaactaaaaacttatataaaattataataaaaaaattaaatttaataaataaaaaaaccccattaaatttacagttaaaaatacgaaaaagccaaagagaagtctcgaaaagaaagagatttgataaccgttggactcttgattggagcagcaactgcatttctgatgtcgaccacaatgggttgaaattcaataagaatttcgtagattccaattaataaaatttagaaaagtcacaagataaacacaatattaatatatgaaacagttcagcaacagttgaacaaactcaacaacaacaacacccacaacgattaacttcttctgtttgacaaccaaaaaaatcatccagcaaatttaaagatggaaagaaattgcttgaaaacaatgtttataaatttaaaaattcattttt

SEQ ID NO: 40535 - DNA, 377 bp, Heterodera glycines
cactagggtcgcaacttttagtgaaaaaactttttttttgctcaattgttttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactattttttcactatttcgacattttttggaaaattctttaacaaaaatgcaataaaaccaaaaaatacacccctaagaatctatctaaaaattttttcaaaaaatacacccctaagaatcgacagctaaaattttttcaaaatacacccctaagaagtgaggcaaaatttctcaaaaatgtactttctt

SEQ ID NO: 40536 - DNA, 663 bp, Heterodera glycines
agaaatctatcaatttaaatatatgtaatatttttattccttttatatattttaggtaaatttgaatttttatttaaattctttgaagttcataataatttattgcaatagaatcttaattttcgtcagtgatgaatgaatatttatgatggcaaataaatagagaattagtttttatgtaatgctaatttgtaagataagtagatttatgttcttcaacgttgattaatcaattaaactgtaaatttgttattttattgaattatgaatgaaacttttatttatatatctatgaaaatttatcattctgtatctttgatttttttttatttgatacttctctgtatttaataatttcatatattttttattaacacatatacattacccgagtcctcagtacgtaatgattgtaaggtctcattgaaaatgaaatttctaaatatttgtctaatatttgttttatgtataaatatttcaacgtaataaattaataattagttagttaaatatatatttatctattttttcttggttagccgacttttgcgccgcggacatttgcgccgcaccatttgcgccgcgacacttgcgccgctcagcaaaaaagacaattgcgccgcggacatttgcgccgtgccatctgctccgcgacacttgcgc

SEQ ID NO: 40537 - DNA, 1232 bp, Heterodera glycines
  misc_feature (49)..(49): n is a, c, g, or t
  misc_feature (51)..(52): n is a, c, g, or t
  misc_feature (54)..(56): n is a, c, g, or t
  misc_feature (59)..(59): n is a, c, g, or t
  misc_feature (62)..(64): n is a, c, g, or t
  misc_feature (67)..(69): n is a, c, g, or t
  misc_feature (72)..(72): n is a, c, g, or t
  misc_feature (74)..(76): n is a, c, g, or t
  misc_feature (101)..(101): n is a, c, g, or t
  misc_feature (103)..(103): n is a, c, g, or t
  misc_feature (107)..(107): n is a, c, g, or t
  misc_feature (113)..(113): n is a, c, g, or t
  misc_feature (116)..(116): n is a, c, g, or t
  misc_feature (121)..(122): n is a, c, g, or t
  misc_feature (146)..(146): n is a, c, g, or t
  misc_feature (155)..(155): n is a, c, g, or t
  misc_feature (161)..(162): n is a, c, g, or t
  misc_feature (167)..(167): n is a, c, g, or t
  misc_feature (170)..(170): n is a, c, g, or t
  misc_feature (174)..(174): n is a, c, g, or t
  misc_feature (176)..(176): n is a, c, g, or t
  misc_feature (182)..(183): n is a, c, g, or t
  misc_feature (185)..(185): n is a, c, g, or t
  misc_feature (189)..(189): n is a, c, g, or t
  misc_feature (191)..(191): n is a, c, g, or t
  misc_feature (198)..(198): n is a, c, g, or t
  misc_feature (202)..(202): n is a, c, g, or t
  misc_feature (207)..(208): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (233)..(233): n is a, c, g, or t
  misc_feature (235)..(236): n is a, c, g, or t
  misc_feature (244)..(244): n is a, c, g, or t
  misc_feature (251)..(251): n is a, c, g, or t
  misc_feature (257)..(257): n is a, c, g, or t
  misc_feature (259)..(260): n is a, c, g, or t
  misc_feature (263)..(263): n is a, c, g, or t
  misc_feature (267)..(267): n is a, c, g, or t
  misc_feature (269)..(269): n is a, c, g, or t
  misc_feature (272)..(272): n is a, c, g, or t
  misc_feature (279)..(279): n is a, c, g, or t
ctcactgttgctcgcttcttcctgtgttacttctggtccatttaaggangnngnnngantgnnnaannngantnnnaatcctttgtgattaaaatagaaantntggnattagngtnaaggnnaggaatgtgttggaatggggattnttgaatttnaatttnngattntantgangnattttnnantgangnatttttngggnggatnnangtttttaanggnaanaattgttngnnattttgantggtgtnattgtnannagnattngnatnattgtgntgttgatcatttcttgttgctgctgttctactgtttttattttataggcataatttaaataagctatatcttccaaatcaaaccaaaatttttaggtctgggtctactcccttgatttagagaaaagttgattttttttaaaactaaaatcaggccccaattatgaatgattacattttttgcttcttaccgttcggcactgtgtcctcctcttcctcgtttttctgtttctgcctacgtaataatttgccaatttttgtaccgaatcggatttggggcaaatggcgccgtgccaaattttccctgtgttcttcagtagatttatcgcttgacattgattgctactcagaaaaaataaatagatatttgacagttaattattgctgctattaccaacagagctttcactgttgtaggaaaaggttaatttatttgtttggtgttttcatgttaccatggcagccaaaatattattaaagctcactaatgggttgtagaggaaaaataaaatttaaaaaaacaaggatgaaattaaacatttttcttcaccactaattgaaaatgagaaaataagtttccgcccccccccccctgccaagaaaatttttttttaaaaatattctcaattttggtattgagccacagagctccctgagaaataatgataaaaatggcatttattcgtgaaggaaggaaagtattaggaaatttaacgccataatcacccacccatccataataagtattatcttcatttctgtacattcttcactttgttcaatgttcgcttttccctctccttgtcgcttatgcttttttggccgccatcattttctttttgagtgccatcgcggaagagcggggcgggcacgggcagtagccactgtctttgccctgttggccgggtgccccgggctgtccgggttggccgctgttgccagacaggccgggca

SEQ ID NO: 40538 - DNA, 147 bp, Heterodera glycines
ctttccctcttttccttttcttctccgtccatctttatcttttccaatgtctattgtctccacgaccaccaaatttgcaaacaatgaggtgaagtgctgcttctgacagagggtgatgttctcccccctccgggggggggggggggg

SEQ ID NO: 40539 - DNA, 1053 bp, Heterodera glycines
  misc_feature (1043)..(1043): n is a, c, g, or t
cgaccctgaaccaggcgtgccaatggatgtaactccaacgttgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagcctcgtgctaggccaagcacgggccctaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccaaccaagcgaggcggcccgccaccgacacattgccacgcagcagccatacacaggctttcacatgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggttgtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcacccggtttaccaacccccctttcgnggactctaga

SEQ ID NO: 40540 - DNA, 836 bp, Heterodera glycines
ttttcagcggacctctcccttttttcatgtataaacacatcatttcggctaatttaaatggaagagagcgataaacataactcaagatggtaacaataatattgagtgtgtaccgccaaaatatcatccggaatgggcggcgcaacgccgcgccaaacgcgcctctcaatgccactcggagacggcgactgtccgctgcttggtttgaccttagatggcactggtgccggtttcggcgctcccaatttgtccgatgggtccaaccgctgccaaaccacaaatggccgctcagagtcctcaattttcttgccgtcggctgccatggtcagaagcagttcagaacaaaatccgatcacatttattatttcatgaataaaatgaaagcacaaataatttgaactgtgatgaaaacagtaaatcttgttatgttaaagacacaaaagtcaattaaataggaaaataaaacaaattttggcaaaaaaattcatttgatataaaacaagaaaaaatgaacgataaaacaattccaaaatttctgcccctaaatttccgttccaacaacaattcacttcatacacatctgaactgctcgtgcaaccgttcgccatgcattatccggcgcatgtcaaacttccgcaaattgaccgtcgaataggcaaagtcgaagatgcgttccatgaacattcggccagcagcgattgccatttggggcccatagccgccgaagccgcacaattggaagaacgactcgtccatcaaatgctcgccaatcactggcaaattgtcgaacgtgttgaagtcctcgtaggagtgccaggcattgatcaccttggaca

SEQ ID NO: 40541 - DNA, 1061 bp, Heterodera glycines
  misc_feature (571)..(571): n is a, c, g, or t
aggcgggcccgccccagggcggactgagaaacaccgcgtcgacgccgtgcggataactgcaacattttttaataaaagtataattgaaaattgaatgtaaaattttcagaattagcgaaatttactgagaaaattttaattttacatttcgggagagaattccaaatttcccccccccccccagagctcgccacagtaaagtagtaaaagtgtcattgatgatcccaaattatgttgttttcccggcactctcatccgatccggatcaatttttggaccagggatacgtcgggaccgggacaatttcaaaaataatctcttccaccaggcataacaacggatggatggtatagggtgggagagagtcaaccacgaatcccttccgaccaaaaatgaattcattctatggcacggcttcctccttcggcctcccaatccagagcctgaccaggatgttcattttttggtgaacatctctggatggatggtatagggttgagagagacaaccaggaatcccatctggccaaaaatgaattcattctatggcacggcttcctccttcggcctcncaattcaagagcctgaccaggatgttcattttttggtgaacatctcttccaccaggcataacaacggatggatggtataggggttggagagagacaaccaggaatcccttccgaccaaaaatgaattcattctatggcacggcttcctccttcggcctcccaatccaagagcctgaccatgatattcattttttggtggacatctcttccaccaggcatagcagcggatggatggtatagggttggagagagacaaccaggaatcccttccggccaaaaatgaattcattctatggcacggcttcctctttcggcctcccaattcaagagcctgaccaggatgttcattttttggtgaacatctcttccaccaggcataacaacggatggatggtataggggttggagagagacaaccaggaatcccttccggccaaaaatgaattcattctatggcacggcttcctccttcggcctcccaatccaagag

SEQ ID NO: 40542 - DNA, 738 bp, Heterodera glycines
atctccgtttggctcaaatcggtgtcgcacaggcgagcgctaaaaagcgctattgaaattttcaaataaataaatattcatcattttgaaataaatgggatgaaccaaagggaggggaggcaatatataaatcggcaaaaaggaagcgaccggagtttggttttggcttgactgccctttatctttgtcaagcgcagtttcaactcagcttcagcagagagtgagtgagcatagaattctgcaaactttttctctccaatgtggggcgatgcaccaaaaatagtaaaaatcggggaaaagctgaagaagagaaaaagaaaagggggagagagagggagagggggagggggcgctttcgcactctgtccattcgcaagtgattgccgggggggggcggcacttccaaataaaagtgtccgtccgttaagcgcacgtttccccatggagcgattgcgtggtcaattgggaagaatgggaagatgaggagaaaagggagggaggcgatcggaggatgagcgacagctgagaatcacagggggaggacggaggcgacggcccaacgaacaccaaaaggacggaaagaaagacccattcctaattgggccaccagaattggcctctccgtccgacatgaagcacctccaaggaagagagggggaagagagaaagagagagagagggggagagagagagggggagagagagagaccgggggagagagagggggagagagagagg

SEQ ID NO: 40543 - DNA, 944 bp, Heterodera glycines
  misc_feature (893)..(893): n is a, c, g, or t
  misc_feature (932)..(933): n is a, c, g, or t
acattttaaatcaaaatcctaataaaaatttcgttgaatttcttcgcctcttatttgtgcaaaatttcgaaaaagtaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgacaatttttaccactatttttctctcactcatcgtctgctagtctctcctttattataagctattttccaaagccaacgacgcccttttctccctcttttctgttagtcatttctcattggtgttgacgatccaacattcagtgtacaaatttgttaaacctctcaacattttaaatcaaagtcctaataaaaatttcgttgaatttcttcgcctcttatttgtgcaaaattttcgaaaaagtaattttctatgtaaaattaaaaaattcagaagcaaattcaagaattttttttatttttaaatgcattttttaccacatgaattatgattaaatttttgcgtttctaattaattgtggaattaagaaaaataaaaattgataagcatttgatcatttttaccactatttttctctcactcatcgtctgctcgtctctcccttanttatagctattttcctaagccaacgcccttttctccctnnctttctgtagt

SEQ ID NO: 40544 - DNA, 1070 bp, Heterodera glycines
atccctcccttttgtgcactatttcgtttcaaattgaatcatttttttttgtcttttgaaataaattgtgaaaaatatacgaaaattattttcggttttaattatgctgtacaatgcttttaagccccgcctgcggcggctccccttttgtgcactattttagtttttaaaattggttccggactttttggctttttgaaataaattgtgaaaaatatacgaaaattattttagcttttaattacgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttcggttttaattatgctgtacaatgtttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccttcccttttgtgcactatttcgtttcaaaattgaatcattttttttggctttttgaaataattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttatctaaaaattcctcttttcgtctaaccatccctccctt

SEQ ID NO: 40545 - DNA, 949 bp, Heterodera glycines
  misc_feature (52)..(52): n is a, c, g, or t
  misc_feature (55)..(56): n is a, c, g, or t
  misc_feature (59)..(60): n is a, c, g, or t
  misc_feature (63)..(65): n is a, c, g, or t
  misc_feature (68)..(74): n is a, c, g, or t
  misc_feature (76)..(76): n is a, c, g, or t
  misc_feature (92)..(93): n is a, c, g, or t
  misc_feature (95)..(95): n is a, c, g, or t
  misc_feature (97)..(103): n is a, c, g, or t
  misc_feature (106)..(107): n is a, c, g, or t
  misc_feature (110)..(110): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (120)..(122): n is a, c, g, or t
  misc_feature (124)..(126): n is a, c, g, or t
  misc_feature (128)..(132): n is a, c, g, or t
  misc_feature (134)..(135): n is a, c, g, or t
  misc_feature (138)..(139): n is a, c, g, or t
  misc_feature (142)..(142): n is a, c, g, or t
  misc_feature (146)..(147): n is a, c, g, or t
  misc_feature (149)..(149): n is a, c, g, or t
  misc_feature (153)..(153): n is a, c, g, or t
agtcaggacggtactgaactggcgagctgtgagagaccattaaaagggaaanagnngannatnnnatnnnnnnngntgcccttttcagaggnngnannnnnnnaanngangngngngngnnnannngnnnnnannggnnganaagnngnaagnattcccgacatttcatttgtaatttacaatctgtggggtgcataatgcccgtgttcagaatgataatctttgttaaatgtctagccgactgaataaagttgattatttgataaattgctattttgaaatttatactaaactattaatttttcttctgttggccatccccgcactatgtaaataaaatacttgctaacattgttttacaataattacgaaaaaataatacttcgcttacccaattgtttgtgtttgttgtacctgttcagtgtgcctattgtatctatcattcatatcattaaacatttcgtaatgttccctcgtcttttccaaaaatgatcagccttgctaattataatcacgttacgacctgtaattgttcaattcaccatccatcatgcattacccgacgaacaatgggacgccgtcatcagcaatcaagcggaagcactcgcactttgacaggagttcgtccagcaacatttatgagaaatcgcccacccaattgtacccgatgaccgcgacagcaatgccgagttcgtccaaaaagccatttgtcagtgcgcagcgtcggtatgacaatgtgcgggtgcgggactccgagttccacacgcgtgtttgtctcgagtgtggcgctgtgttggccggggccgagaaggactaccaagtacgcacaaaatgcccacagccccagggtgtccttttaaatagccgctggtttaattcgactagcaaatttcttgagattttttctgatagcaacatatgtatttaatctatcatctctaaaactaaa

SEQ ID NO: 40546 - DNA, 1403 bp, Heterodera glycines
  misc_feature (99)..(99): n is a, c, g, or t
acagaacacactttgccaagagcccaaccaaaatcggctgagtttgcctcaacagcaaaagaatgtcacaaaatgaatccctcgacaacgcacaacacnagcaacagaaacagcagcagaacccgaacacggaggccgaattggccttgcaacaggcccaagttggactcaatctcttctggctgatccaacaagcggcagcgatgcaacagcagcaacaacaagttgaagaaggacaaggaacggcaccgacttcctctttaactgagtaaatgacaatttgagctcggttaaatccatgccgagttgtaagcagttcgttcttttcaggcgacagaatgtgtcgctgcactcggcactttccaatttggttggctttgctaaggcatcgtcgcctccaaattgtccgtcgccttttttactgccgacacaacaacaagcaaatggaattagtactttgaacgatgaaaaaaggagaaggtgatcggccgaacttttcgggataccgtacccaaaaaaaggaaaatcggtcatttccctctcctctggaaggcgtcagtgactagtgatcagccttgatcagcctgcattcagtagctatcggggttaccgtacccataaaattggccaatccgggacgaccatttccctcgagggactgccattgactaaaaaagagctgcgcacgcatcgccaattccaatcttttagagatttgtcaatcattgggagacggtgggagtatgtgagcgacgtgcagagcttcgtcgagttcgagcagctccgctgccggcatcaagtgtcgcgcaaccgcacattcgctcacggcattcgctattcgtgcacccaaaagacccaactgagaagcaattgcccctatttgctgttgtgcttattctctgatggagcaggtccaattggtgggagatttattccaaattaattagccaattacaggcgaacacagtgcgccgggggtcggcaccatttcggtgtactctcgaaacaaacacacgcacccggtgaatggcaaggggaaggtgccaattcaccaaaagcattccgagttcaggtcaaagtgatcaaagcgcgacagccgcgacgattcgccaaattggcgaaaagagaaaagaaatgggacaaaaaggaggaggaggagcagcagagaaatggaaaaagaaaggggggaaacgaaattggcgaacccaaagagaaagaaggagacgaagagaaaggaggcgaggcaaaggaagaggcggaaatgggcggaatggcgggagaagcactgatcgaatactctcaaaatgttagccgagcagcaaaaggacggcgaaggggcgaaatacgaataaatgggacaagaaagaaagcggaaaagaaagaaagaaacgacgatttaaact

SEQ ID NO: 40547 - DNA, 1451 bp, Heterodera glycines
cagggaccccgcgggcagagactttctccaggcgcgcggcactacgccgagaatgttacgcggcgcagaaggaatcatcgaggcaattgagaagaaattgggttggccaaaaaggcgaacttttaaccctttttatgcaaagcgaatttaggcatcaaaaagggagggactacggcggacggactcttttcgctgcatgaggtctaatggctcgcggcttgtgttaacgctccgatggtgcaggtgtacttgccatatggcttctgctatgaacttttggagagaagttgacagatcactgacgaatactacaaagacatgacccctcgggagattgaagagataatcggcgagttcactgcgtctgagcgacctttgcccgggcctctgatcttttcgtatgagaccgctgacccgtcaagctccagaatactgtgacggaaagaccgccgagtttgcattttggtcttcgaatgcgatatttcagtactaattttatatatcattgcacattacattcctcgttttatataaccccatgcataaatgggccgattcaaccttaaaagcagagagacagacgctttttataatgtaacgcgaaaaatatggagtttttcactccatctgcgcgtattctgaaatcgcttctcttcttttttaggaaatcgatgagacggaagctcgagaattatgaagcgtaatgaccagcaattttgtataataattaattgaattcgatatttcagtactaattttatatatcattgcacatttcgttcctcgttttatataaccccatgcataaatgggccgattcaaccttaaaagcagagagacagacgctttttataatgtaacgcgaaaaatatggagttttcactccatctgcgcgtattctgaaatcacttctcttcttttttaggaaatcgatgagagggaagctcgagaattatgaagcgtaatgaccagcaattttgtataataattaaaggaattcgatatttcagtactaattttatatatcattgcacatttcgttcctcgttttatataaccccatgcataaatgggccgattcaaccttaaaagcagagagacagacgctttttataatgtaacgcgaaaaatatggagttttcactccatctgcgcgtattctgaaatcgcttctcttcttttttaggaaatcgatgagagggaagctcgagaattatgaagcgtaatgaccagcaattttgtataataattaattgaattcgatatttcagtactaattttatatatcattgcacatttcgttcctcgttttatataaccccatgcataaatgggccgattcaaccttaaaagctgagagacagacgctttttataatgtaacgcgaaaaatatggaggttttcactccatctgcgcgtattctgaaatcgctcctcttcttttttaggaa

SEQ ID NO: 40548 - DNA, 866 bp, Heterodera glycines
aaaaagggggtttgaaaagtttttttttgaaaaaaagacttttccaaataatacccttgggagaaggggagtgggaaacaggaattcaaaaattttccatttttttatagtctaatctactcaaaacggttccagaattcaattaaaaataccattcacggtgcgaaaaagggggtttgacaagtttattggggaaaaaagactttacaaaataatccccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccttgggagaagggagtgggaaacatgatttcaaaattttcaattttttctagtctaatctactcaaaacggttcagaattcaataattttcctgcgccgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagcttgctctaaaaaatttttcgaaaatctgagtctttcgtttttatttgttttttgcataattaattcataaatatttttttcagaaaatgctctgaaacgcaccaaattttatttacatgctagtttaggcactctgatgctttttctatcaaa

SEQ ID NO: 40549 - DNA, 336 bp, Heterodera glycines
gaatgtacaatgagcgttcgtttatatcggtttggctataattcactaaatacggtagttatagaaaaaccgatataaacgaacgctcattgtacactctctcatttagcatgcattgaaaatcacccggacaagtggctgtcacggctggccaacagcggctggctccagtacgttgtggacgcgctgaccgccgccgccacggtggcccaagtggtgcactgcatggacgaaggtagtggcggaggtgagagaagagcagcggcggagaggtgccgtgccggaaccgaaatgggactgactttgccgtccccggttcccaagggaaatttgtct

SEQ ID NO: 40550 - DNA, 296 bp, Heterodera glycines
ggcagcatcagtgccgaaggccgcggggccgccgaaccgatcgtgcagtgcgagcagcgcaaccgccgcgagctgattgcctgcctggcaccgaaccggcgggtgcagatcgcgggaatggcccatccgcgctgagattcctgcaccggggcatgaccccggtattccgagtcccccctgaccgtcggcaggacgtggcaacgtctcccccgtcaaccacgcctgccggcggctcaggttttccatggtgcccgcgatgaatgcccaattcctgcctctttccatgaagacggaaa

SEQ ID NO: 40551 - DNA, 1036 bp, Heterodera glycines
  misc_feature (1010)..(1010): n is a, c, g, or t
  misc_feature (1028)..(1028): n is a, c, g, or t
cgctgctcgtccgtcacccacccgtcactgttcgccgccgcttctcctcccttccattccatttcgggcccatttgttgtcggcatttgccaatgatcagcattgccctgctgctgcactacggcattttgttgtgccaccattagtggtggtgttggcttttgatgttgccgccatggtcgaccaccgtcagctgcagcagaagtgccaccaccgacagaaaagggaccaccgtcataaccggagacggcaccattgaagcttaagtgaaatgcgatggaggggcaggggtcattaaggtggattaaggctcaaagcgcaaggctaattggtttaatgcactaaacccatgcctcagcgcagggcagcgatgcggacggaaaagtgccgaaagacgcggaaaaaggggagggcggtatggcaaaaagtgatggcacgaaaggacactcgcgaacacaattacaatcagctggtgaaaatggacgacagagaaatgagacgcgacacgccatttttggttaacgaattttttgaaataggataacagagaatatttagagctattgaatgagaaattttgggaatgattgactcggattcgaaaaggatcaaaatggatgccagaatcggattctccgaccctgaaaccccataaaaataaaaaaaatttcgaaaagggtggctaccatcagaatattaccaaaaaatgaaatcgaaaataataagccaactcgttttttgttttgttcaagtatttcaggagtttagcggtttatgcgaacggagggcgtagccaaaccttggcttcgggggcggcggttgactaacccaccccagaagagcgacgaattgaccgtttgcccttcgtccacttatgtttcgccacaattttaagtaatttttgaatggtagggggtgaattttggccgcgttcaacaattttcttttcataaaaatagagtgaacatgagcaaaaaaaaaattttttttgtttttgcccgaccagaccngaggccccaatcccaaanggtattta

SEQ ID NO: 40552 - DNA, 767 bp, Heterodera glycines
attaaagtacaggctatagggaagctactcccgaaggattcgtgtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaataaatcgatttttcaagtgtccgtttggggtactcaaacatttatgggagcaaaatccaacgcagaattaaagtacagactatagtgaagctatttcggaaggattcggtctccccataatctgggcgcatccgttcggggggactgccccgaaaacaaaaataaatcgatttttt

SEQ ID NO: 40553 - DNA, 897 bp, Heterodera glycines
agatatttattagtaagaaaagctacctttgtttgtaaaataaccaaaaatattatttaaatgttcttctataaaagagacggcatttgtcgtacgtaatccttttaccaatcatggcttgcgattgtccgtcacagttttccaccgtttgcgtcaattcgccccgtcaattctcaacgatttgccgttgttatgcattggcaaattccatgctcatgatgatgatgttgacgatctcttcgccgaatttccatgcaatgacagtgccgcggcatcagatggacaagcggtggccaaatggcttttcactccacttcaaagcaatgtgccaaaggtgttcaaatgcgggttggacatggattatgtgaagaattggtcgtcgaatattgaacaattcaaaacggtgcattcatttatctttcatttttctttatcaatttccccatattttaggcatttgcctcggcttcttcccccgtcaatttcatcgttttcatttgcattccgttgccttttgctgactccgttttggcctttgattttaccaacgaattgactcgggaacaattgacactgaaaagaactgactttcactactgttttctgttcgtccgttgtccaattgcgcgagacgaaagcaaatggacaaaatgggaagaggaagcgattggctggcgaacagatgatccctggaacagaattatcattcatattagggttgcaaccccgaccccgccccgaccccgaaccccgacataacccggttgactgtttcctttttaatttatttttatgtgattaatagaattctcctaaaagtctttagaaaaagagcgccgcgaaaaaaagatgattcgaaaaacaaaaaaaaaggaaaggtgatcagaaatttttggg

SEQ ID NO: 40554 - DNA, 1375 bp, Heterodera glycines
ctgcttttgctgctgttcttctcgttgctttctctgctgttcttctctctgctttctctgctcttcctgctgctttctcttctgctgctcttctcgctgctttctctgctcttcctgctgctttctctgctgctgctcttctcgctgctgtcgccgtttatcctcctcctccctctcttttttgtctcgctcatgcttcaagcgaagttgatcaagttttgtgcgatttttcaacggatttaatggtgcttcttcaggctcttcctcctcaacgacttccatgtcaacaatctccccctcatccgggtattgtattgacctttttcgggtcaggtgtcgttccatttccgctatcatgccgtggtgcattccccgttcaagctgctgaggcgaaaggaagctgccccttggcactctgaaccggaacttgagaccaccgcgcaggtgcaccactacgtattgcctctccagggtccctacagtcgcccagctaaactgtacaagggcaatgagaactgtacaaacccacccacctgttgggatatattatgccagacatgcccaccatccatcccggcccatcaaacactaatttctttggcaagtgtactttgaatttattcgttttattgccgacaaatcccggcgtattgctgggcaaaattacaaagaaagagttgctcatttcaacgaaaaatcaatgaatgaatgatcagagatcacttttccatcttaaaataggtgttccgtcctacgttcttctgtgcagatggtccgtcatctttcttttggtgtttcatgatcaggtcggtgcagtcaaagttcaacttggcacagtcttggcagaatgtttgggtgaactccagcttctcttggccactgccagtgttgaggatgaagcgcttgtcgcctcgcttgaagttttcgttacggcattcgttgcacataaaggtgaacaccccatactgcaacggaagaagaacattgtagggctgccaccagagcaaacattacctttgggcgtgcgagcttccagaaaattgttgggtagtcgaagacgttggctgctttgcgttcgtcgacatctgtgacttcaacctctgcggggttggacttctttgcgttgttcacgtcctccagcagtttttcccagcgagactttcggcccctcttcttgagcacagggcgttcctctgcgtgagatgactgagagttaaccaatatgacgtcatcatcaatatctgaaaaaagagaaaaaaatccaaaatttttgtaaaatttatgaaaaattttacccattttatgttttctttgattgttttgtgcttcttccacggtggttcgcttctataaaatgcttatattttgtgtttta

SEQ ID NO: 40555 - DNA, 188 bp, Heterodera glycines
cggtgtcatctatgttactagatccggggatcgatccccctttttggccgctcgagcaggacctgcagaagctagcttgatggggatcagattgtcgtttcccgccttcagtttaaactatcaagagagggaggagagcggcgcgtatcgggggaggtgggtggcggaagaagaaaagggtgggggga

SEQ ID NO: 40556 - DNA, 1219 bp, Heterodera glycines
aaaaaaaaaaaatttttacaaaaaaaatcaactcccccggggggggggagggggggggggggaaaccatttattttcaaaaattttttattttttttttttttttttttattttcctccaaaacgggtttcaatattttaaaaaaaaaaataacctttcccgggggggaaaaagggggttttaaaaattttttgggaaaaaaaaaaacctttacaaaaataaatccccctggggagaagggaggggggaacatgtattccaaatttttcaattttttttttatttttattttcctcaaaacggtttcagaattcgaaaaaaaataccattcccgggggggaaaaatggggtatgaaaaatttattggggaaaaaaacgtctttacaaaataataccccggggagaagggagggggaaacaagatttcaaatttttcatttttttttagtttaatctactcaaaacggttcagaatccaataaaaataccattcacggtgggaaaaatgggtttggaaaagtttatgggggaaaaaagactttacaaaataatacccttgggagaagggagtgggaaacatgatttcaaaattttcaattttttctagtctaatctactcaaaccggttcagaattcaataaaaataccattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactatacaaaataatacccctggagaagggagtgggaaacatgat

SEQ ID NO: 40557 - DNA, 858 bp, Heterodera glycines
ggggggaattgccccggaaaacaaaaaaaatggattttttcaaagtgtccgtttgggggtactcaaaacatttatggggagcaaaaaatccaaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaaactattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaa

SEQ ID NO: 40558 - DNA, 925 bp, Heterodera glycines
  misc_feature (42)..(42): n is a, c, g, or t
  misc_feature (102)..(103): n is a, c, g, or t
  misc_feature (105)..(105): n is a, c, g, or t
  misc_feature (108)..(108): n is a, c, g, or t
  misc_feature (119)..(120): n is a, c, g, or t
  misc_feature (152)..(153): n is a, c, g, or t
  misc_feature (155)..(155): n is a, c, g, or t
  misc_feature (159)..(160): n is a, c, g, or t
catacctatatgcacataaaagttattttttatatccatttncaatacaattggcaatgcttgcgatactaatggaattcactgcagctaatttatctaganntnaanttaatatttcnncataataatttctgatttttctcaagtaatannantaannttcccattggccatagtgtttcaattcattttatttatccttcaatttatgctttcgtttcgctgctttttgtactcaaaataaaccaaaaagcgtgttttttgtacggatgtgagaaaaaagttagagttgacatgaatcaccaccaccaatttgtcattaaatggcaaatccacggggggagggtggtgattcaaaatcgaattaaatggtatatgagtcaattaggaaaaataattaggatataaaatgaattttggacgatgttattatgagaccaacatactcaatggatgaatgatgcgtgccaaaaaaagatgaagcaattttttcctactatataataaaaatcacgccttaatattgtacatttaaaagccgaatttgtccattaatttattatataaatcaaaaaaaaattaaattaattagaaagattatgaacaaattgatgcaccaaataattattaaactttcgcctgttcgcgagaaagctgtgaatccgctgtataattaacccccaaaaaattaaacattctgtgcaattgtcaaaaacacaaactataattttatgttccaaaatttagctggggtgaataatgaatgggaatccaaatttagaaaacatttaaattagttaattaaaaatttaatcaattgttaaccaattattaaccgaaaatttaaaacccttgtttgcaatctgaaatttatcctgggagggggggggggggtataacgttcacaagtcggaaccatggatag

SEQ ID NO: 40559 - DNA, 246 bp, Heterodera glycines
gttgtgatcaataaatagcctgctaatcaatgtggtttaaaccccaggttctggccattgggattctcagcttttccatggctgatagagctgggaagtttcttcgagaatttttttttaattaggaaaaattcaaaaaaactcagaatttctgtgggaggggtggggggattgggggaaatgaactgcttgctccttcctgccactaaagaatttgtaacgattttttcgtcagcaatttcaggg

SEQ ID NO: 40560 - DNA, 184 bp, Heterodera glycines
cagataatctttaataaattgtaactaaatttttcctaattttcgccaacgagcaccaccagacaaattcattttttaggtagcgtatacggaagtaaaatgacgaaatttcgggggttacctatgaatgtttgaattatgttcatggaggacggcacaatgttcagttttatttttaaattta

SEQ ID NO: 40561 - DNA, 998 bp, Heterodera glycines
ggaatcccggaaggtcgtcgaagacccactggcaaccttcaccaagtggttgctgaacttcgaaacggaagtcctcggcatggagcccggtgcgaagaagcgcagaaaaaggaagaatgccgaaaacaccgacggcgaggctatggaatgcgaagaagaagaggatgccgtagatgaggacgccgagaacaactggatgctggggtatgaagaagccggggagaagccggagtcggtgacaacatacgcgtacgcccacgccggtaattttggaattattttaaaaaaaaacttggaagaaataaaatttaaaggttcccgctacgatcatgtgctgatttatggtgaaatgctgcgcatgggtgtccgccctgaactcatccgccaggggaaccatctcctggaaatgaaggcccgcaaaacaggagtctacacaaccaccgttttccgggacaggtaaatattttgaatattaaatatttttaaaatttttgatcactttagttacaagttgatcccaataaaacttgccaattttgtcaagacgtttggcctagaaattgagggcgtggaaaacaagaaatattttccacacaaattcaataaggtaagaggaatttataaaaaaattaaataaaaattaatacaatcttaggcggaaaattatggcactgtgttggacaccctgccaccgattgagaattattacctcaggtggactcttcccggcagagcgcgcaaagtttgaacaatggtacgacgagaaccgggaaactggttttgagctcagtgaagtcatcgcggactactgcaagacaggtacaatttttgaagaaaaaacgtgcaaaaataacgaaaaaaattgaagatgtccaaatcctggcacgtggtatggtaaagatgaggcggctgtttttgtctgagacgcggcacgacgtaaccgactcggtcaccgtcccgtccggttggcggggtgggttgggtgcagttggctcacc

SEQ ID NO: 40562 - DNA, 925 bp, Heterodera glycines
aaattatcagagtgccgaaaatcgcatgtgatctaagtctccacagaatggtctaagtaaaaatcgtaattacgctcaaaacgcttctcaaacaattttagcgcttccaattccttctacaatcgcctttatacatcccattatgagcgctaaaattctcagagtgccgaaaatcgcatttgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagcgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaatggtctaagtaaaaatcgtaattacgctcaaaaagcttctcaaacaattttagcgcttccaattccttctacaatcgcccttatacatcccattatgagcgctaaaaatatcagag

SEQ ID NO: 40563 - DNA, 917 bp, Heterodera glycines
  misc_feature (51)..(51): n is a, c, g, or t
  misc_feature (56)..(56): n is a, c, g, or t
  misc_feature (61)..(61): n is a, c, g, or t
  misc_feature (64)..(64): n is a, c, g, or t
  misc_feature (66)..(66): n is a, c, g, or t
  misc_feature (99)..(99): n is a, c, g, or t
  misc_feature (101)..(102): n is a, c, g, or t
  misc_feature (109)..(109): n is a, c, g, or t
  misc_feature (114)..(114): n is a, c, g, or t
  misc_feature (275)..(275): n is a, c, g, or t
  misc_feature (279)..(279): n is a, c, g, or t
  misc_feature (318)..(318): n is a, c, g, or t
  misc_feature (343)..(343): n is a, c, g, or t
cgtacttttgacccagcgcaattctttaccggagcggaccttttaagatgnccggncccgnacngnggacccagcgcaactctttaccggagcggaagnannaagaggnccgancccggcggacggagggcccagcgcaagacagcaccggagcggaatcgagaagaccgccggccccggaccgacgacccagcgcaaaacagcaccggagcggaagagaaaagaagcccggacccgcaccgaggacccagcgcaacacgacaccggagcggaanaaanaagagaaccggccccgaacgcccggcccagcgcaacacngcaccggagcggaagaagaaagaanaccggccccgcaccgggggcccagcgcaacacaacaccggagcggaatttttaagatttccggtcccgtacttttggcccagcgcaattcttaaccggagcgggattttacgggatttccggtcccgtacttttgacccagcgcaattcttcaccggagcggaatttttaagatttccggtcccgtacttttggcccagcgcaattcttcaccatagcggaatttttaagatttccggtcccgtacttttgacccagcgcaattcttcaccggagcggaatttttaagatttccggtcccgtacttttggcccagcgcaattcttaaccggagcggaattttacgggatttccggtcccgtacttttggcccagcgcaattcttcaccagaacggaatttttaagatttccggtcccgtacttttggcccagcgcaattcttccccggagcggaatttttaattttccgggcccggacttttggcccagcggaattcttcaccggagcggaatttttaatatttccggtcccgtacttttggcccagcgccattcttccccggaggggaatttt

SEQ ID NO: 40564 - DNA, 712 bp, Heterodera glycines
tgatacgatgcagatactgtttcttagatttattgatcttaaatcatgtttatatgtattttttaataaatcgatgcaattttattttatttattaaaataattttacattataaatattttctcattaatattttgcaagttgttgatggctcttttggcgaagatactccggccgaaatattgcacgattagtgcaaattatttggatttttaactagctttcagtttactattctattccgcttttcttgaatttatgcaattttttttaaaaattaaatttacatataatattttctcattaatatttctaatttttttaaattatatgttatttatattcatattaaaataaattttttctcaactcggacaacaatttgacaatcatcctaaaaattcaagcaatgagaaaaaaacgaaatttcgatttgcaccccccccccccctccccgacctgtttttgttccgccggtttcaccacttttttaatacgttctgtgccgcttggattgggaatggcggatgtccttttgacgggacgtgaagacgacactgacaattgttataaaattcatttattttgtaaattgaaaacaaaaaaatacatttattttcaaaacggcataaattaatgcagataattaaaaataaacaatgaatttatgagacaacaacgaaaaataaataattgaatttatttttacaca

SEQ ID NO: 40565 - DNA, 920 bp, Heterodera glycines
tattaaatagaatatagataatattccattatttttttatatctctttactcaaatacagaattattgagttttttcatttaaattttttaataagatattttgttaaattaatattacaacattaatattcaacaaaacttaaacaattaattatatgttttttcggttacaataaataaaatatttattaattttattattcttattaattttatttaatacagttattaacatttaataggtttaatttatttataatttgtttcattaattaattgtcataattattttagcgtccttgactttattttcttttttcctttattattgatttaaatttttaatttgaaatatgctcaggttaatggttgatttattttttacattataatttttcatcgttaaatttatgtactcctatgaaatattttttgtctaccttggcatgaactgttccatcttttacaaaatgaaataagtttctaaatgtttttaaaaattaacaatagattcaatttaaacaaaatcgaaagaattaaagcttaaaaactaaaagtaaaaatggtcaatggtcagccttgcatctctttcactgaggctgcaataaggcacggtcttcttgaggatgacaaaatatgggacaaaactctcgctgaggcagcattgtcccggtggcctgatcaaatgaggtggctcttcatgagcatcctcgtttatggccaccccagtaatgccgtcgaattgtggaacaagtacaaagaccaaatgtactttcctcaaggcattaccacaccggcacaacgccaagcagcagagcttgaagccctagccgaccttgattggcggctgcacagctgctttaacttaagctgtgtgcattttggcctgccaaaccccccaaactcaattgccaaaaat

SEQ ID NO: 40566 - DNA, 103 bp, Heterodera glycines
caggcgttgtcggcatcgtgggcgtgcagcttcgtcgagcgcttgatgtacttgccgtacagcgcgtgcttgacctgacgctcaaccaggacggtaaccgtct

SEQ ID NO: 40567 - DNA, 1203 bp, Heterodera glycines
tcagaattcaataaaaataaccattcacggttcggaaaaagggggagtggcaagttctattggggaaaaaaaagactttaccaaaataataacccctgggagaaggggagtgggaaacgatgatttcaaaattttccaattttttttagtctaatctactcaaaacgggttcagaattcgataaaaataacattcacgttgcggtgcgaaaaatgggggtttgacaagtttattgggggaaaaaaaagactttacaaaaataatacccctgggagaagggagtgggaaacatgatttcaaaattttcaatgttttctagtctaatctactcaaaacggttcagaattcaataaaaataacattcacggtgcgaaaaaaggggtttgaaaagtttattggggaaaaaagactttacaaaataatacccctgggagaagggagtgggaaacatgatttcaaaattttcaatgttttctagtctaatctactcaaaacggctcagaattcaataaaaataacattcacggtgcgaaaaaaggggtttgaaaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttggaaaaa

SEQ ID NO: 40568 - DNA, 558 bp, Heterodera glycines
agaaacccattgccccaatgtgtacattcgtccacctgaacactctgtccaagaaatcgtcctccttctgtcccttcgccctgcacatttccttgcgcacggcgtcaattacttcaaagcagatgctttccccttcactgtcacagtccaaaaacaacaataaaaactcgcaattcgccgcctcggaagcgaggaactgaacaaaatgggggagggctcatttccaaactgatttatgaacagattttggcaaaaaatatgatcaattttcttcaggttgggcaaatttgaaaaaaatatatcaaagaatttgtacactcttgatgtaaatggcccgaatttggtataaaaaaatagggcaaaaaacaacttactgcattcaaattgtgcattgggttggtcattctcggctcaatggggcacttgaaaaggacctttgggtcgtcgttccggcaccaggaagtgaactcagaggtaaaattggtgcctaaaaaccaggaattaaagcaccaattaagtggacgattgtcaaaaatagaattaattttttgaatttga

SEQ ID NO: 40569 - DNA, 905 bp, Heterodera glycines
cctccgcttttacctttgccattgtccctccgctgagctttttcagctgacgcccttcgtcgacctttgcggttgcttctgtttctgctgcggcggatgttggcccttccctcgatgtccgcccaacttttgctgcagtcccttccaccgtttgatgcgtttgccgccgttggccaccgccacactgtccgaagtgccatcggtgtgattttcctcctcaaaaatggacgacgaagacgacgaagcggaggaggaggaggagccgaagcagcagcagcaccagcgcatgcggacggagcagagaagggaaaatgggcggaggaaaagtcagcggacggcacaaaagagacggacggggccagcagcagaggaaggcattggacaaaggcaaattgggctaattgagcagcacaggcacaacaattgggcctatctgctggggcggcacggaatgaacgcgggagagagtggcggcacgccagtggcccaaaaacagcgaaaattcactaaacgtcactttattaatgcttattgttattgtttgttatgtttattttgtggggaaaagcggatgaaaagagtcggcagagaaaaaaaactgtcacaacaaaaggcaaaaaaaaagagggagaaaaaatgatggacgacgtaaaaaaagggggggggggagaaattgcgttaattacgggggaagacacttttatattattcattcatcgctctctctcgttataataatcatccgtcgtcgtccatagcttcgatgaattgatgagatgggaaataaacattttatgggcgcgggaggggaaatattggccagggacccgggaaagtgcccccccccccccggggcgggagaccaccgccaaagggtcgtccgccgacatcgcttcacttcaccc

SEQ ID NO: 40570 - DNA, 338 bp, Heterodera glycines
aaagcgcttcgcgctttcggagcttcgctacctagattagctctgagttgtgaagatatttggaaattttaaaaaagctcagacgggcgctttgcgtccgtttttaaattttgttagcatagacgggcgcttcgagcccgttttttaaattttgttggcatagacgggcgcttctcgcccgtttctaaattttgttgtgctcttaaggccgattcgcagcctcagacgggcgcttcgcgcccgtttctaaattttgttgggctcttagggccgattcccagcctctgacgggcgcttcgcgcccgtttttaaatttagttgggctcagacggtcactt

SEQ ID NO: 40571 - DNA, 1100 bp, Heterodera glycines
  misc_feature (1033)..(1033): n is a, c, g, or t
tttccgttttttcttcaattttattaataatttttgtctctttttcattttcctttttgaaattttcttttgcatctgtaacaatttcttctttatctaatgaatctgaggataaataatcgtttgcactgatatattcggtcttaaagttttttctttaaaattttggcattttaactaataaaattaccggtgataacagtttcctaatttttgcattgtcttcgccttttaagaaagttttcaacaatttctctaaatgaaattcgcttttattttttaaaatctctatatttaaattaaccattttttgagaaaagttctttgaattcgtccccttttgattgattgtcaattaattggctaattttctcgaaatgcattctcgacaaaaatttatccttttttgttttcctttttaaatttttgctcatacaaataataaatgttacgccaattgactcagcaaaatttctcagtgctttctttttgctctcataatttttaattcggtccattttgtgcatttcgtcgaatgattcttccgcgcatatttttagtgcctttaaaagagtgacgtcttccggcccattctcccacaacacaaagaattcctggcattaacatatttaaaattatctttaaaatttaataatgtaaaattgttatttgtatttcggttaggcatttagcacatttttgcttttcgagcagctaaaaatccaattttactaattagaatgaaaaatatttgatgcaattttttgaaaaataaatctttatgtattgctaacgaagatccttttacaaattccattttagtcctcattaactgtggattaaacttaaactaataaaaataattaaacaattaattaaattaccttttgcttttctttagccgttttcttctcaagtgtaatgcgattttccacaattaattgctcaattttcgctgcttttcccttactttcgagcgcaatttgctcgattttgccacaaatttctttgtctttggtcaaaatccttccanaaatacagccaaatgtcttttaaatcgtcaattatttcccgtcgcatttccataaattcgttgtcgt

SEQ ID NO: 40572 - DNA, 808 bp, Heterodera glycines
  misc_feature (775)..(775): n is a, c, g, or t
ccaacccgggaatttttaaaaattcaaaaaaatttaaaaaaatatcaaattttaatttatttcgagtgaaaaaatacaaaattaaatttttattttgttttttatttaataaaatccaaaagttaaagctaaattaaattaatgaaaattttcaaaccaaatttatttcaattatttcaaacaataatcaattttggacctacataaatgatcgaataatattaaaattgatttacttttcacatcactttttttaggcacgttttttccaaaaaacttttggggaagaagggggtccggcggtgccgataggcggaaattttgaaatttaggtgtaatttgttaacagattttcaacaaaaaaggttggtttttgggattactaagctcaatttgtacggattttctttaaaaaatgataaacatgtatcaattaaaaaaacaatgaggaatcatattttgtcgatacgaaaccaatgagtgtacaaaaagaaaattcaaaaatattttattcctgtagagggattgaaccaagggaaggaagaagggaaagtaaaggatactagccactaggccatttgcacaattgtcagtgcgacttttaaagaatatattaatgtttttttttttaattttttttctttaactccaagtttcgttcctaatttttcactcagacccccattcttaccagtgcttgtttttcccggttgccctaccgggaccgggacctgagcttttcaaaatccgggaccgggacctctgaggaccgggnattcccatcccggtcccggcgcactctactcta

SEQ ID NO: 40573 - DNA, 451 bp, Heterodera glycines
  misc_feature (401)..(401): n is a, c, g, or t
  misc_feature (432)..(432): n is a, c, g, or t
tggatttctatatatttttttcttatttcgcgatttatatacctatttccataaaaataagaaaaaaatgacaatttcgcttttcaggttgatttttcgctaaaatgagtaaattttaagctatgttatgttttttccttctaaaatgatttttaataccatttttcgccatttttgaaagttttactgtgcgtttagcatatttaagaaattttgaaaaattatacactcaatttggaaaaatctgtccatttttttgccattttatttccatatttcgcgatttttggtccatatttttaccagccctagttataagattctcttttcattatttcttcaatatgtttggcaaggcattgacggacggacataagcacaaaagtgatatgtttgtgctngtgttggtggtgttcaatttaatgattttancattttgaaggcgcatttt

SEQ ID NO: 40574 - DNA, 1007 bp, Heterodera glycines
  misc_feature (860)..(860): n is a, c, g, or t
aaaaactcacccataatccaatgattttttatttaatgtatgtgaggacgcatcaaaaaacatttacagtaagcaaaaaattggatgatttcttaattgcctgctgtccccgccccctgggcctaatggcatttttattttttttatgatttaaaaaagaaattatttagacgaatttatgagatgggagggtgagcccaaaaagcttggaatcaccggaatcagtgtgaaatgtcaacacaaacataattttatttttttgttggtattttgagggtgtacgcaatctgtggatttccgaagagctttctcggaaaaaaatatatattttaaattttattaattatttttgtatatgttcattatggaaaatagttggaaagactttgtagaaggggagagagaagagagagcggtggaaaggaaggagcagaagctgtgagaattggaggaaaatatttaaaaattcaatcaatatgtgtgtgtgtggcgatttttatgcaatgcaatgattaatgatgcgacaatatgtgctgagcatttttaaaaggtgtccacccgcaaaaaaaggggaataaatgggggggggggaaagggatccgccgccatttcccatttccatcaaatcatcttctgtatatagtaacaacaacaacaataacaaaacaacaacaataattgcataggtacaataataatcccataataatattattggcaacaaaaattcacagggaaaacggtgagccatccgccggcggcacaaaaaaacgccccaaggccaaattgtgaaaagggtcagtagagagcgaaagagagtggcatttgtatgtgtgttgctagtcggtcgtcccgtctcnaaaagtcgtcagtaaatgcgctcgtagaacaataagaatgcctgtaaaaacaacagatacaaattaggaaagagtttttgtcggaaaatattaagatttttccaatttttccaaatttttaatagaaaatccataaaatataattat

SEQ ID NO: 40575 - DNA, 770 bp, Heterodera glycines
tatctgttccatcaaacttacatatcaccatggcaccgtttttatggatttcattattttttaacataatatttcaccctcaaaatcaattaatgtattatttttaatttaattttatgcttcttggatgcatttttatttccatatttttcaatatataaactatatttcgatatttatatgaaaattcaagaatcccactcattttaatcgaatcttttttcaagatttattgttttttagtgtaacaactttcatttttcaactgtttactgttgtttccccttctacttaaacaatattgcattgtattgtaatttgtaactttctgtctttgtgttttcttttcattaataaaaaattttctcttaaacctcctctaataataagctgcttttcaaatattgctgctggcaattttgttgaatttctaatgattttgaattgcctgtccaatattgttgcggtacccaaatgtccctccccccaaattcgttttaaagagttaaagctgggcgggaggacctccagtacttttcatcttcgatccagtgttttctgtttttttagcttttttattgtaaatggcattttacttataattcttttgccaacgcatgtcccttcatttgcggcccgacgcttgcgcctttgtccaaaatcgggtcaaaatacagcttttttcagtacctgatcgcctaaacagctttaaataagcgattgaaaatgattgtctccaatcatttgatcttcaatgaatttttgaaaaa

SEQ ID NO: 40576 - DNA, 890 bp, Heterodera glycines
atgtgtataaaatttatcaaaaaaagagatagacattctttactgggatagagtataaatttaaaaattccctcaaaaataaaaggtctattgcgcaccgccctccctatcatgctcgagagcatttgtatgtgtataaaatttatcaaaaaaagagatagccatttttctgggatagagtctaaatataaaaatcctctcaaaaataaaatggcgattgcgcacagccctccctctcatgctcaagagcttttgtatgtgtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcaccgccctccctatcatgctcgagagcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatataaaaattccctcagaaataaaaggtctattgcgcaccgccctccctatcatgctcgagagcatttgt

SEQ ID NO: 40577 - DNA, 1434 bp, Heterodera glycines
aaattgaaaaaggaaatcgaagaagagaaaaccaaaattgaaatttggaaccaaaaatcaaaccgaacaaagaaaaagcaaaaagagagacgaaaagcactttgggaaaagttcaaagaaatgaaaaagcattttgccaataaattggaggcaaacaattcgactgttggtgaaggcggcgccaaagaaatcgcttgagatttcatgagaatggatttgatgtattttgagattttattcttttttttttggggggggggagacgtatatcttttgatccttggggcttttcatccgttggctttatcctttattttggtttttctatcgggaaatttcatttttttccattttgggattttcagggcaataggaaaaaatccgggaatgtgagctcaaattaaatttaactgaaaattggattgaaaaaaaaaattccaattttaacgagaaaattatgaaatttagaaaaatgaaatctattggcacaaaaactcatggggaaattcctgttgcccagcagaacattattggctatcttcttggtgattatgattattattatatcacttttgtacattcatttccttggattttcaattttactgtcctttttaaattcttttgtataaagttttcctaaccacattttgaccaaaagattaatcattttgttgatgggtgactgatttttgacagaaattctaacaataagtatttaaaaatatcttttaaaacaaattttaatgggaatttcttttttgaaggttatttatgtaattctgaaaagtatgtttgtgtgggatattgccgaggatggggttcaataacaaaagattgattaccaaccgacaaagaccaaaaaatatttaaaaaaacatctttttgttttttttcaattttttttttgatgaaaaaaatatatatttaaaaaaacatctctttgttttttttcaatttttttttgataaaaaaaatatttcgtttcgttggataaaattaatccagatttcatactgaaacattgatcccgacttcgacgaacgactcaagtaggaatgaggtgataataatttgggtagggtaaagtgattaataattgaggcatttagatttggatcaggcattcagcaggcacagtgattagtcaatgtgccaaaaatcttttaataatcaattttgataaatactgttttgagtgtactaatttatttgtttgtttaaatcgccaaattatgcaaaatgttcaataacaaatttatcattaaaaacattgaaaacaaaaattatgttttaaatttatttgatttcaatccaaagattttttatattttttacataaagttttctgttctcattcatatgcaataacatttattgtaaacatttcaccacctaaaataaataaataaatttaaatattatattttttaa

SEQ ID NO: 40578 - DNA, 874 bp, Heterodera glycines
  misc_feature (823)..(823): n is a, c, g, or t
  misc_feature (836)..(836): n is a, c, g, or t
aaagaatgcatatatcctaaagatttgtccggtgccgtcgcgtaaaattgacaaattttgggagttaatttttctgttagaaaaacccattaaaaaattttttggtaattttttcgagtttttttctacctaaaaaataagaatttttcaagttttctagaaaaaaaaattcaacccgttaaatttggctattgcatttaaaaaaaatccatagataccgccgccttgataattggccattttttcgtgatttataccaaatcctcccgatctctaaaaaccccacttggccaagaattctttccaccccgagacatcgatagctatgacaatccttaattttaccattttttggtttaaaattaagagaatttgttccaaattattatttttttgcagtattcggtgacgcacaattgttaattaattattcggatgcgctttttcatgatggcacaacactgatccatgtgattggcactctgtccgctcagctcagtgtttggattcgttggatggattctgaactaatggagaagcaaaattcaatgcggatagtcgatagaaaaatctacgagaaaatatgggccaatgcaaggctggaatttgaggtgaagaagggggtcttgttggaacttttcgcaaaaaataaaaatacgaaattgaattgcacaaatattgaaaatttcgccaatattatgattttgataattagggctgccaaaaatatttgcaaaaatggtcaaactatgtacataaatatgtaagaaaaatagccaattatgtaagaaatatatacaaaaaacccaaaaatatgaactanatatgtaaataanattttaaaatggttatttttttgaaaaaaattcttcgt

SEQ ID NO: 40579 - DNA, 924 bp, Heterodera glycines
tcataaaaaacaaaaaaaaacgggttaatgattgtaaatgaatgggttatttgggcggattatttgagatgtttttttttcgcattttccgttttttttaattctatccaaaattcactgacaatggcactttctttgctccacaaaattgttgccggacaattgctctcgctaaaccagcaggtggccatcgatgttgaactccccactgatgcgcatgcaattagtggaaatgactgaaaaatttttgaattggcatatattaattaatgcaaaaaatgttaattcattaatttaatttcattaattttcattttataaaattttttttcaaaaaaaaagaaaattacactgtccaataagctgcaaatcggcggacgtcgtgttgttgttgtcatgcccacaaaactcgacaaggttaacacaaacgttcatgagttcgttcacctgtaaataaccaatgatggagatgatttgttaaatttaaatattaaatattttatgaaataattttcgttaaacaaattattttaaaaaaggggagcagggattttaatgatatttcggagtcaatagccagttctttcgtacaatgaattttcgtacaaaaaaacactcttttttaagagttcaattaaaacattgatttttttttaaaaaatcaaaataaattttgaaattaaaaaaacataaaaatgtttaaaattgaaactaaatttatttgatttttgaaaaaaattctaagttttagttgaaaattcttaaaaaaattgtattaattctatctaacaaactgccaattgtacgaactgacatgaaaccgatttttcgatagttaaattatatgatatcaagaaaaacaatattggatttttgcagtactttttaaatgaattatcggcttaaaacattttggcgaacctt

SEQ ID NO: 40580 - DNA, 914 bp, Heterodera glycines
ttcgaaagtgcaaagctaattagcgattcaggcgcaccttggggcctgaattaagccattttccctttgatcggtacacaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgcaaagctaattagcgattcaggcgcacattggggcctgaattaagccattttccctttgatcggtacaaaattggtcgaaaaagagatagccattttctgaggcccgaaggaaaatttgagagggctaatttatatgtaatatt

SEQ ID NO: 40581 - DNA, 896 bp, Heterodera glycines
atttgggcaaataccgggtcagggtattgcccgttacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtccattttttccaccttttttttgcggtgcgttttttaaaacttcggggacagttggggtcgggcggtgccggtaggcgccgccgaaaaaattttgaaaattgtcttcggatttgttaacagattttattcaaaaaatgatcaaaacttgttttttaaattttttgtttttaagtcgctttttttgtggcgctgtttttccaaaaaaaaattttttggaacattgggtgcggggtccggcggtgccgaatcggcaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttgggtaattgaacccaagagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatctttaggggtgtattttcaactctcgcctctcgtcccaaaaaacgagagacgagaggcgagagtaccaaaaatggcga

SEQ ID NO: 40582 - DNA, 906 bp, Heterodera glycines
  misc_feature (828)..(828): n is a, c, g, or t
  misc_feature (892)..(892): n is a, c, g, or t
aatttctttttagattaattcttcctttatgccattttcagactttttttgaccaaatttgtaaaaattgtgggcagaaaataatatcaaaaaaaatctgattttcatttcaggggcttgagaatttttttaaaagttttaaaaaaaagtcattttatctgttaaaaaaatacaaatacattaaaaaaaagtagaaaaggacagaagaaaaagaggagaagctaaactatttaaaatgaatgactataaaattttaaaaaaagagcagtaattctaggattttttaaaaaaatttttcgttctttttttgtttggtaatgaagtcgttcaacattctgacttcaaagattgtccgttcagcatgaaatcttactaaaaataattaaatttaaaaaactaataaaactatgtaaaatgaaaaattgcataaataaaatcattttcaacttaaaaataaaatataaaattacatctaaatatttcgcagtaaattcattgccttttgtaatatcctctttcctcacaatttcggccgcgtttccgttgaaaatggcactttttaattcaaaatcaatctttaataattttagattaaatttttttatcatttatttaaataaatttgatttagaaaatggcctaccttgatctcattttctgtttcttcttttttgatgtaagaagttttagttaatagtagtttatttggttgctttgatttgtccgtttcattttgtccgtctgttacattttgtccgtattttccattttgtccgtctttttcttcttcatatttgaaattaagacaggaagagcatttaagtttanacagaagattaacacttttgcctggttcaatcatttttttcataaatccaacataaacatttanatcagtccgataat

SEQ ID NO: 40583 - DNA, 1368 bp, Heterodera glycines
aaaaaaaaaaaaaaaaaaaaattatttttttttttttttttttttttttttttttttttttttattatatattattttttttttattccaaacaaaaaaaaaaaaacttttttttttttttttttaaaaaaaaaaaaaaaaaaaaaaaaaaaaattttttttttttttttttttttttttttttttttataaaattatttttttttagagcccccaaaaaaaaaagaattttttgtttttattttttttaaaaaaaaaaaaaaaaaaaaaaaaaaaaatttttggtcaaaaattttttttgtttttttttaaaaataaaaaatttgataggggcagacaagaaaaaaaaaccgttttttccaaattttgtataaaaaaaagaaaaaaaaaaaaaagctatttttggtcaaaaattttttttgtttgcgtttcaaatatcgtaagattttttgataggcccagacaagagaaggcaactgttggtactatgtttgcagtaaaaaaaagacaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctatattttggtcaagaattttttttgtttgcgtttcaaatatcaaaaaattgtttgatagggccagacaagagaaggcaactg

SEQ ID NO: 40584 - DNA, 500 bp, Heterodera glycines
ttcctttcagtattcctgcaaagtttggtgcgcttctgatcagtttctgaaaaaaaagttaaacctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactaaaaaatttttaaaatttaataattttcctgcaccgaaggtactcactcggccgcttcgcggccg

SEQ ID NO: 40585 - DNA, 878 bp, Heterodera glycines
  misc_feature (48)..(48): n is a, c, g, or t
  misc_feature (51)..(51): n is a, c, g, or t
  misc_feature (53)..(53): n is a, c, g, or t
  misc_feature (60)..(61): n is a, c, g, or t
  misc_feature (63)..(63): n is a, c, g, or t
  misc_feature (67)..(67): n is a, c, g, or t
  misc_feature (69)..(69): n is a, c, g, or t
  misc_feature (157)..(157): n is a, c, g, or t
  misc_feature (176)..(176): n is a, c, g, or t
  misc_feature (212)..(212): n is a, c, g, or t
  misc_feature (265)..(265): n is a, c, g, or t
  misc_feature (270)..(270): n is a, c, g, or t
tgtgctcaatggtatgatatttcacaaacacctccttaaggaggagcnccngnaaaggannangggnanaggcccctaatacgaacaccggaatcaggcgaaagcgaggggggagaagaagctgccgcgaagcaaaggccaaccgaccggacgagcncgaaaaaagacacgggcgngcgaaaacccggccccggaacaaaaccaaagggccnaggcccgcaggccggccgaacccagcaaagaagcggcacaaaaaggcagcggngcagnaaaaacgaaacccctcttcccataatcccgttgacggtaaattatagtaatcggcaacaatgtgctgccagcgaccaaatcttttacaatgtgctgccagcgaccaaatcttttaaacactcgcttaacaaaatgcttaacactgggttaggttcaagaagcatttctataatagattaatcggcctacgaatcagaaagttaattattagactgatatttttcaagtaaattatttttctcatttgtaactttcataaattttagaccaacattgggattcaacaatggctcatgtccagcgggcgctcttccataatgtccattttgaccaccggcggatggctgcacgaatcgctgtttctgcggctgaatcccacacatttcggtgccgtcgttagaagaagtgctgctgctgtgcagaagttaatgaattaattagattcaaatcctctcttttattagttctttatgggaagaatcaaccattttttgcttatattgcctgtgctacccactggcggaaatattgaaatgctggtttttatgattttttttcataatcttttaaattttaaatgacaaaataaatatttgggatcgggttct

SEQ ID NO: 40586 - DNA, 902 bp, Heterodera glycines
cgatcagaaagccagtgtatttgagttctggaataagtcgtttagtctgacggagtgtgtctggtcatataaggcacagtgcacgcgtcagtgccagccgaagtttctctgtctccaacgacagtctaaaaaaaataattaaaaatcaatgaattttcaaatgaaaggacacaaaaaaaactgttgttggacctgtcttgggtattgcaaataactctccgcaatgtaagcgaagaattgtttattggtgattgcgtgttggttttggttgttcttaagcgctttatcataattgtccatagtaacatttgcaggcatcggaagcatttcgatgctgacattcaaaggcaaaggcagaatagccaaataatagcaactgaaattgaatgataaatatgaatagaatacaaaaagcaattctcttacacaataggcccattttcttggttcggctcgtgctcaaaacgaagaccaaacgacgaaatgttgggacgagaggcgacgctgggcggttcaatgtgttcaggctccgcataatccataacacattggctaccgatagagacggcaatgctactcccggccttattttcagcccacacagtggccgaatagttccgatttggctaaaaattagattttgtgtgcgttaaatttaattgctttgcacaaaactaaagcaaaatgtacctttaatggcccatatttgcaggaaaacaacatcggtgaagcggcagattcgatgtaatgctgcccaatttgttcggccttcgagcagtcctcactttccggataatggtcctgtggatgcattttgctttcgggcgaaacataacgaattcgaccagaaatttggacctaatccagcgcaaaccttctttttttaatcaaatgaacgtctc

SEQ ID NO: 40587 - DNA, 289 bp, Heterodera glycines
tattttacgatttttcttacatataaatcgcagccctagttatgagcaaaggaactcaaaatagtagatttttagatttttttttgattttttgaaatttggcaggataatagagaacattagggcttccgaataataacaagaaaaagtttaaaagtatattgttgctttttaggaaagttatgtaagcaaaatttttattttggggttttttagtaacatctgaacaccttctactcacctttagccaacgaatttaaagatcagcttagtgttcagcgcttaaaat

SEQ ID NO: 40588 - DNA, 687 bp, Heterodera glycines
  misc_feature (372)..(372): n is a, c, g, or t
  misc_feature (382)..(382): n is a, c, g, or t
  misc_feature (423)..(424): n is a, c, g, or t
  misc_feature (440)..(440): n is a, c, g, or t
  misc_feature (461)..(461): n is a, c, g, or t
  misc_feature (490)..(491): n is a, c, g, or t
  misc_feature (498)..(498): n is a, c, g, or t
  misc_feature (529)..(529): n is a, c, g, or t
  misc_feature (532)..(534): n is a, c, g, or t
  misc_feature (541)..(542): n is a, c, g, or t
  misc_feature (549)..(549): n is a, c, g, or t
  misc_feature (559)..(559): n is a, c, g, or t
  misc_feature (562)..(562): n is a, c, g, or t
  misc_feature (620)..(620): n is a, c, g, or t
  misc_feature (622)..(622): n is a, c, g, or t
  misc_feature (630)..(631): n is a, c, g, or t
  misc_feature (634)..(634): n is a, c, g, or t
  misc_feature (649)..(650): n is a, c, g, or t
  misc_feature (658)..(658): n is a, c, g, or t
  misc_feature (661)..(661): n is a, c, g, or t
aaaaaagacgaaacaaaagaagacccccgggagaagggagggggaaacacgacgccaaaaccggcaaccacggcgaggcgaaacaacgcaaaacgggacagaaagcaagaaaaacaacagacacggggcgaaaaaggggcggagacaagaaaaaaggggaaaaaaagacaaaacaaaacaacaccccagggagaagggagagggaaacaagagcacaaaagggccaaacaagcccagacgaacccacacaaaccggaacagaacacaacaaaaacaacacgcacggagcgaaaaaaggggacagaaaagccgacaaggaaaaaaagacgcgacaaaacaagaccccggggagaagggagcgggaaacaaganaccaaaaggngcaagaaaagagagacaaaacaacacaaaacgggacagaanncaagaaaaaaaacagncacggcgcgaaaaaaggggcnagacaagaaaagaggggaaaaaaagacannacaaaanaaaaccccggggagacgggagagggaaacangannncgaaacnnaaagagnagggaacccnaancgacacaaaccggaccagaaggcaacaaaaaaaaacaacacggagcgaaaaaaggggnangaaaaagnnaanaggggaaaaaacacnnaacaaaanaanacccccgggagaagggagagggaaac

SEQ ID NO: 40589 - DNA, 1025 bp, Heterodera glycines
  misc_feature (891)..(891): n is a, c, g, or t
  misc_feature (976)..(976): n is a, c, g, or t
  misc_feature (990)..(990): n is a, c, g, or t
attatttttttaaataataaaaactattcaattaaaaccacctaattttttcaacggacacataataaaaattttgcattgatatgtaaatgcctttttttaatgtgcatctcaaggacagaaaataaaaaccctgagttgtaactcatatgcaattaataattataaaatcagttcttaataaatcacttgatttttctaaacatcggtaataaaagtgttgcattgaaaattatattattaaattaagattttaataaacaaaaataaaagtcccacaaatgaaactcatgtgcaattaaaatattaaatataataattagtccataaaaacaaccaaatttatttaagcatacataataaaacagttgcgttggtaaatatatttttatatccaaatttcgcgttttttagtccatataatttacaaccctaattatgacaagtcgatactcaatgaaatttagcccggataaagcggtgtacaaaaacagaaaatggccatgctgatgaagcagtttaaaaaaggacaaagtgccaaaaggtaattaacggagccacggaatgccctaataattataattaaaggggggcctattttaaaaaatactttgtcctaattgttacgtaaatgatacaaaaattgaaaatgattccaaatgtggcgatggttgcccataaaagtacacagccaattagagaacagctgggatttatgtctttgaatgtcaaatgaaactaaaaattgctaatttgaaaattgtttattttaattgaaatttttaccgaattgttattaatgccgtccataattttggcaaaattagaaaaaataattttgttaaaaactgaaatatttaaaaaattaatgatactgtaagtggccgctanattttcatgataataaaacaatctaaaagctatcgtatgatacccccagattattttttaggttatgtttaagaaaagatatgancgatttttcacganaattctttaaattaacagttttacgaaacgccaat

SEQ ID NO: 40590 - DNA, 1080 bp, Heterodera glycines
ataatttattgatgattggccaatgtccaccaaaagtgcgtactcggcgccaatagtcgtggggctgatgccaagaggagggataagtgagacgatggctaaagagggagagaaatgacagttccgcccgggggaagggctcgcctggccacgtgacatttgtacggttgggtgcccttgaaaattggcgagaaatagtaaaacttgtcgaaccaatggttgtccatctgcaaatatgtaatcattgcatcctccaatcttggcaccattaccacaaacgatggtcggtacattctgctcgaccacaatgcgctcgagtcattttgggacagacgcgacgaacgcggagaaaagcgatcaaaatcacgggagaaacggttgacatcgatcagagaggagcaacggacgagctaaagagccaaaagaaaagggcactgggattatcagaacgggggggggggcagttaccaacaacggcactcactcaccgacggattcggccttggctcgaatgcgctgagccgagtgaccgactcggcacggcccaacccgaaagacatggcggagaatggcactttagaagggtcggagcaatgtgccacgaaagagagggatgctggagcaaaatgacacttttaagcaaagagagcagcggagagggagaggaaaaagggatggaagagcagagaaagagaaaagcggatcagagacacaaaagtggggaaaagcaaaagcaaaagacaaaaagcatggaaaaagcaaaagcatggagaaagagcagctgtcaaatgggagggggagaagctgatcagactgatcaatcaatcaaaagaaaacaaaaagcatttattaatagtctaatcattttacaatgaatgaatgattcacagaaattcgctttaaatgccttcgatttgctcaagtgtgccatccatctttttccatttcaaatttctttcattaaatttgttcgatttctctccgtttgttcgtcgtccgtttggtacctgcgaattaacggcattttgaccacctcttttctgtaattaccagtaatttttgtatcttgcccagtaaatg

SEQ ID NO: 40591 - DNA, 1191 bp, Heterodera glycines
cctgtttgacattttggagaaattgaagaagaaaaggggcgaagaattcgcgaagaaactgccacaaatgcgaagggactgttccgatatcgcagagttagaggtttggcgcacaaccaaaaacgtgctggggcaaatgcgctgacactgaaatccgtcaatcctgcgatttccgtttcccaaatactcaaaaagtttgcggtttcttattctaaattattaaactctttaaaaatgcaaacttttgcattgtgttgcttttttacagagtccccagccgttcgatgagtcccgtttttgtaagcatatttttaacaatcgcataatcaattaaaaaaattgctcaaaaataaaacttttgagtaaaactaacgaaaatttaaaaaaaatcgtttgtggttaaattcttaatttttgagttccgtgctaccgtcagtcagctgagcgttcgtgtagttgccatcaccacgaattctatcaaagtccagtggtacccgatcaccgcaggccaaattgacaacaagaaaattgtcaaatacaagttgcactacaaatgcacctctccagaccaccaatggagtgagactgatgcttatgaggtaaaatttgaggagagattgtactttgactttgtatgatttctgatattaatttaaagtggagaaactgacaattgatttaaaaatggcaatgttttgaagacaaaatttggttttcccaccaaacaaaaatggtaaaaacttatggtttgttccctccggtgcaggacaagcttgctggatttcggactggaatctcgtaaatcccgcgcgggatcccgggtaatagtctagtttgttccctccccccattttcgaaaaatgtattttttaattttgagaaaaatttgtattaggggttttaagggccagagaacccgaaactggattcgagcaaaaagtcgaaaattcttcaacctatgtcaaactccgaacctggattcgtgcaaaaagtcgaaaattcaaattttcactttttggtcttaatatacatatatgaaacaactaaaagtcagcataatttaaaccattttaagaccaaaaagtgaaattcgacaatttgaattttcgactttttgctcaaatccgggtttggagtttaacataagtcaaaaataatgtcagattcggttatttggcccttaaactccat

SEQ ID NO: 40592 - DNA, 952 bp, Heterodera glycines
ggtctgggcacagcaaaacggccttttttccccgttgcgttgacacgcccttcaattacgtggggtcaaatcgacaaagtacgcttcggtatagtctaaaagcaaaagctcgaatcgtacgagcacaacacggaaatttcgccgccatagaaaacgtttttttcgttcttcataaatatcgcttttaagcattttaatcgaaagaatttctcgggattcttaatcgattccttccattaatttaatgtgcctcatttgcgcttcttacccattccgggcgttaagcgccaatcgtacggagccgcgaagagattgcagcctttggtatagccaaaattgaccaaacatttgttgatcagtggtgcaaaatacgtttcgtcctcggggtcgggagaagacgaactcaacgcacaaccgccggggaaagagtcactaacccaacaggtggaagggcaagtgcttaattaattgccaaaaacgataattattcatttaaaaaacataaatgtaaatatattataaaaagaaattaattaatttaaattgctaattaataaaagaaaattgaattgtaaaatattattacacaataggtgcaataagataagttaaaaatgagagcaaagcgacttaccaaccaaattcttttctcgcgagaaaagtgacgtcaacgcccgtttggtttcggtaagtgtccgttgtttggtcatagctcagtctcaattagtttaattgatcaattagcaattttaccaattttaaatttcttacgacattaaatagaagagacattcctggatgttggtcacattcaaagtgccgacagccaaaagcggatttatccatcctttgatggagtaacggccagcgaagagttgggtgcacagaagcgggaaattggccgggaacgacatattttttccatccaaatacattttattgccgaaaaacc

SEQ ID NO: 40593 - DNA, 1108 bp, Heterodera glycines
cttcttctccttttccgcatttgttccatttcaatttgttctcagtttgttcctcattctttctcagttttgcaaatttgattgtctcttttggcacttcccccccccccctctctctgccgttacccctcatttgagaagacttttcatctattctttcgttgggtgaagaacattacgtggacaaaggaatgaatgtgtatgccaatttcatctttgctcgtccgctataatatgttttgccgcttttcgccccccattcactgcccaagtgcatcatctcccatctctcatctcccgcctcttccccgaagggctttttcgggcgaagacttcgcccggcggaaaggggggggggcgtgaaaacggagggactcataaaaggggctaaggttggatttttcagtaaaaaggaaggtgtcaataaagaggggggcacactcgtaattgaccgcttaaaattagcctgttgccgttggacaaatggcccaattaagtccgttcattttcaatttctctattaattgtaaataacaccttttgtgttggcattcattctctatattttgcctttcacagtcactgaccatgattgaccgaggagaacgcggatgaactctcgactcgcagtgcaacggttacatggccatcccggatagatatctcttctttcccacaggaggtttcggatacgcaggtccatgtccttagctttcgtcagggtttcactccaactaggcccaccaacgattacattgagaaagaggtacctcgctactggggcgatcgtactagcgaaggccgcacgcaactccccgaaggtatgttccgtgcatagcaaggtgcgcattctctcaaacatcttggtacggactcggtcccacgcatcctcgaaaacgataccaaatctctcttcgattccaaggaatttattaagtgtctcggagaccaaggagcgggatatcacttccagtttcctcgttctctcttttcaggggggtgtaccagagcgcatttcctcttattgattttccacccgagggttgaaacggttcgctccaatgttacaaacatccctagtcaaggacgtttcactaagaggaaaccc

SEQ ID NO: 40594 - DNA, 89 bp, Heterodera glycines
ttagtaatcaggtgtaatgaactctcatcttttctttcaaaggactttccttcataacgattagtcgaaccatcaggttgtgaaatata

SEQ ID NO: 40595 - DNA, 617 bp, Heterodera glycines
ttccagctgaaccatttgaattcgttgccctgttgctgtttaattaaattttttttaaaattgctttttattcaataaactttttgctcaaattcactaatgcggctgatcttctcgaagaatgggatgttgtagctggcaaagtaccctttctgcttcagccattgtgtcatgtctttgtacacaattattgtgctgaaagtggcaccaaattgacgaaaatccccagactttcatttcaaaagctcgggttctattacttaattgcccgttttgatgttgcccgccatttgttacttaatgggttgttctttgttcatttgtactgttgcttccttctaagacaaactttttacactaaccatcgcgtgtgtggccgagaggttaaggcgttgcgagctatgtcgcaatggcggggtggagttggcggggtggagttggcggggtggagttggcggggtggagttggcggggtggagttggcggggtggagttggcggggtggagtttgcggggtggagttggcggggtggagttggcggggtggagttggcggggtggagttggcggggtggaaaaggggggtggagttggcggggtggagtggcggggtggag

SEQ ID NO: 40596 - DNA, 1493 bp, Heterodera glycines
  misc_feature (63)..(63): n is a, c, g, or t
  misc_feature (653)..(653): n is a, c, g, or t
  misc_feature (702)..(703): n is a, c, g, or t
  misc_feature (1481)..(1481): n is a, c, g, or t
gtctgtgcgtcgtgagcgggtgtgtggggcaggcacataacacactgactggggatggtggtntcgttcccggtcttacgtgccgtaactagcggtgtgtttgtgcttgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgcttagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcacggcggggacancccgtggaaacttaacatttacataagcggaggaaaagaaactaacgannggatcccgtagtacgggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaanaggcgccaatga

SEQ ID NO: 40597 - DNA, 1157 bp, Heterodera glycines
tatttatttgatctatttatattttcatagggaacatatttcgcgcatttggggcatatccagaaattatcaaaaaatgatgtaccgaaatgcaaaagactgtgctttttacacctgctacaaatctcgtaatgacagggacagtaatgacaacacttaattttatgtgggcagttcatttttcaatttaattttattttgggttgctatttatagaaggggtatataaagggagtgaaaggaccatttgattgataccttgtatcaaaaatgcaaagaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtctggggacgaaaagtctgatagactgtgaaaatgctattaaaaaatttatagaaataattaagtgctcggggtgtccgggggcttcttacaccggacacacgattgaaaatattgtttcgacctttaaattcggacatgaaattgaactgaacgaattcagaaaaaatcgtcgtgccttttatgaaccagaaatattttgcggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaagttagggagacgataaaaaaattttcatttattgggacggtcccccaatttatagttctgttgggtatttattttgttatcgattacttcgcgcggcgccggcatcgcggcgcaccggcggggcggagaggaaatgcatggttttggcaaattttcaaaatgagttttaatttcaggataaaaatcatataaaaaatctcaggatttgagaaaataccccaaaaggtttggaatcaaaaaaggaattaattggcaaaagaatttccttcacctgtcactttggtgacaggtggatgattgatgaccttcccgcggcgctgcgcggcgtgggtgaaaaaaacacccgcacggatt

SEQ ID NO: 40598 - DNA, 860 bp, Heterodera glycines
ttccttgaattttcttaataatttttttcgaatttatctatttttttttgatttaggctaggtaactaaattttaaataatttttttaattaaaacaaaaatttgcggctacgttttgtccccccccccccccccggaccacacctccttgaaactgttgacccaatcagtgttcgcttgtgcgttgtaattatagcaacgcaatcgcttgggttggccatcttttctcggagagtgcaaccatttggacaatgcttggccagcagaaattgttgaatttggcccatcaaaaccatcaccaaacgcagcgggaaacaaatcataggaattgattgaattcaatttgttgagatcggtgagaattgtcggtgaaatttgacgaagcaaattgtccaaatgatcaccatcgttaaagcccaagtggcgaatgttttcagaaaaaattggccaaatttcacgaacaaaaatgtcccaaatcagctgctggccatccgtgttgtgtggtgatgaaagccacaaatataaattggtgcctcttttgtcgaaaatttggtgatttgaacgaagaaaagcgatgacgaagtgatcgatgtaactgtgaaaatggaaggaatgcttttattgccataaagctttgatttttaattactaaatccgaaggtgattaaaacggattttgctggtcaacggataatcgggcaatggaaattccacaattttgtcatccatccacacagatagtttcggttctggtcctttgtccttgcgacgaattgcgattggtctccaaattgtcaattcgcttttgccattgaaatgtttgtccaccaacgcattgaaacgtggcgaaagaagtgcca

SEQ ID NO: 40599 - DNA, 1144 bp, Heterodera glycines
  misc_feature (43)..(43): n is a, c, g, or t
cccccccccccctgcccccgctgcacccccaaaacaaaaaganaattggcgagacggggaagggcgaagagtgagagagagagagagagaggcagtgtggaattatgatcatcattatcataataataataatacttaatatagcgctaatgatgatgatgattatgacggattttgatggattgattggtcggcggcgcccgggggaaaaatattttgggaaggtggtctcgaagaaaaattgttggcgtcgcgcgggcgcgaaaaatgcgtttagcttctctctccctctctgttaatggtgcaaaatttgtgtggtgctttgcgggtaataataacgggagacgggagaccaccacagcgccccgcgcaaaaccatttgatttccctcccactttttgaaagtgtttggcgatctgttgcaaaattcctatctactgatcgcaagtgattggtggggtaaattgttgatcagagaatccctaaaggaatgttgctgatcggaaatgcttagttaataaactttaatttttagatggaaaaattttaattagtttgatcgacttatggggatttaccgggtaacgggaatggaaaaagcgggaattcgcgccttttcccggcttttcacagattgactggaaaatagaaacggaattttccgccggaaatttcccgttcgtttacggtttttcctacaagaagttttactgtaccgatcactaaatttaattatttaataatgaaattgagtgattccgggaatccctaccctgaatttttaagaaaagtctaagccgatgctatcggatttcatccgagactcggaaccattcaaggttttagccaaacaaaaagtttttaaaattcccaatccatattttttaagcattagcagcagatttggatgtgaattaactctttttttttattcgcggaataaataagtcaacattttttaaatatttttcggaaataatatttattaatttccataataatatttgtattgtttttatatttttttatttcttttttatcagaaattttgtatagaattaatttttttttttcttgaaattttaaaattttttattacttattttgttttccaaaacatctttttttcacgtcgctcttttct

SEQ ID NO: 40600 - DNA, 59 bp, Heterodera glycines
ttggttttaaaaattaatgtaggtacctgctggcattactggtcccataaaaaagataa

SEQ ID NO: 40601 - DNA, 1076 bp, Heterodera glycines
  misc_feature (7)..(7): n is a, c, g, or t
ttattantccggtaattaaactattaacttgacataattcaacaaacacgctaatttaacattttaaatggggaaaatttttttaacatttttctcattagatttggagcacaattagtttaaggttttcatcgttaaaaaataaatcaaccaaaatttttaattcgtgcctctattgtttttcagcgggtctgatctgaaggcttgcaatgagaaaatgcacaaaagaatcgctgaaaggataattatgcattaaaatgtgaaacattttctcaattaatatgctggcgcgttttttaaatctgtcatcccccccccctcacaaaatatgtactgatttaactctttgctcttcgtttatcatttatctttatatgattaagaatatttaaagaaactttgtattattatttctctcaaaacttagcacccattttttgataaaatttagcaaatgtttatgtcagaaatcttcagaaatgaaaattttgtttcttttagtgacccaagatttaaaaaaattcaaacttttattattcggttaatttttgtgtgatggtcatttactccgtgatcaagaaaatgtcattctgtttaaaatgtcatgtcgaaaaaaacggcagcaaactttttcccctctctctgacaattttgccaccaaaaaattctcagactcatactcagtattaaaatgcttttttaaaggagtgattctgggcttttcattcataccattttctctttaattttgcttcacctgctggtcaaaacactttgttatgggtgagcttcgatttgggagcaaacaaaattgccccaggcaattaggggaggaatggaactccccatattttcatgcccaacatgaaaatgccgggaaggcccaacatccctcacaaaaatccatatcattataaggtgcaacagcaaaacagaaaccaagtgcagtacaagcaacagaaaacgattgaggaaacaatccaagaacaagagaaaggccgcagcagcgtcctcggtaaaaaacttcgccacggggggaggggaaatccggttcatgctttgaactatggtaagca

SEQ ID NO: 40602 - DNA, 1445 bp, Heterodera glycines
  misc_feature (269)..(269): n is a, c, g, or t
gttcggcaacaatcgggcattagcagcgccatttagaagatcatgttgttgttcatgtggaagtcgttgttcagtacaatagtcagagtccgatcatggtaggcacgccacgcaactagtgcatagaacatgcaaaagcgacgctccgcttctccagttttccggatccggatccgactccgctcgttgtagccccacttctggtatggataaaagcagggtccactaacctacggaggcgccacaaaaggagaccgcccccccccccncccctcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaattgattttttcaagtgtccgtttggggtactcaaacaattatggggagcaaaaatccaacgcagaattaaagtacaggctatagggaa

SEQ ID NO: 40603 - DNA, 1535 bp, Heterodera glycines
  misc_feature (18)..(18): n is a, c, g, or t
  misc_feature (54)..(54): n is a, c, g, or t
  misc_feature (1432)..(1432): n is a, c, g, or t
atcagcgcaattccaagnccaagtgtgaaagccggaagcagatcgaacacacanagccaccagtcggcggagatgaagctgaaaaaaatgaaatttatgtgaaattggcattaattttacattgcttttgccatttcttcctccgccgcttcttttcgattgtctgacattttgttgagaggaaataagagagatttcgacggattaaaagcttgaattgagtcaaaaacgaattgaatgtcatcccatttttggtgccaaaattcatatgcgaatgctttttctcccccgcaagcagtagccattcaaaatttgtttgttgcattcacaaaacaggggatgaggggggatcaccaaacatcaaacaaataatgcgaaactcgaaaaatttgagagtttcgactttttgttcgaagttaggtccgagtttgaaattggtcgaatgaatgcactaatattgggctcggcaaattacgagaaaacataaataatatgtgtgctttaaagagtcattgttatttttccttgtcttttatatgattttttggatgaaaaaacgggcccactaaactgaaaaagtgcacaggcgaaagttgaaattagtataagagtggtgtcatttttcattattatccattcgccaattcttttcgtcgctttcttcgaattttgctacctgacaaatccttcgaaatatccctgaacatttttcgtatttttctcgacattttatgtacccttttccttctcattttttggtctgtaccagggatggaattccgagggccaaaaatttttcgcaccagtcggaattccgaggccccaaaaattttcggaaatcggaattccgagggtcaaaaatttttcggaagtcggaattccgtgccatccctgctgcgcacgtcctccttctgctgttcttcagcttacaattaaccctagcccgtaacgatcataaaagtgatttttttatttctttagaaaaacctgaaattaccaactgccatttgtacaaactgtcactgacccgttaaatagcacccacaaaattgtttgtagatttttatttgaaatgaaaaatttattaataaattcattttaaaggtatattaaaaatatacttttttagtttaaaattgaaacattattaatgattcctaagcataagaatatctttttcacaaatgcctacagctaaaaaacagattttgtggtcagaaaccaaaacagaccgaggaaattattttctgtcaccattattttgacctttgtaatacaatacttaatactacagtactttattttacaaatactgtattaatgacgcattttccgggagccaattacgccactcttttggatttattctcaagaaaaatgaaatatattataaattgaaaataatcctaagtataacctttcgaaattttcnaatctaattataaatcacaaaaattgtggacttggctaaaaaagaataaagtattgaaatggttgcccttgtaaaaattttttctattgttaattttcttaaa

SEQ ID NO: 40604 - DNA, 630 bp, Heterodera glycines
  misc_feature (111)..(111): n is a, c, g, or t
aattttttttttgtaattcattgaaagataaataatgtagtagtagtatatgacgtattaatccgccccaaatcccccccccccacttcctccaaaatccccccccccttncccttaccaaaatccccccccttcccttaccaaaatccagtagtatatagcgtcaaaagcgagcgggttccgagcgggtgtttcccgcacgaacccgtgcctatgggagggggcatccctttgatgttgccgcccgcacaaacccgtgcctatgggaggggtgcagccctttgaagttgccgcccgctcacatcctgagcctatgggatgttctttgaactctgccgcattgcggatttaaaatttccccaaattgttgcgggtgttttttcaccccgcgccgcgcagcgccgcgggaaggtcatcaatcatccacctgtcaccaaagtgacaggtgaaggaaattcaatttaacttttgcaaattttaatcttttgtttcaaaaccttttagcgttttatcttctcaatcctgaaattttttatgatgattttttgaacggtgaaattaaaaattctttttgaaaattagccaaaatcatagggttttttcatttccactcactccctgccgatgcgc

SEQ ID NO: 40605 - DNA, 1019 bp, Heterodera glycines
  misc_feature (962)..(962): n is a, c, g, or t
cgcctcgtgttcctcccgctgtgtctgttgcaggcgccctttatccgacaaattccgtttactccgtcgctttttccgtcgcaaattcacaagcgggcggcagcagggaacgttcgccctacgcggcccaatttgggtaaaaatttcaacaaaagggaaatttttctgaataattgtatttctgtttcgacattggtgaccgagtaattgtcgacgatggaagggcgggaaaaatcaaattcctcaactatgtcgctgaccaaatttttgccggcattgtgttggaccgaccattgggcgactcggacggaaaatttcaggcacaaatggcatattgaggcatttatataaattcagtgctttttaagggcattcagtacttcaaatgctatcccaaatatgcaacctttttacccgctcatctgctcaaaaaagcagcaacaacaatcgcttcaagtgcattgcctccgaggaaaacgccgcgtccaaccaaagcgtcgcaacttcgaacggacaaaggcacccttttgggaggcatggcatttaaaggcagcagaggtgagtggcaccgttaatcaaaaaaatgtttaaattgtgtaaatacagagtctctggacagtttaatgcgctctcctccgcctggtcacatccacgcctcatctgtgagatctttttttaataatttcatttggattagcagttacagtgcgtgaaactgtctccaactggcattaaggacagcgacgttattgtcagtctgaaggtcggagaaatgatttttttaattttcaaatttacagttgatttaaaacttttagaaatgccttcaagagaaggaagcccacttggccaagctttccatcgaattgagcgagcggagtaacgatgccggtgacaaatattcagaatttgctttgttaaaaataattcatatttcagaccgactggcacatgaaaatctngaatttgaagttgaggattagtgaaattggatgccgatctaaatgcaactgagcgac

SEQ ID NO: 40606 - DNA, 1771 bp, Heterodera glycines
  misc_feature (841)..(841): n is a, c, g, or t
  misc_feature (845)..(845): n is a, c, g, or t
tgaatgaattaatgaatgaaagttggtgagatggaattgtggatgtgatggaagtgttataattcagttggaccaatcacattgctaatcattgcttacgtggccattttatgggcggtagacggaaaataaatccggtggaaaattgatgacaaattgtatacaaaaagcagggggaaaagccaccaacagcagagaaagtcaaccaaaaagataatattttatagaagagatatcatcagacactgatttgatagccaacaaatatttgttggcaaatgcatcaaaaattgaaaaaaatagagaaattattgaaaacaatttataaatttaaatatgaatttacaaaaatggcgaaaattgaaaaatatgatagtgaaaacggaattcgaaacccatgcctgcttaaatttcacgaaaaaatgcttattttttatttgaaatgaaattattattattattattattattattagattaaattatttattttatttagtaaaataaaattgctaaaaagcaattagctccaataaatgaaggaaatgaaaattagtcaatataaaatttcaattgatttttttaataaaataagaaattaaacggcaattaggctgcaacaaatgacgcaaatggcattataaattatgtggcattgattttcactgcgcgcttgaaaatattgctcatttaaaaactccccataaatttgcattatatcaaacaaaattttattttttacaaagataattgttaaaacccataatttaagttgtattaatccatagaactatttaacaattctggtcctccttttctgaattgcgccttaatttatganatanattgctggttgagcttgtactacgccaactccattaatgaagtgaagcagtactgcccatcccattgagaaaataactctgaattacaattttgggttgggccagattcaaattcaggcatatttaaattggcattttattcgtgtcactcgggactgaaaatttcacttgacccaaggctcgagactgccaaaaactcaagaccgagacgtttttttaattttttttttactaaatgatttttttagtaataatgattttgtttttgtttacatttttgactcatctttgcttcatcacaattaatgcaaataatgtcaaaataaccaatgttcttggtgacggaaactgtctattccggtaaaattcctttataatgaatgataacactcattgcttcaattttttacaaaaattttttgaaatttttaattataaataactgcataaccgtaggcagggaatgttagggaggggggggggaggaattcctcactcacaaaaaatttaaaaataaattttttggaatttaaactggagggcgaaaaagggtcaggccttcgcattcacctgacgattttttttttaaattttcccgggatcggacatgggcaaaggctttgatcgccaaattttttttaaaatttgtccttggatttcaaaaataacctgccctaatgtctttggaaagtgtgttctgctaacggatgaaaaagggcccccgggggctaatttaaacacccaatttggtcgttttgttagatcatttgccgtctcattgtatggccatgatgacaacaatgcacataaactgttgcgccaagcagcagcccaaacactgatcgaatttgaagataatgaggcatatgatctggaagataagaagctaatgaaagatattatcactgccaatttggcaccgggcc

SEQ ID NO: 40607 - DNA, 1030 bp, Heterodera glycines
  misc_feature (937)..(937): n is a, c, g, or t
  misc_feature (970)..(970): n is a, c, g, or t
  misc_feature (1008)..(1008): n is a, c, g, or t
tgaatttttaaattgcatctgtatcccaaaaaaatggctatctcttttttggataattttctataatacaaatactctcgatcatgagagggaggacggtgcgtaatggcccttttattttttaatgaatttttaaattgcatctgtatcccaaaaaaatggctttctcttttttgggtaattttctataatacaaatactctcgatcatgagagggagggcggtgcgtaatggcccttttattttttaatgaatttttaaattgcatctgtatcccaaaaaaatggctttctcttttttgggtaattttctataatacaaatactctcgatcatgagagggagggcggtgcgtaatggcccttttattttttaatgaatttttaaattgcatctgtatcccaaaaaaatggatttctcttttttgggtaattttctataatacaaataaatactctcgatcatgagagggaagacggtgcgtaatggcccttttattttttaatgaatttttaaattgcatctgtatcccaaaaaaatggctatctcttttttggataattttctataatacaaatactctcgatcatgagagggagggcggtgcgtaatggcccttttattttttaatgaatttttaaattgcatctgtatcccaaaaaaatggatttctcttttttgggtaattttctataatacaaatactctcgatcatgagagggaagacggtgcgtaatggcccttttattttttaatgaatttttaaattgcatctgtatcccaaaaaaatggctatctcttttttggataattttctataatacaaatactctcgatcatgagagggaggacggtgcgtaatggcccttttattttttaatgaatttttaaattgcatctgtatcccaaaaaaatggctttctcttttttgggtattntctataatacaatactctcgatcatgagagggnagggcggtgcgtaatggcccttttattttttaatgaanttttaaattgcatctgtatccc

SEQ ID NO: 40608 - DNA, 1015 bp, Heterodera glycines
  misc_feature (6)..(6): n is a, c, g, or t
  misc_feature (28)..(28): n is a, c, g, or t
tttacnttgagcaaatttatacagatancattttgaggaaaatgagctgaaaatgtgaaaatttcacaaagatggtcgtgaaaataataagtcggagattattggagctatcaactcaatatttccgcaacgctgttagagtttatatttagaagataattagctgaaattttgagaatttcacaaggatggtcgtgaaaataataaatcagagaatattattaacccgatccttctacaatattgctgcagtatttatttagagattaagtagcttaaattgtgagattctctatttacatttcattatcactttgaaattctcaaaatttcagctcattatcatggaaatataaattgtataggcgtcgcagaaggatcgagtcgataagcgccaataattttccatttattattttggtttgtccagcttgtataattcttacaatttcagctcattaccccctcaaaataaactgtataagtgttgcggaagtatggagttgataaacgctaataatttccgatttacaatttacttgagcaaatttatacagataatttggaggaaaatgagctgaaaatgtgaaaatttcacaaagatggtcgtgaaaataataagtcggagattattggcgctatcaactcaatatttccgcaacgcagttagagtttatatttagatgataattagctgaaattttgagaatttcacaaggatggtcgtgaaaataataaatcagagaatattattaacccgatcctagctgaaattgtgagattctctatttacatttcattatcactttaaaattctcaaaatttcagctcattatcatggaaatataaattgtataggcgtcgcagaaggatcgagtcgataagcgccaataattttccatttattatctcagcacgtcgatgcataccaacagatatttgtaacccgtcgtatgctttttcactgatcaaatatgcacaatcgcactgccaatcgtatggagccgctcggtac

SEQ ID NO: 40609 - DNA, 1676 bp, Heterodera glycines
taattaaaactcgttgatttttatttgatgaatgttgttgtttatttttgtttttacttcatcttgaatagttttctagtctctttttgtttattgtcaatttacatatttcaatttgtattgtaattgttgcactataaaagactcacttagcgatggtagatgctcattttgctgggtgtgcacatatcaagtcggagtacgtcgtattacgaagcgaaacgcaacggcaagaaggaggcaacaaaccaccaaatgaatccaatccattggaagggaattcgcacgagggaattctgccaagaaatgtgagggcacgcggaatggaccgccaaagagagcaaaaaatggccaaggcccgagcggaaaaccgtcaaaaaatcgtaagaatttgtccatcggttctttttgagagcgaaggaaggaagtgcaaatatggagagaaatgcgacgcggagcactcgctgacaaaatattgggcgaagaaaccgccggacattggcgagttttggcacccaacgccaaacaccatctttctttggaaggtccgtcctgctttttgttcgaccaaatgggcaagtgctctttctcattgagctgctgtttcgcccgagcccatacgaatgagtcggatttgagccagaagagcaaagcggggcactcggaatggcagtccgttctcaacacgcacactttgcccattcagcaacagctcagaaaacgcacttacgacttttctcggttctcccccttttttccttgtttaatttctctctttttctgtcagttctgaacgtgctctgcatgaatcaccatcgggttgtatggaacgcgaagcaccgaagtgggacatgcgcactctccgcggcaaaaaatacttggcccctctgacgacggtgggcaatttgcccttccgccgtttgtgcgttgaattgggcgcggaagtcacttgtggtgaaatggcaattgccacgcatttgttgcaggtgctttgcccttgggctgtggtcattatttgtcctattccttttacagggtcttccttcagaactttctctgatgaaaagacatccgtcggaaaaaatctttggcgttcaattggcaggtaaaagttagggagagagaaacctttgcaatatattttaaggaggctaccccgattcacttggtaaagcagtccaactgatcaccgacaatttcaatgttgatttcatcgatttaaatttggtcggtcattattcgttttgtcaattttccttattttttagggttgtccgctggacagtgtcaatgaaaagggtgcaggctgttcgttggcgaataaatccaacaaattggtttccgttttgcagtgcatgcaaaagagtgccacgggagtgcctgtgtccgtcaaaatgcgttacggagtgaaggaaggagaacggactgcgcattacaccatggggacaattgccgaacggagtccccctcagctgctgaccctccaccctcggtcacggtcagccgaaccttcaaacggacgaattgatgccgtcactatcacagggaacagcgctacacaaaggcggccgagtgggattacgtcttggagtgtgagcagcgaatcaacggacgcttcccattttttgtgtgtggagatgtaatggattacgaagagtattatcaggtgacacact

SEQ ID NO: 40610 - DNA, 1238 bp, Heterodera glycines
  misc_feature (12)..(13): n is a, c, g, or t
  misc_feature (51)..(51): n is a, c, g, or t
  misc_feature (1123)..(1123): n is a, c, g, or t
  misc_feature (1136)..(1137): n is a, c, g, or t
  misc_feature (1145)..(1145): n is a, c, g, or t
  misc_feature (1173)..(1173): n is a, c, g, or t
  misc_feature (1189)..(1189): n is a, c, g, or t
gtgccattgaanntggtgacgaaatggacaaaggaaaagctggcatggccnaaagcaaagaaaacggacaattggataatgaaacgatgcaaaattggggagaccgcggcgattcagcagcaaaagaaagatgaaaattggaacactgtgttattttggcttgttgatggcactaattgcattgggtgagcaataaaaacaatttatttttttaaaaaatcaaaattgcggttaattaaggccattgtctccgccatcagcagcaaaagaaggcaaagcgggaaaaagcatcacaaaagagcgcggtcttctgacaatgagtgacggacaaaacaacaaaaacagtgatcagcagaagaagaagaaatgaattacctaattaggaatgaccaatcaatcataatttatcagtagggtgaggatttttagttttttaactattttttctgcggctttatttcgacgagaaatgcacgaaaaacacatttttagctcggaaattcttagttttaacgccactattcatcactaggaatcactattttggagcgttgccactaaaaaaaattatttttgaagttggccactaaaataattttttgccactattttggcattttttggaaaatttcccaaaaaatgcaataaaaatgaaaaatataccccaaaaatcgacctaagaaattcaaaaattacacccctaagaatcgaactaaaaattttcaaaattacacccctaagaatcgaactaaaaattttcaaaattacacccctaagaattggaaaattttctcaaaaattcttcccccaaatttttttttcatgctcaatatttgctaagaaaatgttttgtaactgcaatcagtgaataaaattgtttgtcttaattttaaattattttcaaattaaaaaacagctatttaaaaaattacacccctaaatttggaactttttcgccactatttttgtcactatttaggcattttttctccaattttcacattctccaaaaatgacaaaaaaacgacggcaaaattctccaaaccaaaatgatgaagacgatgtcatcgctcgtctcgaacgactcgaaaaatgcttgaggggtcagggaatcctgcgcttnaactcattatccnnacgctcgnaaaagtggaaattttgtgcagcaacttngtgagggcgagaatcngtgtggaaatcgatttgctgacccccagcacgcctcccactcttcgtcc

SEQ ID NO: 40611 - DNA, 1300 bp, Heterodera glycines
tcctcttttcccctttgctagcctcccccccccctatatgtatgttaataatactacaaattaccaagaataagtcagattaaatcgaaatatgggtagccttttaattagagtagagcgggaccgggaattttgggcaaaaccgggacttgccgggacctgagaagccgggaccgggaccgggacctcgatttttcttcgggaccgggaccgggaaccgggaccaaccgggaatttttaaaaattcaaaaaaattcaaaaaatttaaaaaatttaaaaaaaaaatcaaattttaatttatttcaagtgaaaatattaaataattaaatttttatttagttttttatttaataaaacccaaaagttaaagctaataaattaatgaaaattttcaaatcaaattttcttcattactttcaaacaattaatcatttttggactaagtgatcgaatattattagaaattcagatttacgtttcacataaattttttcggcgcgctttttccaaaaacttagcggaagaaagggggaccggcggtgccgataggcgccgccgggggaaattttaaaaatttgggtgcaatttgttaacagattttcaacaaaaaaggctggttttgggattactaggctcaatttgtacggattttctttaaaaatgataaaatacaattaaaaaaaaattaagaatcatattttgtcgataggaaagccatgagtatatataaaaagaaatttcaaaatattttcatttctgtagagggatcgaaccaggggaaagaagaagggaaagtgaagagactagccactaggccatttgcacagttggtcttgctactttatgaatatatttaattattatttctaaattttctgcaaatgccataattttttggaaaatttccgaatttttacaatcaccgtttgcattgttggcacggacaacattcattttggtaaggagaaactgtgccaaatcgctgggccacagcatttggcccttttttctttgcaggaattcgattacggcatttttgaaatggcctcctggcaatgtttttgaacatagttttgttgccaaatcggcaaaattatgtcgaaattgttcgttctcattttgttctttcgacttttgaagttccttctctgctgccttcatatcggaaagaattagtgggccgttcgttgtcaacttttgaatttggcgcttcatttcatcactgttcatggcattccgttcactttggcacatttcgccaatgcttttctcaatttctgcaatttccttttgtccttct

SEQ ID NO: 40612 - DNA, 907 bp, Heterodera glycines
agacggaacaagtacacgcgtgatgattgagcactatgataaatacaatgggttatgtggatttgaatcgtttttggcgtcatgtgcttttaccttttttggattttttgttcccgtttcctatgaagatgatgatgatttaattttaaaataattttaattcatatattgtgtttcacaaattcataaacaaattcatccgaattacttggccttttcaaaaattgcataataaactcaaaatcaaatcctaaggacataaaataaataaaaactaaaacataatgaccacaaacattagagaaaatcgattgaaattttcttcaattaaaataaattttccgaaaattatttgccaaatattttttgatcagatcgtttggcatctcgccataggagtcaaaaaagtaggccacccccggcgaacgcgcccatattgcgcaccaatgggttcccggcattcccgacgggtcctgaagtggcaaaatttatttaatgtattttttgacactcaccaaattgacaattagactgcagggaaatttcgtgcactttggcaatcggtcggccggaaaagtgccaacaaattattttctcgtcgcccggttctcaaagagagctctgtcaatgaaccgattgtccattcctgcgacgaatccgcctctcgctcaaaaacaggtaaaatcccgcagccgcagtacctgctgcaccaaacaggtagatgaggcagagaaaaaagttgattggcgacttctcgatcacatccggaaaacacagtacaatcccttcgtgtgcagcattggaggagggcatttgaacaaaatcggaggaataattctcaccattcatactgtaaggtcactagtgattgatctgttccggtcaatcagaatgagcccgtcagcct

SEQ ID NO: 40613 - DNA, 1521 bp, Heterodera glycines
  misc_feature (265)..(266): n is a, c, g, or t
  misc_feature (810)..(810): n is a, c, g, or t
taataccaataatgtgtaattttgatgcttgtacaatgcattaaaattgtcaaatattttatggtcgtgttgttcatatggggcaccacttgcacatgtattggtacttgtgcagtttacggggcagatgaacggtagcgctggtctgagcccggtttcgtgatcagcgacctcgaaaaccccataaaacattttctttgatttctaaaattcagttttttttgaaaatgtatgtgaaattgccccgtaaactgcacaagtaccnnccatgtatttaatgattttttagtaaatgtaaccaaccgatccggatttgaagaatctctgcggttgttgggtggcgcggtgttggcgctgggagtcggcagcggagggtacggaggtcggcaattcgagctgatcctccgtttgttgctgctgatagggagttggtgcagaagcttccgtggcatgcggaagcaaaacagctaaaattggataaagaaacactaataaagccaattttaaagggttttcaaaagggaccatcggcggaagaagcggaagtggaagggcgttgttgttggaacacttgctgctgttgctgttgttggatgagaggcgcactaaccagcattggtgacagaaaacaactgacttagtaggtattattactgctggtagcttaaccgtttctttgtttaaatataacttctaaaaagaataattaaacaaagcaaagactctctgagtttgttagtttaataattagtaaaaacaatcctaattggggctttctcatccattcttcagtgatttaccattgtggtntagcccaaataattcggataaatttagtcacatgaactgaactaacggaactcacaaaacattcatttcatgcagcaaaagtaatcgattaaatgttccttccactctctctttctctcctcctcttcccgtctctcttcaaattttccttttttcttttctctgtccctctacactctctctctttttctctttttcctctttctctcgctttttcctctctctctctctctctctcgctctttcaaagttaaaatcgaaattacagattaaacatttgtgaattttgccctaaagcgaaaaataaaaaaacttatgggggcctgaggtcccattcccagctgtatttataaaaaaatcaaaaacctaactaggacaggaattacatttataaaaatcccgataaatttacgaaaaacgcagaatttttcaaatataattttccacattaagttttggcgttatatatttacatatttgaaaatactgcggaatttttcaaaactctgatctagagctcggtatattttgaaaaaagcctacatgtacctgtacctgtatttcccaattggcctgtacctgtattttctggacaaaagtacaggaaaatacaggtacaggaaaaatacatgttgccgaaaatttgcctgtacctgtacctggatccaggaaaaatacaggcctggatccaagtacaggccgagctctact

SEQ ID NO: 40614 - DNA, 536 bp, Heterodera glycines
aattcattactcaaaagtaaaacatttttaaatgcaatttattttgtcatttaatatttcaataaaatataaattttttattttaattaaataataatgcatttttattaaaatttatatgaaaaaatgaataaaaaaaacaccgcggtggccaatacgcactcggccagctcgagaattttgagcgggtcggaatgcggcaaatagcacgggtgaactatagtgaacgccccgtgaaaaaatgggtcaaatgatataccaatcgattcctctcgacgagataagcaaggaaaaatatgactcgaggcggcggctttttaacgcaataaccaaaatgacctatttgcaccagtttcactgcgcaataattttaaattaccgtatttgctctaattatcccccatggtggattatttttcaacctcctcgtggactgggggataactggagattgggggattatgatagagtgattatttttcaaacatctcatagactgggggataattggagatggattaatagagattggggga

SEQ ID NO: 40615 - DNA, 1715 bp, Heterodera glycines
  misc_feature (27)..(27): n is a, c, g, or t
  misc_feature (84)..(84): n is a, c, g, or t
atcggtaatgaatgaaaagttaatttngttctgaattgtatttgacgataaacaaatgtcctccttaaaaataggtaattgaanaggaatatataacgaatgcttacatcatttgcaatggacgcagttgacatgtaaactttgagtaaatgcgaaatgaatgaaactgtacaagaaaacgcatggagaaatggagacgattctaacagtttcggttggacgagaaagcataaattggtgttaagctaaataaaagaaattatattatgcgttgtcacccgataacgagtggtaccgtctgatcaggcgattgtccagttaaccatgacgccaacaaagaatatgaggcatcaaaaatcccgataatatcagcaaactttaatttgttgagtatgtcctacaaaataattttttcaattaatgtttgtattttaatttggtataaccattgtattactggtgaaaaaatcaagtttccgctcaacatatttcatacccgaatccattttttcattcatcaattcttaattcaaaattgattcaacgaaaattaagaaaaaataccaatcgcactcatagcatccgaaagtttgaaggacgcatccattgaaaactgttgactcttgagaactgcagaagaattatttaattataccggtaatcaacttctcacgtttacagtcgtcaaaaaattgacaagtaatttcaatagccgaggcattagatgaagtgacaaacaaatccatttcaaaagtaatatgtagggttgtaaattatatggattaacatattttttctgcgcatatgctatgaagaaaggggcttaaaaatagcatttctgcgttaaaattttttgatttggtgaaggtttttagttgcatatacacccagattttgggggttttcgggaatagatccatatttcaccatttttggagcatatttcggcattttttctgttttttcatacgaaaagtgcaaaaaaaacgaaaatatacccctaagaatcgactttttgggaataaaaaaacacacccttaaaaaattatgaacttttgtgagaacttttgaataaaatttatttaattttgttttagcatataataaaaatttaaaaattcgaaattgcataaaaattttaaaatcacgtttttttgcaatagtccaaaagagtttaaaaattcgaaattgcataaaaattttaaaatcacgttttttttgtaatagtctaaaagttattgttttggtgtttttaaagtaaattctgaatttttacaccatttttggcatatttttttgtggattcaaagtcgttttggcagtttttaaggcatattttagtgcattttggtcatttttcggggttttagggcatattttaggcatttttggtgcatattttatgtgcataattggcatttttttagtgcataaacttataagcttagacataacattaaattttttgtcattttatttcatttttatatttgtttattttctttttaaatggtaaattttaaaattttatttaaagatcgatcaaacaaattattattttttctagcgctttgagaaaaaatattttagcaaaatgaaaatgatttttaatccaaatttagcttattaaaaaaattaaagataaattaaaaaatcaaatataggaaaatattggtgttaaagtacttaaaacatttaatctaataattatcaga

SEQ ID NO: 40616 - DNA, 1085 bp, Heterodera glycines
atgatctcagcaaagtgatttttcagagccaagacccatgcatcatacaattcgaaatgctttttcggcgctattggagcaaaaaaattagagtgcaataaaaaaaattctgggagtgggattaccgtctgtttcccgttcccgtaaaaatcccgggcaatagttacgatggtttccccttttttgaaaaaaattttttgtcctgactaaactgtgccggtccataatttttataataagaaaatttaaaatattgatgttttaaagttagaaaattttgagattttaaatgcaatatttaagtgtctgagataaagaagaagaagcatccccgagaggaagattaatggatcactggagagggcagggttgtctggtttttgcttattaaattcaatttttgaaggtcaagaacaaaataaaattttgaaacttatacctaaagctataaaaggtgaatatttggaatacacttcagggttttcgcgggttaagaaaaatgtcgggtttcgggattttgttttcatgttggatctttttacgaaaacattttaatatttcattaattaaattattctaaatatttaaatcaatatgtaaatcaaaataaaatttttgctcgattataaacctatattttggcaagtcacttaaatatcgttaaaataatttctatttgtgccccgtctttgctacttttattttggttatttttcggctttttaaggcatatttcagtgctgttagtgcatattttcgtgaccggaaaatcggtcagtggaaaatgcgtcagtggaaaatgcgtcagtagaaaacatcgttctgcattcggaacgccggacccgaactcgaacaaaaaatcgaaaagtcaaaatttcgaaattacagtttttcttcaaaattggtttaaatacacggaaacaaactaaaagccatcaaccagtctttcaataatagatcatgtatgccgttttgaaccaaaattgctaaattcgaaaattaggactttcgagtttttgctcgaactcgggtcaggggtaccgattagccctaaatggatcccggactcatggcatgtgcccccg

SEQ ID NO: 40617 - DNA, 1454 bp, Heterodera glycines
aaaaggacataatcaaacacataatgtacagtcctagcctgcatgcgggtgtggttgaacgggcgaatcgaacactcaaggagcgcttatacaaatattttagtgaaaataacactctaaggtggttaggggtgatagataaaatcgcaaataatgtgaacagtactacaaatcgtaccattggtacaaatccagcttctgtaacctttaagaatgctccgcgttaagaaaacgtctatataaagaacacactgatgacaaggaaatcaaaataaacacaaaattcaaatttggtgatattgtaagaattagcaaagagaaaggccaattttcaaaaggttactatcccaattttacagacgaactttttagggtccaacgtgtaaacaacacagacccgcactcgtacagaatacgtgatttgaacggagaagacataaagggaattttctacgatcaagaacttgtaaagacaacggaaaacggtacccatcgcgcagaagtgctaaaatcgcgtacacgaaacggagtcaaagaacatttcgtccgttgggttggcttgtctgacaaatacaacagctgggtctgtgactcagacctagtgaaacgtcgagcatttgaataaagttaaataatggaagatttttacattgtacttccctcaaacacacctggtccaggaaatactgcctcaaattttacggttagacttccacacaccttagagcttgactccaaatggtccgtcgcattatcagcaataatctatccatattcattcccgtcgatcagtgtggacgaggatgactctatctctgtcaaactggttaatcctaactatagagaagatgccggaaattctgacgaggaatcgcaaaagtttatcaatttgtcagtgaagattccaaatgtacaattccaaagtgtgcaaagtttacaaaaaacactgaatcaaataatccagaatgcttacgatacaaaattggcggctcatcattaaatgatggtacacccaacaaaagagccaaacgacaaaccgaattgtcagaatcaggcgctggagtaatcgaagtagagaatttcttcactcgaaatccttttgattactggcaacagattggagaactgagaaaaaagcactatcagctcagagaaagggttgaaaaaatgacaaaggagtacaattcaacagcggatggcgaacgaaaaacatttctctcaacggaacttggggtttttcaagggcgagaaacttttctgaaaaaacatttgcatttgattgaagaagaggcgaagagaagggacggtgagcagcaagaatccaatgaacaaagactcattgaccgtttctttgcccgataccctgccaattatagagagcagctggacgagtggaggtcaagttacctccgagatgtgctagatctacagacaaagatgggagagtatgaagg

SEQ ID NO: 40618 - DNA, 988 bp, Heterodera glycines
aacgggttgacgagacgccaaaaatgatgttcgtccgcacaaattggccacatataataagagcaataacaataacaataagaaatgaatgactttcctttttatgttctttgtctgtgtgtttgtccataggtaataaatcgggtcaaaacgggcggtggatggatgatcagacgatcaaagtgtatcaattaattagctaatgagcttaatgacatgcgtaaccgttcaatgtttttgcttaatcctcacggatttgtgagaggcgacgactgcaaatggcaaaaacggctgctgctgatgtgcgaggtgcgtttattgtcgcgtttcacatttttgatcaaatgacgggcaaagcgataaagcatgatttattagcattaaaaagtaacaaaaaagaagccatcttcgctacctaagctcaaatatatttaatagaaataatacaaacataaaaaaggaataaaaaaagaaaataattaattttcaaaaaaataatgaattttaaaaatctatgctgttcaaaagtttgtgttaaaagattcatcggtcaaatcatcattaggatcattttcaagatgttctctcaaaggaaatatttgattaatttccccaaaatttttttattatttttcactatttaaatcaaaaaaaaagaaattttgtcaaagttacattgggtggaaggaatggaaattattctcctaattaattaaaaaactcaatttctatcgtttatttgacaataaatgttttcacaaatctctttgttcttattcttatgtttagtaatcagaaaaaaaattgtttgacaaatctattgaaattcaaaagataattgctttacatattatgtaaatttataaattttattgattaaaatatccagtaatgattatgtaaattcttaggttttactgaacattatttgtatttatgttacacagcgactgacgaattaacattgccgtcgtgactaggaaaaaat

SEQ ID NO: 40619 - DNA, 971 bp, Heterodera glycines
catacaaaaaagtagagtgccacgggaccgggaatttttgccaaaaccgggaccgggacttgccgggacctgagaagccgggaccgggacctcgattttttttcgggaccggcaccgggaccgcaagaaaaaccgggaaccgggaccaacggggaaattttaaaaattcaaaaaaattttaaaaatttaaaaaaaattcaaattttaatttatatcaagtgaaaataatacaaaattatttggttttttatttaataaattaaattaatgaaaattttcaaacaaattttcttcaattatttcgaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaaaaccaaatagagtctttttcgttggtcatttggtctaaattacaaagaggaaaattgtctataaaatgaacgatgaatgtataaatattttctgattgcatattccatttaaatgcgcgagaaaattggaattttggtcgttttcaaaattttataccttcaaatctaaatattcaaaaagaaaatcgcttcaataaattttctttataaaaattttgccctaaaaaatgcgcggcgcgccgcgcacagaaaaatcccgcggtcgcggatcgcgcatcgcggattcaaattgccgcggtcgcggatcgcggatcgcgcaaaaaaaacgccgcgaatcgcggatcgcgcatcgcggatcgcggtcgcgtcccagccctggtccgttgtgcaacatgaatattttttattttttgtccaaaaataaaaaactacaattttcagaaaattatttt

SEQ ID NO: 40620 - DNA, 840 bp, Heterodera glycines
tttgttgtcacgaaattattttattattgagatgatgatttgctgatttttgagaaatttgatgattttttggaaaaaatccttaaaaatggccatttttagcctatcgacatcccccgcaaattcctctaaaattttggcaaaattgccaattttcgatgaaaatctgattaaaaaatggtcaaaattttctatttttaccccggcggcgcctaactgcaccgctggaccccaaaaacttttttcttaaaaaattgactcaaaatcgcaaaaatttgtcattttttgtgaaaatctgttaacaaatcgcactcaaattttcaaaacttttactggcggcgcctactggaaccactgaacccttgtttccaaatagtttttggaaaaacgcgccgtaaaaacatttttattgatttttattcgaaaaaattttccaaaatgctgatttttggccccaaatggtgatttgttgtttgaaaaacgaagattttgaaaattttcatttggcaacactgcctataaatgattgaaaagaaaaagagaaaataagttacatggattatattttgaattctaattaatttttgattatggcattgtggcctacttgtttggacttcatttccattgtccaactgaacagagacgaactccttcatcagctggagaaagcgcttcttatatttattttcagtgagttcattggagacttaaatttataaatgtaattaaaattttttaaattcatattttatttattaatgtattattcgacattgattttatttttcttaatttttgcctttgaacttttgccaaaatttggctaactctgctacc

SEQ ID NO: 40621 - DNA, 1309 bp, Heterodera glycines
ctatgatgctttttctatcaaaaagggagatgaatacacttattaaaaatttgtaattcctttttaaacaggccaacaagtttaggcttaacttttttttcagaaactgatcagaagcgcaccaacttctgcagggatactgaaaggaagagaaataacctattttaaatattatatagtcagttcatctaaataattgttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacactggaaaaaatcgatctattcttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaaatttttgttgaaatatttgtcgtgctctgaagggcgg

SEQ ID NO: 40622 - DNA, 1005 bp, Heterodera glycines
  misc_feature (900)..(900): n is a, c, g, or t
tcatttatctcattatttacttctttttcccaactttgtctctttttctgtcatttgtcgtcgtccactgattttgttgccagtaatttcattcattaattcatttttattgtttattttttcagtgttatttaatatattttgaaaatgaaaaaaatcttaattttagtggctttttcttataaaaaaaatgctcattgtttctttattttttgttttctgtcaaattttgctgctgttgacagtaaaaggcgatggaaattacagtcgacaaagcgattacggtagtgccggtgtttccgacggttctccgccgcccatttcttcgggtacaaatctgtacaataagcaaaaactgatccaaaataattgaattgtattaaataatctcgttacattaaaacttacaaaaaaataaaaataaaaattttatttaggggctgaaaaaacggtagacgaatttctgtccaaattcgaagcgttgtccgcccgaactgattccgatgatgtcggcgttctcatggcacaactttcccaaaatatttcctccttttttgaattggctctccccgtcggttcactcatcgcgggggcccttcaaattagcgacaaagtaattcataattatcattcaacggaatatacggtagttcggcgtaatgcatactgtaattgattagaaaagcaattaattaataattgtgccaaaaatattttgctttgttagcccgaatctgaacaatacaaagcgatggagaaactgcacgataaatttgatgcaaaacttaaagaattggacacgaaaattgtgagatcttggcaaaagattgacgtgagcacgcgaatattcaacagttacgaagatgtaattagctaattatagtaattaaaggcaattanacactcatcaaaaggctaaacacccaaattaattattattttattttttatgaaattattattaatttgttcaacttttctttttttgcttttattattttgctt

SEQ ID NO: 40623 - DNA, 952 bp, Heterodera glycines
  misc_feature (935)..(935): n is a, c, g, or t
ttcattacttttgcggtgagtgagtaatccattgaatagtctaattatgggtaattaaggaattgatggacccgagcaaaggattttacaacaaagaagaggacaaagtcatgttagccattgatgtcactgtacaataaacaaaacgggggccaaatatatattgatctgctgggaagatcttgtcattgaattatcattatatggacctgtttttttaatcaaatttattatgtttatatttattgattttgcaaaattgatttattaattaaatactggagctgtttagagaaatctctttctttggtgtagggtttcaagaaaaatcgcgaaatatggacataagatggcaaaaatatggacataaattttaactttttcaaaatttcttcaaattcgcttaattaaatgtaaaacgctaaaaaatggctaaatacgtttttaaaaatcattttcgaatgttaaacctaaaatttactaatttttagcgaaacatcaacccgaaaagtgaaattttcgattttttgcttatttttaacacaaatttatcaatttttaagaaattgaaatgttttcaatattctcgatacaattttgctaaaaaatgattttttttttttggaaaatttttccggtccttggggtaaaaaaggctaatttagctgctgggggccgttttaatagaggttttttggaaaaatgccaaaatctcgacataaaatatggataaaaatgccaaaatatggacaaattatggatttccatataattctattccctagtgattagggtcaatgaatgtttgtcattttatggactggcaatttaaattttgcccaatttgattttatcaaacttacaacggtgaaataaattaaataacaacaaaaacaaatattttttacacaagtgttcattttaattacagaaantaaatcttattgacaga

SEQ ID NO: 40624 - DNA, 1038 bp, Heterodera glycines
  misc_feature (882)..(882): n is a, c, g, or t
  misc_feature (921)..(922): n is a, c, g, or t
  misc_feature (1002)..(1002): n is a, c, g, or t
ttgagtttatgggccgtaagaagcgagagaatgccgacgatgccatccgttaaaaacatcacactgatgaaccaagaaattttgaaggcgatgatgaaaatctaccaagaaattattgggaaggtctgagatagacgagaattttgcaatttgctgattgggatttggagagatgaattaatgtgggtttccgaaattttaaatgataatttaaatatttatgtaaaactgtttcaaacaagaaaaaataaatttatacaaattgcattccattaaattcacaaattatttaatgaataattaataaaaattgattaaaatgtgaaattgttttaaatgtgttgcttaaaagatagtgggtataaagcaataaaaaaagcatagaacaaatatttgggcaatgaactcaaaaaatatgaggcgataagaaaaaaaaaagttgccaaaaaatgtccaccgattttgatcaattgggataattgtcaacaatgatgaaaaaattgtaaatacaattgatcagactttgccagtgaaaataaaccatggaaaaagctttaaagaaatattttgaaaaggatgggacgagggagcagaagaaaatatatacccaagtatttaaatgattttgaaaaagtgctgatcagaaaatcaaattgaacaaaatgatcgacaaattcaagtaataaattttcaacatccatgctcttaaaattcatattttttaacaacctaatttctttaaaaaaatatgttttccacatttttaataaattttatttaaatatggaatttgaaaggcacataaaaattttaggaattaaaataattcgattatgtaaaaataatttctagcttgttgtaagagttttttaaaagcattanatgaataatttcaaatatattatgaaaatgtgattttannattgactttaatatgtttcccaggtagtatagtggttagtatccgcgcctgtcgcgtgcgagacccgtgttcgattcccngcctgtgagttaatttttaatttttttatgcgtttt

SEQ ID NO: 40625 - DNA, 853 bp, Heterodera glycines
tgaaatgatttccaaatgcaacggagtttgtcggctttctattgggtgagtgcagtaaattcacagacacacattccatttaattgcaaattcatttaaattttccagttttcgatcgctaacgagcgctcagcgcgagaaacacactttgccggaccttccgtaaactcccaaactttcagttgtttattttacacttccaatttcatttagctacgattacaatgcacttgaacctgcaatttctgctcagattatgcaacttcaccaccagaaacaccatgccacttatgtgaacgttttgaatactgccgaggaaaagactcaggaagctctttcaaagggtaacacttagtaaattggaagcaaaccaagaaacagctgtataaatttgtctctgtttttaagcatagttccatcgtttcgttagcgctttatatttccctcccgacttcatttgtcttcccatttctaggtgactttcgcaccgcaattcaactgcagccaatgctcaaattcaacgggggcggccacatcaatcacagcatcttttggacagtgttggcaaaagatggcggcgagcccagcggcgatcttttgaagaccattgaacgcgacttcggttcggtgcagaaaatgcaggagaaagttagcacgaaagctgtcggagtgcaaggctccggttggagttggcttggctacaacaaagagctgaagcgattgcaggtggccgcctgcatgagccaagatccgctggaggagaccactggtgagcattcacatacgaacattttaggttaattatatttaaacctggtaaggctatacttattcttccggtccattaaatcca

SEQ ID NO: 40626 - DNA, 1367 bp, Heterodera glycines
tttgggcaaaacgtgggccttcggaggaccgggaaatttgggaaaaaaccggggacttcggagggccggggaattgggaaaaaaccggggacctcggaggcccgggaatttgggaaaaacccgggacctcggaggaccggtaatttgggcaaaacccaggacctcggaaggacccgggaattttccgtcccgggtcccgcccaacatccttttttttttttggataaaaactgtttataaaaatacaataataataattttgtaaaatataatgatttttatttttttaattaaaatgtctaattccttgcaattcaaattcataaacttaatgaaaataaagcgaaaaatgtaaaaaagtaagcaatttttgtaaaatttatgctgtagatttgtcaatatgacatagatgctgaaagttgtaataaatttaaaattccaattaaaattaaaagctcaaaaatttttaattttaatttttaggaattctaaatttagttatccccgtaaaatatacaaaaaagagaatgattttgtattaagggttggttggcatgttaacaaacaaaaccgcaatcaaatgtccttaaaaataaggacaaaaactaactttcacccgccaaatcaaacaatattggtatcactttggtagccctaagtgggggcaccccaaaacgtcgccggtcgaaacgtcgccggaagactttttggaccataactttgttcattgtaaatcaaattaagcattcttggtgttgttcgatagctttatgtgtttactattaaaaggttaaatttaaaaaattttcgttaagtttcaaaaaagttatggccagaaaggaattcaaaaacctagtatttcgaactttttttgctctgattttttttgtacattaataaaaaaattttgaaaaatttgtagataaaaaataaattagaaaaaaaaatttaaaaaaaggacttttttttgttctttaatttaatagagtttttcataagctttggaacaataccaagaatgtttaatatggttgagtaggaaaaaagttatggtccaaaaattcgcccggcgacgtttcggctggcgacgttttttcctggtccgggccaattataatccatttttttgtgtcaaaaatttcaattttgctaattaaaatgcgtaattttttttgtcggttcctaaatattcggaaacttggaccaaagtgtaaaacacaaaagatttatttcaacattcattcacaggttccgttgcaattttttcctcctcccaaacattccgatgaatttccactcaaactttggcaaatgcattgtggccaaatgtgagcaacattcgccctccggccgactggaacaatttt

SEQ ID NO: 40627 - DNA, 692 bp, Heterodera glycines
tccataaaccatggtaaaatttgatttaatccattttactttcaaaattaatttatttatacgaatgttttgccattgaccccaaaaatgccgaatttgagcggaacattccccccaaataattaatcattttttgttgttttcagtgaccatttgctgtccaaacatctccaatccgatgtcccaatggtcactcaatttttgcgtaccatcccacaatttccgcctgcattggacaaaaatggcactgttttgcttggcactgttggcattgatcggatgccgtcaccgtccccacatgcggcaaatgcaccggcaacaaatccgctcaaatgggtgccggccgccgaacgggcggcgcgcgaaggcgaacttcgccgaagcaaacgaaaagtgagtgaatttggggaggaatcgtccgtttgagtcccagcggagcagtacaaagccgcaaaaaaaatcttttttgtggcgaccttatgtcccggcgacattttgtatgtacccgagttccagacaaatgcgtccattcgtagcttaatgaactaacttttgacaaactgttatataattaaaaagggttggtccaacactcgccaaaaagaattgtgttacatttggagcattatataaacactaaaaatgtgaatggaaaatttcaattttagctgccatttgatttttacctctca

SEQ ID NO: 40628 - DNA, 628 bp, Heterodera glycines
  misc_feature (38)..(38): n is a, c, g, or t
ttaaagctggcctgaattttagaatcattaaatttttntggaatcaaaagagtccctctccacccctttgattttcatcgtcccgcctaaagtaaagtgccatttttttaccgattttatcttctcacacagcattatgcataatacccccccccccccccccctcattacataatcatcatcatcatcacatttaaacacccttcttctgctgctgctgtcccagcgtcaaatcatttccatttttctgtttgctccccctcccccccccccggcccgtcattcgtccccatttttcccccttttttttctttgtatgtatttggcgtcgtcgtccaattccaaaggtcaattcttcgcccccagcagaagcagtcacttttattttttcccattttaaatgtgttcaatctgcacctgtgttccccatcatccagcaaaactatcaatttttgaagaaaaaaaaatgaaaaaatgacatatcccaaaattctcaaattttggtggaatcccttttttgtcctcccttttttcatacctaacccgaacagggtcagggcacgcatttagaggatgttcctgggtaatagtgaagctggtggcggtgggggtcaattgggccccgccg

SEQ ID NO: 40629 - DNA, 385 bp, Heterodera glycines
  misc_feature (330)..(330): n is a, c, g, or t
  misc_feature (370)..(370): n is a, c, g, or t
gaatggacaggttttatggaggcaaatgaaatgacaaattcgaactcaaattgaaagggtggtccgaatgtgagggaaagtgcggacagatgggcaaacggagacggcgacggaagtgcccggggggcgagagggaatgcacggaaccgacggaagagacggagcaatgccggagggttggaaattagggatgggtcgaaacggggaggacaaatgaaaaccattccagaggggggggggtgggggtaaatcttcctaaaagaggggagggggggaggggagagaattgaggttgtgaggttattataaagcacccaaagggaggacggngaatatttgtcgaaatgtccatgcctattttgattattangttgaactgtgcgga

SEQ ID NO: 40630 - DNA, 1032 bp, Heterodera glycines
cgggcaaagaaccggggcaaagccaaagggggataaatttgaggagagaaataagcaaaggaaatgggagaggaaaaggttgccaaaaaagattaaaacaaatgataaaggaaaagcaaagaaaaattgggacgataaaacggaagaaaaggcaaaagaaaggacaaatggtcaaattgggagaagataagagacggaagtgataagggacgatgattcatcagcagaaagaaccaaaaaacaaaacaaaagcctacacaaaactgttggtgaagtgaagcggtgaatttgggcaaagctttcaaagggacgagaaaattttgaaggatttgccgcggcgaaaagagacgccgactccgttgggaagtgagcagcggaatttcgggaggaagaagccatccgacaagcaatcgcagggggaaaaagccaatcagagggaccatctgctcaatggaccaaaaaagagaacgccaatggcgccgaaaataatccccggaaggcatatactcaattttgatctaaacactcgaataattaggtaacaattaacaaattaatcaaccaaacaactcacgccgcctctttcgcacattctctgcgcatgtttgtaaaagaacggtttgtgccattgtccaaatttgttcaacaatctccggtcatttctcggcagtttttgggcgaattttgcacaaatcaacacggaagtgccattgccaaattgaatggcttcgacaaaatcattgcctttctttggcacggattcctcgaggagccgaccgacgagttcctttttttggggttgaaatacgaaaaggatcaaccgactgaccttttgggaaaggcacggttggtagaaaagcttgacgaagggcggacaagggacaattcggagggtggcggacacgagaaagcccaaagagccgagggaccacggaatgccgaagaacagcgactgattctctccatcctttggcatttaaagcatcaaaaaggccaacagtttcttcctttaatcaccttttcggcaattag

SEQ ID NO: 40631 - DNA, 1151 bp, Heterodera glycines
  misc_feature (57)..(57): n is a, c, g, or t
  misc_feature (60)..(60): n is a, c, g, or t
  misc_feature (63)..(63): n is a, c, g, or t
  misc_feature (68)..(68): n is a, c, g, or t
  misc_feature (70)..(70): n is a, c, g, or t
  misc_feature (74)..(74): n is a, c, g, or t
  misc_feature (76)..(76): n is a, c, g, or t
  misc_feature (96)..(99): n is a, c, g, or t
  misc_feature (112)..(114): n is a, c, g, or t
  misc_feature (117)..(118): n is a, c, g, or t
  misc_feature (122)..(124): n is a, c, g, or t
  misc_feature (126)..(132): n is a, c, g, or t
  misc_feature (139)..(140): n is a, c, g, or t
  misc_feature (142)..(142): n is a, c, g, or t
  misc_feature (144)..(144): n is a, c, g, or t
  misc_feature (163)..(163): n is a, c, g, or t
  misc_feature (168)..(168): n is a, c, g, or t
  misc_feature (172)..(173): n is a, c, g, or t
  misc_feature (176)..(179): n is a, c, g, or t
  misc_feature (182)..(182): n is a, c, g, or t
  misc_feature (187)..(187): n is a, c, g, or t
  misc_feature (207)..(207): n is a, c, g, or t
  misc_feature (210)..(210): n is a, c, g, or t
  misc_feature (224)..(224): n is a, c, g, or t
  misc_feature (229)..(229): n is a, c, g, or t
  misc_feature (246)..(246): n is a, c, g, or t
  misc_feature (266)..(266): n is a, c, g, or t
ccccccgccctttagaggacgacaaatatttcaacaattccaatggaaattgactanagnaancgaangntaangnaccttttaagggaaaaaaannnncgaaggagagaannnaannaaannnannnnnnnggggganngngncgggagccctcggggaagnagagntggnnagnnnnatnaaggnagggagagttttgggtagtnagnaattgttgtttaanttgtnagataggaagggtgggnatgattataatgtgttaagnatataattaaaagtaaaatgatataaataaaatataaggaaaaatttttaaaaaaatttttttagatgttgatttttgatagaaaaagaatgagagtgggaaaattaagttgtaaataaaatttggtggggtttagagttatttttgaaaaaatatttatgaaataaaaaaatttatttatttaagtgttggtttggggtaattaaaaaattatggggagttgaaatctaacgacaaatttaggaaatgggtatatggaatttattttagttggatttttgattgatatatagttaaataaatggtatatagataaaattaaaaaattctatgaataattattttttaaaagaaagtgtgatgataaaggaaggttatgaggtgtaagtgggattatgaaatgaaatttggtgggtggatagagtagaaatgggtattttatttttgattttttatataaaagtcaattataaaaaattttttataaaacacatcttttattttttattttatttcattaacaaaaaatttattaaagataataatgtaataaatatcttttcagttcataaaatctaatttttgtctaatactttttgagtaacttatgtgtcaaaatgggttaaaaataagaattttagatcaaaacgttttttggataattgactttggtataaaaagcaaaaaagaaaaaatgaatttgcatgtaggggattccgaaacctagggtttaaaaatcaatgacaagcgcactaccgctacaccactggacactcgattggtgcaaataaatgtttaaatttgtttattcatttaaaaaagcttggccccgtcttaattaggcactcagactcatttttgccagaaaataaaaaaattttttaa

SEQ ID NO: 40632 - DNA, 848 bp, Heterodera glycines
  misc_feature (780)..(780): n is a, c, g, or t
tagggctaccgaatgctgctaaattaattcaattcggacaactatgaaaagagttatgctccaaaaagcgggcgctggcgcccagttggttggcgcccagtcgactccaccgtggtctatccccccccccccgcccgctctttcacgcggatggcacaaaaaatttaaatatgcttttcaaaatcgcaggaagcggccaacagccgcgcctcgcaactgagtgtgtcgccggcacctccgcctgagcatccgcaagaccagcagcagtacagtccacaacaaaatcaacagtacagtccacaacaaaatcaattgatgacactgttcccgcccggcatggaactgaacgtgccgttgtcgtcgacgacgacggcacagccggcgccgccgctgtcgccagtcgcacggatggccaacggcggacatggccatcaccaccaccagcaacagcacaataacagcagacatccgcaacaaatgtcctcataaacataaacatgatttttaattgatgttttttatgcatccagagctttctttctatggtcgacccaaaacacaatagataagagaatatcactgatcaaaaaacaagcaaattttgaaaacaaaagcctaaggcttgttttgaaaacaaaagcctaaggcttgaaagggctttgtctaattatgtaaatcaaatgcttttcaaattacgtgtatatttaatttgtctgcaaatttgatttgatttcacatgagcgctattaaattatcatttttgctttttttgtataccanaatcggagaacacaaatgcaagttctgatcatcctttattcatttttttgttgtttattttgctaatt

SEQ ID NO: 40633 - DNA, 1223 bp, Heterodera glycines
tcctttttttgattgtattatttgtgccgaatttgtccccccatttttgtctttattttcccacaaacaaattcaagccgttcattattatatatatttgtgtgttcatcaaaacaaatccaagtctttcattcattttttgttttgtgtgcggacttctttcttttctcttttctgatgagcccttctcctcttcacacaccgaaacactccttttattattttgtaaaaaacaaaacaaattacttacattcgtccaaaaagtcactttttaaattttattccattggccaaattttatttcattttttcgcccatttttttgtattatttttatttgtcttacacaaaacactcccaataattattaaacacagtgccgaccgaaatttggtgtattttacctaacattttttacttactgcgctctttcagcatttttttctttttactttccctgtcccctttcattcattcgcttgtcattattatttttttttatatatatttgttttttatgactattaaatacttcaatgtcagaagaaagtgcgtgcatttttatattaaaggaagcagttaattaattacctgattataccttaattgatttacatctgctgcagcaaaagagagacaaagagcccttcaatttattagcgcgtaagtgtatcgaatatcgccatacccacaattaattttcattttaaatttgaaaaaaatacgcccacaaaacgccaaaacttttttgtgtaagaaaagaaaaaagaggaagagcagagctaacgccaactaacttcgaaaatgttttaagccttcgaactttttaacggccaatgctaacccattataaataagcttttgctttgctcaaattttcctaattttgatttttttttaatgatttctcactcacctggtgaacctcaagacaatgtctaagaatcccctactttttaaattcaatttacatttttatgtctaatggatgcccaataataaattttaaatgttttttcagcctgaaattttatctatcatttgccatttgctgtaaaaaattgaatttttacaaaaaaagcgatggcagaagtgaaaaaggagcccatttttacggaagtgaagaaggagccaatttttgcagcggagacgccagcagccgagccgagaagggacagcgcttagtgaacaatgccacccgactttgacgacgtcaccgcagt

SEQ ID NO: 40634 - DNA, 1768 bp, Heterodera glycines
taagaaaaaaggtaacgaaaccagtggacaactgtcggcctcacctgtcaataatttgtttgaggcttgcgattttttgttttggcattttatcacaatttctagggcgttgagttgccgccgtttactgacaatcagatgaatgtttggtttaagtatttgtcctgcatcaattcgcggatcagagaagtattttttttagattattatatggaacgatgtccgtccttttatttttagattaccgaggatgcatgagattattttatttacctaaaagggaacggatctgaatttatttatcgtttcggtgcaatttaaagctgattcaatttgtaaaaaactatttgactattaaacaatattcgattctgccttaccctatttatttgtgaatgcaaataattattattttttccttgactttttttacactttttgttttcgttggaaatgtcgccgtctgctgataattcatctgacgatgagcaaattgcctgtgatcccgagatcactttccgaggttgtgctccgttctcaatttgcatgttttccttttctctttaggccgctccgttcgtccattgaaatggctttccgaagtgtcttcttgtcgttaccttcccgagggtgaaatggtcacagtctgtcagatcctcgtaacttttatttgtttaattattactggttgatttttcatgtcagatcagtcggcttgcatatatgccaaacactgtctccgtacaatcccctgctaccatttgcggcgatattcatggacaattttacgacctaatgaaattgtttcaaattggaggtgacattctcgaaaccaattatgtgtttctcggtgactacgttgaccggggctattataggcgagtcaatttgaaaatcaaattttattggtcgtccaatgaatgtgcagaatggcaatggggcacacgcaatcacaaattttgcgtatggttccttccacaaattgagaatttgggcctggtttcttaatgagaagctcggccttgttttcattattaatttatccacgtaaaaccaccgaaattaatacacaaaaaaaccttttcatatgataaaatgtttagtttggaaacgatctcttacctaatgctgctgctgctaaaatacccggacagaataacacttctccgcgggaatcatgaaactcgtcgaggtaaccttacgactgggaccttgtctttgagtttggccctaaaactaagttggctgtgaaatttgggtttttcaaaaatgaccaaatttagcggttttgagcaaatatttcaagaaaataaggatttagggtcggtggttccgatagacgccgcccgggataaattgaaaatttcagtgctatttattcatagaattatacaaaaattgctagtttttggctcaaaatcgctaaattggtcgcactctctttgtttattacattgctttttttatttgtagtcttttctttatgttaattgtactataataaaattcatttgcttcaatttcctttttcattaagtctcacatcagtacggcttttacgatgagtgccaacaaaagtacggaaattctgtggtttggtcctggtgttgccgcgtcttcgacgtgctgcccattgccgctgtcgtggacaatcaaattttctgtgtgcacggaggattgagtcctgaacttccgacacttgattcaataatgtgccttcagcgcaacgtggaagtgccggcaaatgggcccctttgcgacttggttt

SEQ ID NO: 40635 - DNA, 1134 bp, Heterodera glycines
  misc_feature (104)..(104): n is a, c, g, or t
tttttatagatttttaaatgtttggaatttttttttggcttaccaaaactccatcgaacctggctctttttaaacatgccaaaaagtttaggcttaactttttntaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggctctttttaaacatgccaaaaagtttaggcttaactttttttaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaaaattatttccagaaaatctcgcatgaattctcatttt

SEQ ID NO: 40636 - DNA, 900 bp, Heterodera glycines
gccaattggacaattttaataagccatacatccattaggaaaaacgattaaaaacaaattacgattagccaaagtcaatgctaaggaccaaaaaggtgaaataataccaaagacaaacagaagttatgaaatccaaaaataatttcagctaataaatcctatttcttaaatggttccatatttccttgaatgaatctttccattattttcttgcgcttccaatggtttgtctttctttcccaaaaaatgtcccccaaatcccccccccccggcaatgtctctttatgaaatgccgacccgatttgtgccatccccccctttcctttccctttcattttccctttttctcccaattatttccgtccatcggatgagcccattctgcgcacaccttgcagctggcgaacgcaagaaatgacaacaattattcttttcttttgtgtgtcgccactcgtaattaaaggccaaaatagccattaacgaaaaatcaacaaaatcagaacaaaaccccaaagtaaaaagcatcttttggggacgaaatgtacgtcgtttaattttcgcaaaatttcccgaatttctccccccccccctccctttgtaattttccccttgttgctttaggccataaatttgttttgtccggaagaaagggaagaggaagaaagaataatgggaaaaggaccgagaaaggggggggggatacggtaacacttttggccattggggaaaggcaacaatggcattggcattgccacttgtggccatttgaaatggttgtgaaattttggaatcagtgccaattgctctgtttggcgttggcatttcacgcggtcacaaccgaccgtttctggcgcagctcgcatcggatgtcccgtgccgcccgcctcttgcgagccgtcg

SEQ ID NO: 40637 - DNA, 1270 bp, Heterodera glycines
  misc_feature (11)..(11): n is a, c, g, or t
aaaaaaaaaanatcggactcaccaccatccgacgttttgtcaagggatgaagcggtgccgccgctcttttcagcctcgttgcaacattgtcctccttcttcgtctgcttccattgtttgcgtttggccccgtcgcacgtccatcggttcctccttcaactcctcctcttcatcaacaatttgtcgtcgttgtccccctccatcaatggtggtgccgtcggtgttggcattgtttttgttttttgatggcatttcttggtcaccaccatcgtggtgttcaacagcatggacaaccagcgtagtgtacagagtgtcggcattgatttcgaccgggcccaactggttcagtttggcagtgccactgcattcactttcaaactccgacatgcattgaggcggttggcctattgtaggaggaaagcgagtcaaatgagtggttgttttttttaatagagcaaaatttcggcattttttgatttttttttttggggggggggctgaaaatgccaatttttactaaaataaatgatgtcaaatgagtgagtttgatttcaaaaaatgagctaaatttggcgttttttgactttttggaggccgaaaatggcattaaataaggagaaaatgctaattttaatataactcgtaaatgcaaaacaaaacaaaaaaaaaatacttgaattaatttgctggaacaattcccgatcaaaaccagtgttggcccaatcacgacggagcagaacagcggcacattcttgaacagtgcctaaaatttaggggggggggaatggtgcaaaaaaaattagatttaaaaattgataatacttttatttggttgaaaagcgcataaaatgccatggcattgggcataatgacgtcgcaatgagacaacggagcagcagtcgttttggcacaaatcgcaacgaatacgggtgaacgggaaattgccagccaaaaaaagcacctccacattgtcaaacacctaaacacaatggttttagtcgttttatctttaaggctaaaaacggataaactcgttcagccgcctctgacgaagaatttttctagcggttttttcaaaatttataatgaattactaagttttttttaaaaaaatttttcctaaaatcgctataaaatgcttccaaaaatttttttcttgtaattttcttagatttttcgctcaactgatatgtgagatagcgaaaccgcatgcacctatctctcacgcgctatagccctattttcttctcaaaataattatgataccagaa

SEQ ID NO: 40638 - DNA, 742 bp, Heterodera glycines
agtttgttatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctgagtgtaaatatcgactggccattcaaattctgcctttccagccttatggaaagatattatggaacttttggttccatctcagttgtcaacgccgcgactgcatcgttattatatcagtcgagagaattttcgaatcgcttt

SEQ ID NO: 40639 - DNA, 1057 bp, Heterodera glycines
  misc_feature (28)..(28): n is a, c, g, or t
cacagcatattccaattgggcgcaatgngcgtcgtcctcgcattggacaagcccatcacatcattccgataaatcattgttattttgttgttattattgggcatcgtccccccccccatttcctttaccatttttctctccccccccccccctccgacccaatgatccctttacagggggtaataaataaatggcgtgcataaattaaacacttgtggcgaattgcaacacaattcccaatttgatatttgtgcagtattttgcatgtttctcttacaactagtcggattaatatgttcagaaatgattcgtaattcttttcgattctttttatgtaattcccaaaaaacttccttccccctttctttctgctgctgtcgttgtccttgagctgaaattcttcaagaatctcgtcccccgcccctttttacctcactctttcctccctttcctccgtgcctttcttctccctctcaaacgccaaaagttccccttttttgttttgcttatcggcacccaaaatctctttggcattgagcgcggcaaattttaagggattgaattgtgcgcaagccgagttattccttcctctaaatagatttttagctgtaactccctccgactttggccttgatttattttttggattgccgaactttttcggagattggaatttgagtgggtaaaatggttttaataattaaagacaaatggcaaatgctttggttaatacccatctttcgtatcacttcttaatttgtccatttcatttcttgcacttctccatttgttaatctgactagccccaaagcccacaaatccattgaccgtcctttaattagtgtaatcgccgcagggttttcttcttctgatgggtgccgtttcagcccaatgttctccttcttatcactcatcagaatgggcggcacttttcaaagtgcaaaagacacagcagcaaataaacgcttcagagtataattgacttacgcaaaacttagtcgcctttgaggccttttgacaataattactccgattatgggcgggggattgagaataa

SEQ ID NO: 40640 - DNA, 926 bp, Heterodera glycines
atactatcattcatctcaccataacaataaagaattttcttaggcggtggttcaattagattcttatgatgttttaaaattcgtaatagccaacgggtcttaccactcccggtagcccctgagagaattagagtgaacggaccgcgaaacatttttaatgcctcttatttatttgatctatttatattttcatagggaacatatttcgcgcatttggggcatatccagaaattatcaaaaaatgatgtaccgaaatgcaaaagactgtgctttttacacctgctacaaatctcgtaatgacagggacagtaatgacaacacttaattttatgtgggcagttcatttttcaatttaattttattttgggttgctatttatagaaggggtatataaagggagtgaaaggaccatttgattgataccttgtatcaaaaatgcaaagaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtctggggacgaaaagtctgatagactgtgaaaatgctattaaaaaatttatagaaataattaagtgctcggggtgtccgggggcttcttacaccggacacacgattgaaaatattgtttcgacctttaaattcggacatgaaattgaactgaacgaattcagaaaaaatcgtcgtgccttttatgaaccagaaatattttgcggtttaaatttcaagcggggtaaaagcatgacagcgttaattttctggaccggtaaagtcataattacgggaactaaaaacaattctgaaattgaggaaat

SEQ ID NO: 40641 - DNA, 895 bp, Heterodera glycines
cctttaggcccaaattgccccgaggcccaacagagcctctcggtcccggggagccctctctcccctcaattccttcctcccctcggagtcccgcaatgcccgacatccctcgctcgccttggtggcctcttaagaaaaagttctttaaaatatgctataccatgaacaaacctttgcccgggtggtcctcctggacacacagtgcacggcaagtctaattccgattccacgacaatgtccaatccgtccacgcctgactcgcccggacttccggcttgcccaggaggactgtccgggcctggcaatcccggtggcccaggagggccctgtgggcaactcaacattgaacagctgcaagcggagtctaaggcactttggccgccacgttcggctgaggaagagcgcttatttcgcgactcagtgaaagtcggaaaatggagaacagcccaaactctgttggaatcagccttagggggggaggagagcttaagctggaatttcgaaaaatgccttgaatttctgcgattttgccaaaatatttgaacgttccgagtcgatttgtgagtacaaaatcggcacaccgattgccaatgcgagaacactgaaaagtgcgacggagcaacagccaatggccaaaagatggaaatggtcccagcagcaatcattcgtcgtttgttcttttggcatagattcggcgatatttggacgttgctgcttcattctgcggaattgtcgtgataattaagtgcggcggcgaaatgttttagccgcttcttttaagcgaatgtttccgccgtcattcgtttcggaatccggatgataagccggtgattagcgtggtgcattcctcattcaacaatgatctaccgctaatgctttctcaaccgggcatttg

SEQ ID NO: 40642 - DNA, 814 bp, Heterodera glycines
aggggaggggcggaaggaaggtgggggggggggagagaaaagggaggaaaagagggggagaggcattgggaaagcaataaaaaggcgaaagacaaaaagagggtgcccaaagacacacccaacaaataaataaatgtacacttgtaaatgtacgacgagtgggggagggagggatcagcagaacaaagtcaaagtcaatgtcatccctcccctcgagcaacaacaacacatccaccgaagtgattgtgagagcaaaggattgggggcggggggaggaaggcacaaggacaccctttgcccccccccaatcggcgacccccgcggggtgcgcgaacaaaatgaaactgaatgaaataaacaggaggaggaggaggagggagggcagggtttgattcagcaacaccaatcgagcaactgaaattggacagattggcaaattctttttgttgtaattggattagccaacaacggcccggccgatgggggcagagaaatgaatggggggggggcaaaagacagaaaaaccgaaagatcaaaaagcatttcaaaatcaatcccgaggattcggaagattgggttcatctaatgacaaaaatgtgtttaggaggcgaattttttacacataaacaaaagatggcatagagtaagaaaattgagcaaacaaaaatcgaatggaaggaaagaaagaaatgataagataaaagggagggaacgatatcaaaattaacggatcgaaaaggaacaaaaaaaagggggaaaatgggaaacgaatgaaagtcatcggaataaaatgaaaaatgggggaggaataaat

SEQ ID NO: 40643 - DNA, 1390 bp, Heterodera glycines
acgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataaactgatcagaagcgcaccagattttgcaagggcatcaaaaagacaaggaaaagcaccgctatgatgctaacaccagtaactcttaatttaaaaatttttattaatttttaaaacttcactattttaaattttttatagatttttaaatgtttggattttttttggcttaccaaaacttcatcgaacctggttctttctattctctttcaaatcgcccccaaatttttttttacagcttaactaggccctattaagcttatttccagaaaatctcgcatgaattctcatttttaaattttttatagatttttaaatgtttggatttttttttggcttaacaaaacttcatcgaacctggttctttctattctctttcaaatcgccccaaattttttttacagcttaactaggtcctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatctttaaatgtttggatttttttttggcttaacaaaacttcatcgaacctggttctttctattctctttcaaatcgccccaaattttttttacagcttaactaggcccaattaagcttatttccagaaaatctcgcatgaattctcatttttaaattttttatagatttttaaatatttggattttttttggcttaccaaaacttcatcgaacctggttctttctattctctttcaatcgccccaaattttttttacagcttaactaggccctattaagcttatttccagaaaatctcgcatgaattctcatttttaaatttt

SEQ ID NO: 40644 - DNA, 696 bp, Heterodera glycines
atttttattaccattttcaagtgcaattccattggtgagtcaattaatagcgtaattatatttaataatccaatttaattaggtgtacgatgaaatggtagttgcatttgtaaaaggacagcaagaaattccattcagtgaatattcaaagcaaaaatatgaggcaaaccttggcattgtgtattttatgataaacaattggcactgtgacaaaatagatgagaaatttaaggaatatgaacggacagaatgccaaaaatatcgcaaatatttggatattttgtacgaatatttgtacagagagtacgtcggaattccaacagccaagccaaagtttgtatttcaaaaccaaattgaaattgacggtccaataatttatgcggtgaattgtctgaccaaaatttctcagttttatttaataaaatcggtgggacaaaaatatgaatataaattaaacaaaatgttctacttggttgacaattttgaaccaaaattgttgaatgagaagagatttaattataaatttaaattaaaagatgtatcaaaaatgccaattaatgaaatgattttgcaattagcaattgaaacagcgaatgaatggcaaacaaacgaaagtttaaacggtataatcagtcaaaaatatgaagaaaatttggaagaaatgctcaaaaaagcggaagaaagagcaaaaaaaga

SEQ ID NO: 40645 - DNA, 934 bp, Heterodera glycines
agtgatggactagcgagtgatgtccgtaggaataaaagccaaggcgtggctgcgtcccatccaacaatttcctaatgcttagtgatggactagcgagtggtgtccgtaggaataaaagccaaggcgtggctgcgtcccatccaacaatttcctaatgcttagtgatggactagcgagtgatgtccgtaggaataaaagccaaggcgtggctgcgtcccatccaacaatttcctaatgcttagtgatggactagcgagtggtgtccgtaggaataaaggccaaagcgtggctgcgtcccgtccaacaatttcctaatgcttagtgatggactagcgagtgatgtccgtaggaataaaagccaaggcgtggctgcgtcccatccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctagtgtttagtgatggactagcgagtggtgtccgtaggaataaaagccaaggcgtggctgcgtcccgtccaacaatttcctagtgcttagtggtggactagcgagtggtgtccgtaggaataaaagccaaggcgtggctgcgtcccatccaacaatttcctaatgcttagtgatggactagcgagtggtgtccgtaagaataaaagccaaagcgtggctgcgtcccgtccacaatttcctagtgcttagtgatggactagcgagaggtgtccgtaggaataaagccaggcgtggctgcgtcc

SEQ ID NO: 40646 - DNA, 958 bp, Heterodera glycines
  misc_feature (943)..(943): n is a, c, g, or t
tctccaagcgtgttcgcgaatttaactgaccacctgttcacctcccccccccccatgtgcgcgaaatcctctcacataacaccggtacagacccccatgtgtgcgaaaatttcgcgcactacgacggtcccgaccaatcctcctagaccccaccgacttccctcccaaactcttagtgcacgaaaatttcgcgcactacgacgttcccgaccaaccccccaaaccccctttgatcccgccgacacccaccccaaaccctacgcccagcgcgcgaaaccctttgatccgcgccgcaaaaacgcccaataccctgtcactagtgcgcgaaaatctcgtgcgctacgacggtgtggcagggctaactactcattctgtattcagatagaaatataaaatattaatatactataaaatttaaaagttcaatgtgatgactatataattatttttatcttgcttctcttttaataaattaacaatatttttatttttttaaataaatttttcgtaaatcaaatttacataactattaaaacaataaggttaattaattattaattgaattatttttttgtcttaattatcttttccttaggtttctaattatccgtgttaaaatattttccaagatcacagatcaattcaattaggaaaaactaattttgatatattttcttaaattttattcctaaaaatatatagttttttgatctctttattaaaaaaaattcaactatacttttagctttatttgttctttggattggtttctaatcatcattatattaattgtatctaaagaatttcaggaacaaagcaatgaaaaacatcaaaatgattattccaaaaaaatgaaatttctaaaatgaagatgctggcgcattatggagcgaatatcgctagttgcatactagatggataaaagaataattaggaaacccantattaatgaaataat

SEQ ID NO: 40647 - DNA, 803 bp, Heterodera glycines
tgtagaatagaatggccattgctctccgcgcccctctctcctggtgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctgggatagagaataaatttaaaaattccctgtagaataaaatggccattgctctccgcgcccctctgcccatgctgggaacatttgtatggtacaaaatttctcgcaaaaaagagatagcctttttctggcatagagaataaatttaaaaattccctgtaaatagaatggccaatgctttccccccccctctg

SEQ ID NO: 40648 - DNA, 1482 bp, Heterodera glycines
gttcaaaagaaccaggcggcacatagccatagtcattgtttgtgaccagcgttcgtccttcgacccgttgcaacaatgctgatgcttcatcgtcagcttggccggtcaacggcacaacgccagaacgtctcctcatgaaaaagataggatggaccgttatattttagaaaatgcatatatactgtaatttcctatttgcccgaattggcaattaaataatatactgtaatttcctatttgcccgaattggcaattaaataatatactgtaatttcctatttgcccgaattaacagttaaataatatactgtaatttcctatttgcccgaattaacagttaaataatataatgcttatttatctattacttgatcaaccgttgttgcatgttgagctgttggtaggaggccccgacgctttgcgcatcgacgctaccgtagcgaggaggtggtaccgtaacctgctggaccaccgccgccactgcgtcttgggcctcttttgcagcctcgcgactgtccgcttcctttaataataatcaaaaataaatataaattaatttgcttaaatcaacaacaaacctttctgcttaaatagcccacctaaaaatttatataaatttttaatttacataatttttttccagttttccaacccaagcaagctccaacaacgaaaaaaacacgaaagtcatgcaggaaagcaaccagatgtcgattgccttaacatagctgacctttggcaaatttctgaaaattttcttattaaaagcaaaattttcctgccccatttgactgcactgcatttttgacctaccgaattatgttgccaaactaaaaattcaaatggaattatattaaattgtatggttaattaattaatacatttatttatttgaatccattaattaagataatataacctggaaggtcatcgctgaaagaaatgtattaaatattaaaatgatgaaacataaaataaatttcccacccaaaagtgaattaacaccgagcattgttcgggccggaatggcctgtgtaccgagcacaaaagaaatccatgctgaatttttttttttttttgcgtgaaaactaatggaaaaaatcatataaattttaacgaacagatgaaaatggtgaggtaggtaggtaagtaggcctgcagaatgtacctgattgtgggttttcaaaatttattttatttatcattttcattggcaaagtgtgccaattatttttgcattttaccatccagcacgacgggagaaatgaaatttcatggtcaattcatgccaatagccggctgggtagggctgaaaatatcaactgtattttttgacttgaaaatttttagataattttttagggtagtcccgtaacctgaaaaaattttaggcactaggaagcggtgacttttttttttttgatcttcggtccatccgcaggaagtcaaaattataagcgcatatttagaaattttcttcaa

SEQ ID NO: 40649 - DNA, 876 bp, Heterodera glycines
atttcggggggggggggggatcttagaattttctgagtcatataattctggattttttaaataaatttacaatttcttaaattttttgctttaaaatcgctctttttgttgcgcggtttttcccaaaaaaactttttgggaacaatgggggcggggtcaggcggtgccgataatccacacaacaattagaaaaataatttatcaaaatacattaatttatttaaaataaagtaccgaaaaaagacagtaaatcccaaccgggactcaagaccgaggactctcgagcttcactacccgctagcaggaagatgtatcaaaatagcatggtagtcgtcaagtaaaataattgtttttatttggcagagaagtgctgtatcccaaaaaataaaaatttatttcctttatcattttaattggcgtatttagcgttaattgttctcactcgcactcccaattatcggttaattgcccctcttccgactaattagacagacactctttcagtttgacgacgacagcttcttggtattaatggaccactaaacactgctgggtggcacagttgttttatagcattgtcagtttgccgaagcactctttctttcttgtgataacagctaaaagtgccggtgccatttggacgataaaaatggattccgaaatttttgtaattaaaatatttctttttgaagttttttgtctccaaattcttcaataggataatacgcgaattcctcaaaatctccaagcatagcttcttgtgaatggtttcagcttggttaatctgttgtcatatgcatataattttcaaaaaaatttttaaattaatttaaagaaaaatattttaaaaagatggaattgctgcttttccgttat

SEQ ID NO: 40650 - DNA, 1379 bp, Heterodera glycines
ttattaaagtaaaaaagtcttaataatttattgtgtatacttaggattggccacatatgcctttattacggtaacaaataaatgatttaactctcttttaatacagcgtgcgagatcggcatcgcgccattagatcgaagaaatggagagtgatgtgaccgatggtctgtgggataaaatggtgctgtgtctgcgcagcattgtggcgttgccgccgaatttggacaggcaaagtgtgagttgtggaaatttatatgacatttttatatttgtaaatttgttcaaatttgattataaaaataaagacaatttttccgatgccatttcgttttaattgcataatatttcattgaagttagcataaattaagcatacacctcaatttcggcactataatgcttattttttgatttttaaaatttcaaggttaaataattacggctttttaaacctccgtaattgctgaatacgggtttcccgtaaatgacgcctgactgctccccttaataatttaaaattcaaaatgattgaaaaatattaacgaaaatttaatgcaggtttatccgaactcttcgtcatcgattggcttggccctgatcgtcagcaatttccgatttgaggaccgtgataacagggatggcacaaacgtcgatgagcagaatttgcgttcaaaatcgattccaaccttttttaaatggttttctatttttgatctatgagatatatttacccaatttttaagaaaaataagggttatagtggaaaatttttgaaaatttgtttggatttgttaactgattttgcctaattcggagatgattttttgataacaattttccatttcataggggtgtatttttctgaaatttttcggatcggttcttaggggggtgtatttttcgtgtttatggcatattggttattaattttgttgagaattgctgaagatattgttacaatcttttcttgatgacagaaacagcactgaatagcactgatgggtcatatcggcgcttaaatcgaaaagacaacaaatgatgacttgccaatatgagtagctgatctaataaaagtcacgaatagtgagaaattctcggatctcgctaatttactagttaattgaaattgcataataagaagagacttactttgtcagcattcataactcatttgatgggttgacgaaaagtgcagccctatttattgtttcgtaactgattggataatgatctcctaactttccggcactgattgatcgatgtgtcgtatcatcgcaatttacctctatcatatgtacatacacaatgacaaagcggcaatcgtaaagaatgagggtccctaatttaactttttattttaggcttaaaattcagtttccg

SEQ ID NO: 40651 - DNA, 1340 bp, Heterodera glycines
  misc_feature (17)..(18): n is a, c, g, or t
  misc_feature (81)..(81): n is a, c, g, or t
  misc_feature (1294)..(1294): n is a, c, g, or t
  misc_feature (1308)..(1308): n is a, c, g, or t
  misc_feature (1316)..(1316): n is a, c, g, or t
atttttgagaattttcnnatttcttaggggtgtatttttgaaaaaattttaggtcaattcttatgggtatatttttcgttnttattgcatttttgtcaataattttgggcaaacgccaaaatagttgaaatagtttttttaaatttttttatgttttaggttctaaaaataaaaaactagaaaataggcactaataactcgaaaagtagcttaaaaacaaccgaaaaaaacatattttcgtgagtttcaggccataggaagtccagaaaaaaaaggtaaaaaactaaaaattggagtcctattaataagaaatttgtttaattaattattattcattaaaaaatgagtgcataattataataataataattaatttaaatatttactataattgatattttatgttcgccccattaatattttttaggttcgaccagcaggcagcgaacaattgtaaatttcttcgatttgctaacagagcattgcgaaaatatttgctctaccttatatcgaagaaatttttaagagaaaaagaaggtttttaaaatgtttaaaatgccaaatatttaataaaaataataaatgttcactttaaagataatagtatagtgaaacaatttaaacaccaaattttaatgatttaaaactttttgcggattataaagattttaataaaattcaaataattttttagggttatacagctccaatttatagcatagaaaattgccaaaatacgttttgaaaatagaaaatagggttagtccccctaaacccgtccgatttggaaattgcaaatgtggtcgattgcactccaaaatgctagatgtttttaaaattaatttctaagagatttttgttttttgaaaatttctgttacctatcttttctaatttttatgactagagctcccaaaagtatgcatataaaatcgcaaaatatgcaccaaaaattgcaaaatatgcatataaattttttcaaattgagaacattccaaaattcttcaaattcattgcatttatgctagaatctcgaaaaataactaattataatattacaataatttttagaagaaaaaatgtaaaataaagctaaagtttattaattttgaagaaattgagtaaaaaaacgagatttttccaggtttggacttatttttcgtcataaattttcatttaaaaaaagtttaaaatctgtaggaagcagtttaaataaatattggctaaaatctttttccatccattttactaattcattcgcattctcttcaatttctgggcatttttcttaaganaaattaattaatanaattttcnaaattttaattgtttgatgaattt

SEQ ID NO: 40652 - DNA, 986 bp, Heterodera glycines
tcaataaaaatacattcacgtgcgaaaatgggttgacaaagttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctactctactcaaaacggttcagaattcaataaaaataacattcacggtgcgaaaaatg

SEQ ID NO: 40653 - DNA, 847 bp, Heterodera glycines
  misc_feature (784)..(784): n is a, c, g, or t
tttggggtaatagtgaagctggtgccccccccccccctttttggaataaaaatattttttcttctgattgtgaaaacacgttttatgggttttgagggttactgatcacgaacatgacattcttttcgaccgattccgaatcccggatctgaattcgaacaaaaaattgaaaactcaaatttttcgattttccatgtttttgttgaaaaatggtttaaaagatcttttattgaagcaataatgactttcacatcgtttccatatatttaaacaaagtttgaaccaaaatgtgaaaatttgagttttcgactttttgttcgaattcaagtccgggattcggaattggtcgaaataggtgccggattcgtgatcagcgaccccaaaagcctttggaaacacgttttcatgacaaacaaaaaatttttcgaaaaagggggggggggggacaaagcacactattaccaaattttgtaccgtgtatattatcttctccatatgtaccgtatattgtaattttgttcaatgagtactgtatgtttaattttgttctatgacaattttggacaaaagttaacaatctgttaacaaattttcattctttttggaggaggattaacaaattttcaaaaattttcctccgcggcgcctttaccaaaaaacaatttttcttaaaaattggctcaaaacgggcaaaatttggtcattttttggacaaaatctgtgcacaaattacattcaaaagctggacttttttgtaagaaaactgcttttattttacccgcantattatagaagtgaaatcctaacatttttttcattgtttatcggtcaattatgactagaaatt

SEQ ID NO: 40654 - DNA, 1282 bp, Heterodera glycines
  misc_feature (50)..(50): n is a, c, g, or t
  misc_feature (125)..(125): n is a, c, g, or t
aaataaacttttctactcaattattttattaattaattcaattaattttnatcaaaatgacattggtttatttattaattaaaaatacacttaaataataatgcttcaatttaaacagaaaaatntagagttataaaaataaaaaatatattttaaatagcctaaaacggaattgcataatatttacaaacaaattattaaaaaaatctttatatttggtaatctacttaacaatggtttaaaatttaataaatagttagaaatataaaaaatcatgaaaattcctcattagttcttgaaatttctattcaattaattttaccaattaactcaattaatattttataaaaatggaatttttatcttttttattaaaaaaacctaaagaaaatacattttaataataatgattaagtttagttcattacaagcaaaactcagttggtaaatttaattgtttaaattaaattcaattataattcataataaaaaaatcaaacaattaattcctacatcgcgacaagtaattttaatatattaaaaataaggacatataaataaaaattagtcagttaaaaattaaagaaaaattattaggtaaaattttataatttttcgttaataaatgtattatggaattcaatcctcaattttttatgaaaatttgaaagtaaagtttttaaaatatgtaaaaatgaatttttgaaaaaaacctacttatttgattatttattaacaagacataattttattttgaatttaaaggaaccaagcaagtttatgtgcggataataattaaataattcagcacttaatgaattgaaaagcaaatatttattaatgaaagtcaaaatattatcttatcaaataaaactgcataatgaactcaataaaatatatttatttcagttatttaaatgtttataaattttcaatacattaaaaagcaataaatataaatatatttctttctttttaaaacaaagccaaattgcattcaaattattataaatttttaacaaaaatttgagaaaaaataataacaattgtttaacatctatatttttattaaagagatttatttaaaataaataactacaaattttaatttattagcaaaaaagacaacgataaatacacaataaaatgaaacaataatatgtactgaaataataattaattttttaatcaatttcaaattacattagatataatttatttatttaattaaacagactgatgacaataaatttttatattcaagcatattattcaaatagta

SEQ ID NO: 40655 - DNA, 1194 bp, Heterodera glycines
  misc_feature (47)..(47): n is a, c, g, or t
  misc_feature (1114)..(1114): n is a, c, g, or t
tcatcgcaaaaaactcattacaaattcattcatttctgaccatcgtntagcaccaaccgccaccattgatggaatgcacatccaaaagtgattcatccccaatccaatccaatgaatttgactgttatcgctgttagcgatcagcttacccccctaccccttagctaattgttgattcgaatttctttttgctcggctttcatgggggggggattggacaatttacgcgacgtgtcacagcgccacccaccgcccgcccatcccgcccatggggttgtgttggggacgggggacgagtgggatgtatgcggttcccgcccattagccgcgctgcttcgccgcagggaccgcccatttgggcactgtcggccaccgcatttaagcgctgtccaatcagtgaaaaatcagtcatttccaaaatttcattctgctcctaaccaaaaagcattcaactgacaaataagctggtggaaggaaataggaaaagccaaacaaaaacatttttgaaaatcagtcaacgattaaaaaattttaaataatttttttcgaaaaccgtttcaattttttgtatttcacttaaatttagaaatcaaaaaaatttttggtttaaaagccaatattttgatttcattgttttttaggaagtgattttttcctctatttctgatcccaaatctcattcttcaaagcaacccgtcccactctcgaccgtctaacatgaacaagtggtctgcacttgtgtaagttttgtggggaggggtggggcttgaaccatggccaaatattaactctctgttcactttcagtctgttgatcgcgctgatcagcgcgctggacagcgctgttgttcgacaacagcgcgccgccgacgctgacgcatcgaaaccggaaccgaacaacgaaaagccaggcaaacttaaatgaatttaataaaaaataataaattagtaatcgaataattttattcaggaactgtggactcggacaaaataaagccggtcaaaattaaagcagggctcggatcgtaccaagtaactttccaagtacaggcgtgccaatttccaagtacataacaggggaaatttgttaaatccaattacacataaagatttanacaaaaaataaataaaaaaggataattttcctaaaattctatttttcccagaacgattttatccccaatattattatttc

SEQ ID NO: 40656 - DNA, 712 bp, Heterodera glycines
  misc_feature (663)..(663): n is a, c, g, or t
gaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcggagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttgggattcatgtgagtgttgagcagaaaaagagatagacgttttttcaaaattttcagagccaaactcgcccagaaagaaatccagaaaattagggtcgtcgctactattccganatgtggttggattcatttgagtgtgagcagaaaagagatagacgttttt

SEQ ID NO: 40657 - DNA, 722 bp, Heterodera glycines
atgttagaaatttaaaaaattatgtaatttttattttcaaataaattataaaaaattttttaaaaagttacaaatggtttaaaaattgatctaaactttaaataattttctttcatctcacatcagcatttactttaaaattattatttaaacttaacgcttcaattaagtttttttaacaatatctcagaactctttaaaatagagaaaataatttttaaataaaagtattgcaaaaatttaaatatttaaagttttattattaaacttttgtatcggattttcgctcctaccgtctttatcacagtggttattttcctgttctcaattcaatctatctttcactgcattggtctccgtctccaactctccaaaaccgttttcgtttttcaactctacctctccctctcatctccaacacgccttcaactcagtccatcgctgtctccatcgccgtttttgtttctcaagcgtctcaatttggtctccctctccaactcagtccgactccttcaccgtctccaaaattgtttccgtttttcaactctccctctccctctccctctccccctccctctccctctccctctccctctcctttcccgtttcaaaaaatctttcaaataattttaatttgtaaatggctggatatgtatgaattaataaaaaggtatctctagaaatgatttttacaattcaaaataaaagaaaaggagaatcaa

SEQ ID NO: 40658 - DNA, 1024 bp, Heterodera glycines
  misc_feature (11)..(11): n is a, c, g, or t
tttctattttncgggggatcgctttcacgccgaacccatgtccgggggagagattatttatttgcgcagtggaacaaaaagaaaagcgcaatttcctcctataaaaataacaaattaatttaaagggagggaaacatttgtcaattaagcgtctaatgagtacactaattctttccctctcagaggcgggaaaatcagaaaatcaaaaacattcatgcggaaatcaaattgcactttaattggcctaaaatggttgtgcaaaaagaaattgtaacaattagtgggtggagtggatggtcgacgaatgagtgggtgggcgggctgctggactcggtttggttggcttgcgtttgctgtcccaaaccaatgacattttacccttttcaatgtttgtaacaattaaaaaactaattgacattaattgcaatgtttgtttattctgtttcttccaattttcaacaataaacgccaaaaatttatgttttgtgcgtcaatgaataaatacataaatatggacttgaccagcagttcaacaaaatgattgacaattgcataaacaaacactcgaacaatttctgatgcaataaaattgatttgagcattaattgcgatcgtttcgaaggacatttgggtaatcggcggagaattgaacaacaaaaagtgacaaggaaggcaaaatagcattaggaaggattctctgatttgaagacagttaaaacgactcggccattgcgaagtgaatgagttcagggcactcaattgggctaattagccccgattgtttttgcttaattactcctccatccatcgaaatttttctgtttaatcgctgtcccattcgtcctcatctgctgatgattcccgctgttcttgcttttcatctccgctcctcctttgctgctgatgttttgggggttcggggggaggtgccgtcggacgaaacgttttttggcccatttttgcctgaggggccaatggtggtggcggtttcggccgatgcagcgaagagcagaatcttgaagaa

SEQ ID NO: 40659 - DNA, 1172 bp, Heterodera glycines
  misc_feature (96)..(96): n is a, c, g, or t
  misc_feature (194)..(194): n is a, c, g, or t
aagtgtccagaaaattaattttctgggagcccgccataaatggtgattttggttgcaaattattttaatgtttaaaattttgcgattaattttttntaatttgtcaattaatttaaataaagaaattgcaaaaaaaaacaattatagaatttatcaaatatttattcaaaatggaaaacactcacgcaaggaantgggaagaatttataggaaaaattaaacaaaagcttggcgtgactgaaagaacaattgaaaaatgggccaagaaaattaccaacatcaaaatatttcaaaagttatcttaatatttataacattttttaataattaaatttcagagcagaaggtttacacaattgtcgaaaaatggaactgaataagtaatattatcagctgaagaatgaaaataaaaatctcatcgaccggaaaattgctgaagagtagagtgcagcgggaccgggacctaaacacggacaactgagtacaactgagtaccaaggtcccggttttgaccagttttgaccgggaccgggatgttcccggcttttttcccggttttcccagccaaaaattcccgggttttcaacccgaaaaggtcccggtcccggttaagcccaaaattcccggtcccgctgcactctactgaaagtgaacattcaaccaaggtcattaagaaaatgcaaatcggaatttaaagaaatgcatatttcatttgaatacgatcaatggcaaaaaaatgccaatttgtcgtgatgaaagaaattgcaacgaaaaaatataacaaaaattcaaattttaaatatgaataatcataattcccttttttagattgctttctttaattaatgaaaaatctatttgggttttttcaccaactaaactaatcacgccctttcaaccttttagcacccttttgtagctgtttaatttgtcaataaatttggtagaaataaaataaaataaaatcaaataaatcatgaaacgaatcagtcagaaggtgggcataaaggcaatgaaatgcataaaatctgatcaaattcatttacattcggtggaatctttgatcagatgccatcagatgagaacaattgttttatttgtgataataaatatttaaaacccccttaattattgttagctcatattaattactccccaattcgttgagaaaa

SEQ ID NO: 40660 - DNA, 936 bp, Heterodera glycines
  misc_feature (830)..(830): n is a, c, g, or t
tgatttgctccactaattcctactaatacagacaacagaattttattattttgttgtttttgcatttacaacacgaattgtttcatccacaatatttattcactgctatttcagtctttaaaaggcatagcaaattgcatcatagtgataaaccaacacacgttaaaactaaatcttggcgtcaaattttaattcgaaataattcatttcatttgattcttttaaaaatcgcctctatcggtttatgcaataatcgataaatcgcaatttatattctagagaaattacaataaaactacctaaaaaacatgccatcattattaaaatatggttatttttttaaacaccgtgctcattaagtccatgctgaatatgtttttgattaaaaatatgttttaacagcaagctccatttccggggaaaaataaaataaaagaaagaacggatttgaatttttattctattttagaaatttaagcattattcgctgccaccaatgctatgttgtgatttgctccactaattcctactaatacagacaatagaattttattattttgttgtttttgcatttacaacacgaattgtttcatccacaatatttattcactgctatttcagtctttaaaaggcatagcaaattgcatcatagtgataaaccaacacacgttaaaactaaatcttggcgtcaaattttaattcgaaataattcatttcatttgattcttttaaaaatcgcctctatcggtttatgcaataatcgataaatcgcaatttatattctagagaaattacaataaaactacctaaaaacatgccatcattattanaatatggttatttttttaacaccgtgctcattaagtcatgctgaatatgtttttgattaaaatatgttttaacagcaagctccatttccgggggaaaataaaataa

SEQ ID NO: 40661 - DNA, 1006 bp, Heterodera glycines
taattttatttactttaccatttttatctatattttgctattttacaaagaatgacacagctaagaaatacatattttgatagatattccatcaaaaccgaaatcacaatttaaaattttatttccagaatcaaatgctaatatgaacttttcaacaattgtttaagatgccctaaaaattttataggaacaatagcaatttaaagtgttcttcatttttgggaagccaatgatgcatgtacacttctaacatactgtatccggtctgccccatatacattgtattggaaagtccaactggtaaattggcgtttctttccgagagggcgcttacgcgtaaaaacacgaagctgtggtaggccggcatggcagtgattggcccaacttcgtcttggatgatttttgccaaggtgccaagctcatccgctttttggttttccctgaagaaataatacatttttttcaaattatcaagacctgataatttcgacaatttttttttggttcatggaaaaccaatgtgccgcttgttgcgcccgttcgttgctctcaagttggtaacgcatcatgaaaaagttaattccatggtaaagaggcactcggtagcaacagaattctgggcacccgtaccaaatgttttccattcgatctacgtcccgcgtaaccaatacattgtaaattacactgaaatttttaaagaactatcaaccaaaaaaaaatttttttacaaagattaaaacgataaaaagagctaaaaataatataaaaatgttgatcaattaactaattcgaaatacatcgaaagcgcatgcaaaaaggccaggaaacccgaaattaaaacaacaaaccccagattaaaagactaaaaacccggatcatttactcagtaaataagcccatcttattgcttaattattacttcggcggaccacgagaagatatgtctgagttgattaaatgtgcagtccggttatatgtataaggatctgtgatttgatcgatgccc

SEQ ID NO: 40662 - DNA, 1014 bp, Heterodera glycines
cgaaatcctacgacaactctgaaagacataaatttggagcttttagaagactcaaagtaatcaaagcaaaaccctcttcagacactgaccaagaggatgaatcaaatgatgatgaagaagaaaacgaagacgaagaaattgaagaagaagatgaagaagaaaaagaatacgacagtgatcaggaagacgattcaccggaattgacctcaaatgaccaaacaaaccgtaaacaaacaccctttgtcaattatcgatcgagaataaaacttccaccccaaactctaacacacttctcaggaaaattctcccaatggcccagcttttgggacgatttcaaatcctcagtccacaatgacccaaacttagagaacatacaaaaactgaaatacttgcgaggacttttacatgacgaaccataccgaattgtgtccccttaccccctcacaaacaaaaattatcccataatcgtcaaattactcaaatcccgatacggtaatccacaattgatcagagaaaatctgcacagcgaattaagaaatttaagaaaaccaaatgaatccacaagcgaactgagacgatttatcctattcattgaccgaattatcctacaattacaatcccaaggcgaagaaataaaccatccccaaatcaagcaatccattgagactaaactccccttcaatatccgactaaaactgagagaaaaattcaaactttactcgacaaaagaattaatgaattttctcaattcacacactcaagctcgtgaagacatagaacgaatggaagattcaaacagacaaataagaaatttcacccctcaccggccacctcaaaacagaccacaaaggcaatcatacccaaactattcccaaccccagctaaaagcaaaccaccgaaaaccatcaaaatctgcctctctcgccctatcccatcacttctgcattaacaccaaatcaaacctgtccgtttgcagaatttaaccaaaacatcgcaaccccaacacaaacaaaa

SEQ ID NO: 40663 - DNA, 1240 bp, Heterodera glycines
atacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctctgactttg

SEQ ID NO: 40664 - DNA, 1227 bp, Heterodera glycines
ttggatatgctgcgcttcaacaaattaggcattggctctgattgggtgtcggagtacggcgacccggacaatgccacatacttttcgtacatttacaagtgcaaaaagcaatcattgggattttgacaatacgtgttgtcctgcccctctctctcttcaggtattcgccgcttcagcagctcagcgtcactcccgggaagcagtggccggcgactcttttgctctcggctgaccatgacgtgggtttgcccatgctttaatggcatggactcgggaatatttacgtgagattgttttcaccgggatttgagaccgagaaatcgaaccgagagcccaattccgagaagttctcgactcaaaagccgagagactctcataaccctcactattctgctgcttttttcaggatcttgttgatgtgtctcacacactcaaatatacggcacaactgtatcatttgttgttcaccaatgctgagagttggcagcgcaaccccgtggtggcaaagattttggtggaccaagggcacgcgttcaccggcacaccgaccgagaaaaaagtgaagcaccaattgcactaacaaaagccccattttgacattattatctttttcagatcaaagagaaggttgacatttacactttcatcgcgcgagcgcttgggctgaaatggaccgaatgattaagaacaaatccatctgtgtgatcactgatcagatcattatcgatgcaatatttttaggattttcttttcataaatttgcattccataaaattttgggacaactattcaaaagggaaaattccaataaattcaaggacagttaaaaaaattttatcatatgcgatgaaaaacaattaaattttatccaaattttttatatttttcgccggaatgaatttttaccaataattttttatttctgttggtcattcatttcaccgcatatgcacttttttgcgccgagctttttccaattttggagcaatggcgacgatctttttttttacttttaactccaccctttgtggcctttttctgaaaaactttttgggaatatgggggaggagatccggcgatgccgataggcgccagcgggaaaaattataaatttgaagaatttgttaacagattttgtccaaaattgatcaatttttaacgccttttgggtgtgtttttgaacaatattttaaaaaatagaaagagaggttccggcggtactgatag

SEQ ID NO: 40665 - DNA, 954 bp, Heterodera glycines
  misc_feature (51)..(51): n is a, c, g, or t
gagtataatgtgtaaaatatagccgtaagccgatgtcaaaaaccgaaatcngaattacaaatttcagaaaaatctcggtaatcggcatgccaaccccccaaataataccgggaattagaagatgtgacaatattattagtgttttttataatgagaccgctaattggttcgggagcccgaaaaattgctcaagcgagaataaaagaaacactctcgcaaattttcaaaggtaattagcatgccaacccccaataatatcgggaaccgaaattcaggaattcgaagatggactaattattactaacattttataatgagaccgctaattactccgtgagcccgaaaatttatcaagtcatgaataaaagaaacactctcgcaaattttcaaaggtaattagcatgccaacccccaataatatcgggaaccgaaattcgggaattcgaagatggactaattattactaacattttataatgagaccgctaattactccgtgagcccgaaaatttatcaagtcatgaataaaagaaacactctcgcaaattttcaaaggtaattagcatgccaacccccaataatatcgggaaccgaaattcgggaattcgaagatggactaattattactaacattttataatgagaccgctaattactccgggagcccgaaaatttatcacgtcatgaataaaagaaacactctcgcaataaatctctaaagtgtttgttataagcaaatgaaatgcataaaatggaaaggaaagagattttttgggagagagaaattcattatgggcggcaccttggatattattcaatcagcacttccatttttctagaatttatccttgaatgaatgaatgatgtaaagatagggaaaacaattggttttagtggggagggggaggggtggagaaattcactcattcctcgccaacaaacaaattccttaat

SEQ ID NO: 40666 - DNA, 676 bp, Heterodera glycines
tggattttaatcaaaatttcaaagtccgtttctgatgaatccgtttaataatcggcaataatcagctccaacaaactacaagtaaacaaggaaaataaactgaaatatttgttattagaccaaaacataatgtacggtggattttaatcaaaatttcaaagtccgtttctgacggcaataatcagctccaacaaactacaagtaaacaaggaaaataaactgaaatatttgttattagaccaaaacataatctacggtggattttaatcaaaatttcaaagtccgtttctgatgaatccgtttaataatcggcaataatcagctccaacaaactacaagtaaacaaggaaaataaactgaaatatttgttattagaccaaaacataatctacggtggattttaatcaaaatttcaaagtccgtttctgatgaatccgtttaataatcggcaataatcagctccaacaaactacaagtaaacaaggaaaataaactgaaatatttgttattagaccaaaacataatctacggtggattttaatcaaaatttcaaagtccgtttctgatgaatccgtttaataatcggcaataatcagctccaacaaactacaagtaaacaaggaaaataaactgaaatgtttgttattagacctaaaacataatctacggtggattt

SEQ ID NO: 40667 - DNA, 717 bp, Heterodera glycines
gttatgagaaactgcagtagcaattcccatttactaatctttttgtaatacagtacgaacagaaatatacagtaagccactgttaataaatcaaatttattgcaaaaaatgaaaagcaaagtacaaaaatatattgtattttggtgagataattgctaatttgaggggagggaggagaagaaacattcgttttgtgctcactctcctcctgcttcacactgcttttacatatgaaataaattggatgaattaattacccgtctaattggcattaaattttgggtttgttatccgtctgagcttttcctcttcatttgtttccttattcaccggcggcaggcactgtctgatcgattagcacccgttcattgtcactcattggcacctccgttcgatcagtgccaacagtcctcccctttagccccacttttcattgtgaaatgctttatgtcgtcactgatcagctcatcactgtcatcttcttcgtcgtctccgatatcaatccgttgttgttgttgctgatcagctgcggttgttctcctgctactgctgatcaggctgcttctgcttcttctgttggtcacttcccctctgccggtgccgtcgctctccggcaccattgtcaggggtgacgtctagccaaacgacgtgccaaagatggaaaagatggacgaaactactcattgcttgatgctgtccgccactgttgctgaccgg

SEQ ID NO: 40668 - DNA, 462 bp, Heterodera glycines
aaatttgttttaaataaaaaaaaggtcattttttatacaaaattttttaccaagttgtactcaaactttcaaaaatttccccggcggcgcctatcggcaccgccggacctctccccctcccctatgttctcaaaaattttttgaaaaaatacatcgcaaaaaaggcgtaatattctcttcccaaaaatattctaaaaaatgtaaaaatgacatgaaaaaagttttgttgaaaatcattgaataattttttcaagaaaatattcaaatataccaaaaacattttttgaaatcaccttttacttggttaagaattaaaaaatttagtctagtaaaaatatttagaaaatttttattatattttttgaagaatttccgaattccgacgtttttggggtcggaattccgatttccgaaattttttggggcttcggaatgccatccctggtttacaacactgggaac

SEQ ID NO: 40669 - DNA, 1127 bp, Heterodera glycines
cccccattttaccatatttttgaaaagttgatgcaaaaatggcaaaaaatagtaaatttttggcgaaacattttgcaaaatacacccccctaattcgggatttcaaaaaagcaaaaatacacccctagaaatcgaatttttgacttcagcccccccccccgaagccaagggtctggctacgcccttgattagggtacgacgctttaactctttaatttagtcatttaaaaattgtttaattttttttggccatgaatctcgcatcattaatacatacagattcaatgtttgtacataaagaacaacgaatgtttgaataaattattgtcgctgatcgcgaatttgacatcaaaatgcttttttttttgatttaacaaatttggtaggtacgcttttgtaatttttaaaatttgaattcacggagttttcacttatcactagggatgcgacttttagtgacgaaaaatcccaaaatagttaactaaaatagtgagtaaaaatcccaaaatagtgacaaaatagtgtcaaaaagtccgaaatagtgacgaatagtgacataattttcagccaaaaattgagcaaaaataatttttattcactgattgcagttgcaaatgaggtacatttccaaattttgaggcaagaaacgcatccggttatcgcataaaattgttttgtaaatagagaaagtccgctcaacatcgcaagaagtcagaggcgcgaatttgtagaatggaattacggtggggcaaacatcacaatcaacattttttccggaaagaatttggcaaaatttggcaatttgatcaaacgagggattttttgagacaatgaaagagattttttggcggattatttctgctttctcgccggctgctttgtccaattggttgtgaacgtccgcaaaaatttccatcgattcgtttatcgacagtccatgtgcctccaattttgcaatgacagggcacaaatttcccaaagttggtgtgaatgtacgcgaggtcttgccatgttgacaaagtgaagcaccactgactttctcttatgcatgatgcatcagttgggtccaacgagttgaccaccctaaatgcgtaatcctaaaaaagcttaatcttttccatacttcc

SEQ ID NO: 40670 - DNA, 1572 bp, Heterodera glycines
  misc_feature (27)..(27): n is a, c, g, or t
cagattccagtgggttcatgtgccaancagattccttgtgcccggggggttgttcaagctgtatttttactgggacacttattggatactcaaaggcttttcagcattaaaattcattttaattggtttttttaggcctttacttttcaaatttggtcgaaaccgctcgcggaatgcttgagaatttcgcgcatttgctccgtttccgcgggttcatccccaactcgggcaacgttcagtaagcattggcacttttcgccctttttgatgcttttcgcttttccttccaaagactttcgcggcgaagtcagccgccgttgttcacgcaaatgatcgccgattattatgaggtgacgaagaacaaatcttttttggccgagtatttgccaatggcggagaatgaattggcttggtgggaggccaacagaacggtggaagtgcagcggaacggggaaaagcattcgcttttccgatacaatgtgaaaacggaagacaaacggacaaaagctgaccaaagtgcggcatttaaggccatcaccgattgcccacggcccgagaatttcctggaggattaccaattgggcatggagtccgacgacgcgactttcttctggtgagctaacaatgtgagaaggcatttgcaaaagcgcaaaaggtcttccacggcgagtgcgtgcgagtcgggcctcgacttcagctcgcgttggtacaaatggggcaccgaatcgaaagcaatgcgaaggactgccatcgccaccagcgaagtgctgcccgtcgacttgaacgtgttcatggcactgaactaccaaactttggccaaactgtacgacgaggaactgaaggagcacgggtagaaagaacggcacggcactttgggacaaagtgaacgatttaatcacagaaaggcacggaaaaacaaagagattgccgaagcaattacggcacacattgacagaacattttgggacgacgaagagggcgtttggttcgattttgacctgacggagaaaaaactgaggaaaaagttttatccgagcaatatttatccaatgttattgaagaacgacggaaaagggacgggggaaaagtgccaaaaagtggtggaatatttgaagaggagcggagcaattggattcaaaggtaaagcggcgggggatgagcagcgattggaccaattcatacgggacagacaaagggtcaaaggatcagaagagtcgtcaaaatgaataaattgaaataggcccctttaaattgaccctttgctcttgcgtaagtcatttgctctcttcccaaggcggagtgccatcgtcgttggaacggaactccaacgagcagtgggactttccgaacggatgggctccacaacaacatttggtggttctgagtctgctcaagtgccaaaatgtgtcgggcgaagctgccggaattgctcgaaaaattgccgaagcatttctcacaacgacttacaacggattattcactcgaaaagaggcgaaagtacgcttaactaaagaataagccagcagagtcggctccattattttctaaattaaataagccatgttaagccct

SEQ ID NO: 40671 - DNA, 1620 bp, Heterodera glycines
tcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcataaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaggcgggggggggggggggggcgcccaaaaaaaattttacaatgaaaaaagagaatttggaatgatgagaaacaaaaattattcagtgaagaaaaaagaataatgttaaagcaatttgatcaaatatatgcaaaattaaaaatgaaattaaatggaaaattggaaggaaaaaagaaaaaatgccaaaaaataatagcaaaacatttgggcacaaatatcagaaacatttattattggaagaaacaattaaaaagtggaaaattggtgcaaaatcaaaaaaatgatgagcaaaaaagagaaattgttgaaaaatattttaaaataaaaattaaatttatgcaaaatagaaaacattcacgaaaagaatgggaagaatttagagcaaaaattaaacaaatgtttggaatttattatagaacaattgaaaaatgggccaagaaaattggcgtttttgaaaatgtttcaaaaagtgaattaaaaaaaataattaaaaaaaaattttttctatttacagagcgaaaaatattaacaattggtgaaaaaatggaattggcaacgcaatattatcaaatcaaaaaagaaaacccaaaaatcaaagaatacgaaattgcaaaaatatttaacattccaaaaaactcattacgcaaatacaaagccaaatttggcattaaacccaaaaacaaattgcactaatggaagaacattattatcaaaagaatttttagtggcaaatttcactgaaaagatgaaaaaaaaacctaaaataaatttttaaattatttataaaagtttttttgagaatttttttttcgatattgaatttgtgataaaaattgacattttaatcatttaaagccttgctaatatttttaattaaaattgaaacaacttaattaaacattgattgacttatttatactatgttcattaaacaattaaatatgagttgataaagaaatattaataaaaaattaattcgtaaaataaaatttat

SEQ ID NO: 40672 - DNA, 1128 bp, Heterodera glycines
ttaaattcttagaaaaaaagttctggttttactgtattttatggctttgtttactgtaatttgacatttttttttcttctcaggaccccgatttttggtcaaaatgggcgaagaaggcgaacattgacgtgaactcgttgaacgatgagttctccaccaaacatttgattgtgcatgagccgcgggcgcgtaagaagcgatttgaagcggacaatttcaaagggaattccgaaagtggtgacgacggaggttcggatgaaggtgagtgattggtggtttaattgaaaatttaattaaattatttatttaattgtgtctgagactttaatttatgcttaaaaaagtactggcaattcaaggctacggtaacactatcgaatgtgggcccgccctctttacaaaaaattatttttcattttttaagacaaagctcttttatggggttttcggggtcaaaagattcaattctagcatccatttcgactcattcgaaccccgaacctggactcgaacaaaagttgcgatttcaattttcagtaaaattcacatttaggtaccgaaaaaaatgccaaatttcgtgcaattttttcagcctgaaatttcgaagctatctaacgcgccatactagtatttaataataataattttaaaaaagctaaaaacaattagagtgagtgaataattgatttttggtacaaatgtgaattttgttaaaaatgaatttgcaactttttgttaagggcctcatttttcaaatatttaactgattgttgtgagtgatcaaacaaaactcattcgtcacatattcctaacaaactacagctgatgaccgatcgcaaagcacgcccgggcccggcacatccaaaattgcggaaggcgtcaaaaaccgaagttcaaaacgtagtcgacgacgtgtcggcggtgggccccatggcggtgccggtgaagacgatgaggactacccatacaagccggacgaacttgccttcaacaaaacgtcatactttaaagtcagtgccggacggacacgattttttgaatcacgagaaaaattgcatctcttaactccgaagttttttggaaaatgattttttaaattttttgtatcacttatttttttattttttg

SEQ ID NO: 40673 - DNA, 1343 bp, Heterodera glycines
  misc_feature (1307)..(1307): n is a, c, g, or t
attatttataacatttataaaaataaacgggatttctcgatcaggttcagggattttctcattagctagaaaataaagaaatcccactaccaaattttcaaattcattaaaaagaaaactaataagttgagatgagaattaaattaaaaatgaaagttttttgacgcgaacacatttttggcgtcatatatatttttttttaatggcaaaactttgttattttttggtgtgaatctgttagagaccggacgggcccggggcccggcccgagcccgggcccggtcattttgaccgggctaaaacgggcttaaatttcaccagcgaaactgcccaaaatttgaaaaatttaataacatttggcgaaatgtctttaattcaaaatttcaagatatgactttagatttttgaaaatttgtagaatttaattcaacatacctagattttgtaaaacctcgaaaattctttatggcccgaacctttatttcccaaagaatttagaaaatttaatcaataaaattttttagaaatgaatgcatcaatctggaaataggtctatttgaaaaatcaaaggatggcaaaatggcggagtgccgagaatgtaaagaaaatggaaagtccaaatatgaatttagcctgtttatgattatcgacgttcgagattaaagccgaaaaccgcagaaatgttgatatttttgaacaaggccatcccaatgttggactacaaatactgatttaattttgttggatgataaaaagttcataaaattttccataaaattttggtttagaataaagaaaagaaattacgcaatttttttatatttataaatgcatttttaaaatttgaaaaaagcccgggcccggcgggcgcccggcaaaaattttggaccgggcccgggacgcccgttaaaacgggctttttttgaccgggcggcccgggcccggccaattgtcgaagcccgagcccgggcccggtcccggcattttcaaaattccggtctctagaatctgttaacaaatcacacacaaattttcaaaacttttttgaaaaaatgcgccgtaaaaaagggttttgaaaagcagaagaggccaatttataggcttgatataattctaagctaaaataaaaaattaaacttgaaaacttttcgctttttgtaaggctaatagaacatgagaagagctttcgaatgttaccaccaatgttcggatttggattacaaagaagatagctatagtggaaaagcatggtggggcccaagcgtgaggggccagctgacgggttccgccctaaatttttttttcgntgatcaaaaatttttgattttttaaattcataattt

SEQ ID NO: 40674 - DNA, 1136 bp, Heterodera glycines
tcttttcactattcaaaaaattaatatacgttagcagaattgtaaaaaaaaattctttcttttagctaaatgtgcatccgtacagcgatgcaaacgggcgctgttcgcgcttattgcttaaccttctgtttttgaaaaaatcggtggcttccatatatcctctaatatataaaatgaacaaaaattttagatgcctacagttgtcattccagacaatgattggttccgatatcaagaagcgatcaaaaaattcacaattaagtcggatgacaatcctgagttgacgagcgaacccgcaattcaattcattgagaaattactccaaggtgcaccgggcgatgaaaaaaagtaaagagacgagcgttatatttaaaatgaaaaaaattacatactaaaagttagttgggcgagaactggattcccatgggaaacccggaatccctttcctttttttgccggtactgttaaaaatttggtacctccttattttaaaatattcaatcccgaaaattcgatttattaatattttacgatcaataaaagcaattttaatcattatttacataggtgaagtcgttccagctgtggtcactgttttatgaggcggcggaaaggggcaaaaatgttcggcggacccaccgacccatcatcaaacacactaattgatcggtcaattaaatttttcccattttttatgcatccatccattttcttcttccgttgtctcttcccggccaattatttttcacttcctttctctccctccctgcgtcatccatcggtcactctctctcctcgcaattttttattttttgatcatatatttgtgcccaattatttttcacttcctttctctccctccctgcgtcatccatcggtcactctctctcctcgcaattttttattttttgatcatatatttgtgcccaattatttttcacttcctttctctccctccctgcgtcatccatcggtcactatctctcctcgcaacggtccaaagcaatggcataggtgaattttgacaaaagtacttacaacggcatttaaaacttggagcatcttctcgaacagtgccacttcctgcttgtgccgtccgaacgtgtcgacaacaatcatttcgaagccgtcatttt

SEQ ID NO: 40675 - DNA, 1455 bp, Heterodera glycines
ttcatttcttccgctgattctcaagctaagcaattgacagattttgcagttcgaattcgacgttccatcccttataacggctcattggacggtaaattccttagtcttttcgtcttttccctctgtatgggcagctataggaaagctgttttgaaatggattgttcatttgtctgtggattttgtgtccagacatttgcgcctctgtcaaaaatctgggaaaacttacagtttttcattcttagaagtcttaaacagcattaatttaaaaacaaatctccgaggcgcaaatgtggggtaaccgtggattttgacctcatgctcagaaacaattcttcgaagtttaagactttgtcaaattgacaaaaggggctgatttaattttaattgcattaccccaacaaaatttcggccaattggtccttttgtcatcgtttcgcttcccgtgccattccctccccacccccactttttttgttgccttttctcgctgtgtttggtgtttcgacttttgcctctctttctgtccaattgattcggtcccctttttctgttcattttgctttttgtgaatgtttcgttcgcttttggtaatggtggaaataaactgaaaacaacaagtggttaattaattaattaattaattaattaattaggcttttgtccgcgttgcttcaaagaatgtgcgttttagacaagcagaaaattttggccggtgtctctgacggcgacggagccgtggcgcaacacgcgccggacattacgctgggggaaggggcgaagcctttgctggacgaggagggggaggaaagtgagtggaattggcattgggccaatcggatgtttggcattccgtcaataagcattccaattattacgataaattgaccaattcgtcgttcgttttgattaattcccccccccctttttttaattttcccttttttattgtttttcatttgttgtgctttcattgtgtcctttcgcttattggatagtaagtaccaaaaccctaaaaaaagaacactttcagacatcaaacttgacggttacaatggcgcaatccctccggggtcggcaggaagggccaaagacgacttggaagttcagccggccaagaaggaacggtcggtgcttcaagccaagctgactcggcttgccattcagattggttatgccggtgtgtgaggggggggggggggcgacggaccggcgaaagtgtcccatttgaggctcttttgttgctgcttgtacggtgcttattttgggaattcgcttttgcatccaacactacctaatcgaccaaaaaccattcgttgtcgccgactttcgctatttcgtcaactttctgatcatcggcgtcactgttctcgtcgtggcagtgccggagggattgccattggctgtcaccctttccttggcctattctgtgaaagaaatgatgaaggacaataac

SEQ ID NO: 40676 - DNA, 842 bp, Heterodera glycines
tgtttatccttcgctgtacgctcgaggaggccttcgatcgtttgctgaagcaaaacggaacgatttcaccgaattttcactttatggaggtgccaaaggtcgtctcggtgccagcaaattttgttctatttcaggctttgacttgctgggagcgcgagttgttcgcttgcaacttctcccattctccgctgggcattgaaatttcccccgagggaatgtccaaagttggcaatggcatccacgccaacagcggcgcttttctccacccccacaacctcaacagcgacggcggtgccgtgcccggcaaatcggccctttctgtccccactgcattcaattctcccgttgtgacgacggcaatacctttctaaacggcctttacaaatgaatcctttgaattggtcacttcccccccccccctcccccaattttccccaaatttcgtccatcctgccaattgattgcgattgtcaatgaatctttaattcctattaactttcccttattttattgcatttctcaattttgttttgagcataacgcagttcttaccgtcttttttgtcgcatggccttttttatttcttcaatttttaataaattggtatatgctttctttgtgactaaagtaaaaatggcacaattacaattaattaagaaaaaaaaattgttagtctttttcagcttcgacagtttcaattttacaaacctcagcaggagagagaaaagccaaatagagagaaaaagcaaaagggaaaaagagagagtctgagaaaaagagaaggggtgatagagagagagagagaggggaaatagaaacgggagaagagagcaaaagagagg

SEQ ID NO: 40677 - DNA, 1052 bp, Heterodera glycines
aacggacacttgaaaaaatcgatttttttgttttctcttgcagtccccccaaccgatgcgcccagatttatggggagaccgaatccttccggaatagcttccctatagtctgtactttaattctgcgttggatttttgctccccataattgtttgagtacaccaaacggacacttgaaaaaatcgatttttttgttttcggggcagtccccccgaaccgatgcgcccagatttatggggagaccgaattcttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaattcttcgggaatagcttccctatagtctgtactttaattcagcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaataaatcgatttttttatttcataaatattttttcagaaagtgctctaaagcgcaccaaattttatttacaacttaattttagcactctgatgctttagtatcaaaaaggaagatggagaaaaatttttttttaaatagttcctttatattttggttatatcgttttgctttcctagtgtaggtaggaacgagtggaatcatgcgcacccgtccgatct

SEQ ID NO: 40678 - DNA, 1006 bp, Heterodera glycines
  misc_feature (54)..(54): n is a, c, g, or t
  misc_feature (84)..(84): n is a, c, g, or t
cattagtgtttgttatttgagtttagtgtgacacaattatgtgtgtcatgtctntgataaacattagtgtttgttatttgagtntagtgcgacacaattatgtgtgtcatgtctttgataaacattagtgttcgttatttgagtttagtgtgacacaattatgtgtgtcatgtctttgataaaacattagtgttcgttatttgagtttagtgtgacacaattatgtgtgtcatgtttttgataaaacattagtgtttgttctatgactttagtgcgacacaattatgtgtgtcatgtctttgataaacattagtgttcgttatttgagtttagtgtgacacaattatgtgtgtcatgtctttgataaaacattagtgttcgttatttgagtttagtgtgagacactattgtgtgtcatgcttttgaaaaacattagtggtttgttctgtgactttagtgtgagacactattgtgtgtcatgcttttgaaaaacattagtgtttgttctatgactttagtgcgacacaattatgtgtgtcatgtctttgataaaacattagtgttcgttatttgagtttagtgtgacacaattatgtgtgtcatgtttttgataaaacattagtgtttgttatttgagtttagtgtgacacaattatgtgtgtcatgtctttgataaacattagtgtttgttatttgagtttagtgcgacacaattatgtgtgtcatgtctttgataaacattagtgttcgttatttgagtttagtgtgacacaattatgtgtgtcatgtctttgataaaacattagtgttcgttatttgagtttagtgtgacacaattatgtgtgtcatgtttttgataaaaccattagtgtttgttctatgactttagtgcgacacaattatgtgtgtcatgtctttgataaacattagtgttcgttatttgagtttagtgtgacacaattatgtgtgacatgtctttgataaacattagtgtttgttatttgag

SEQ ID NO: 40679 - DNA, 1179 bp, Heterodera glycines
  misc_feature (1096)..(1096): n is a, c, g, or t
accattgatgtccttatttttgagataattatgatctaacgtcctttaaaccatttaaatcaaaaatataaaaaatgaaaatggaataatttttatttaattttttaaaattaagattgcggtttacttgttccaaacagacagctcgctgttcatccaaattgttggacattacattctgctgaatgatgcgcgtgcacttgtgatgccagcctggtttctgctctgggcctccggtgaaatgcgaaaaattgttggcaaattgattttttgtgccaaaaatgatccaaataatgccgtcggcagtgttggcgtcgcaacaatggtggtggcttacagcaatggcggcaaacccaaatggcaccagcaacagcagcgaattgtgccggcctaaaatgctgccacgtattaatgatgaattgggaccagcttttttgttttattgggaacagctcatttgtgatggttgggaacagctcatttgtgatggttggaaactgagtgtgatgaattgggtccagctttttgtggtgaattgggacctgtgggaccaaatttatgatgtgggttcagttttttatgatgaaatggtaacaatccattgtgataaattgtgaccagatttgtatgaatatttccgtagttttcatgttagccaggtccctaaccagaaataacttcataccgagtaaaacgggttagaatttttttaaatatctcatcgcaaaccaatatttatccaatgctgacttctgttttccaaaattgggcgagaacaaatgccaccaggaaaattatgaaaattttggttaatttgttaacagaattattggaaattaccgaaatatttaaccatttttctttaaaaaaaattctgcccgctccccgctcctggttacggttctgatagccagcccatttcgggtaattaaccatttttagttttgttcgaagcttttattataaccaagttttatttcaaataaatttttattacaaatgaaaatttttaggaagttttttcaaggaatttctgacactagggagggtaagggagctacttttttcaacaatttgtatgttcacaatattttanaaattaatcaagtttttatatgtataaacaaacaaattattttcaatttttcggttgttttttttcgttttatggaaatatga

SEQ ID NO: 40680 - DNA, 864 bp, Heterodera glycines
attatagatatgataaaagaaacaaacttaatttattctatctcgatcccattccaattagataaataaatttttaattcataaagctaacccattagatcttcggcactatgcttctcggtgttgttcggcacctccttagcgctcttcgatgccgatgggtcgacagcttcaacatgaccgatgtttgcagcgttgtttggcacagcggcagcgatgtcggtctctttctccaccattttcatttatttttcactttttttttactcaaataaacttttaaatcacaccaaaaaataaatatcactggagctaaaatagaacaaattaattttggctttacttgttactatacagacaaatcttaaaatatgaaccgaaataggtagatgactgtagatgcgttttcatcgcttctcgttttttttgtaggtacatacctaggtatatgtaataaaaacaaagtccacaaaattggcaaaaaaaaagactttaagtaacgacaaaaaacgacatacaaaagtgaaaggatttaaaaggacaagagaaaagtaaaaagagaggaaaagaaaaggaaaaaggcacgtgaaatttagtgacaaaattgagagaaaagaaaaggaaaagaaatggatgggatggaatggaatgagaataggaaggaaaactgtgtactcaactcagtctcaatgtacaggaaaaattccttcgaaattgcctaatgaattcaaaaaatttgctttcccaaataaaaaaatgcaattttaaaaacctaaatttttatattttgtttttcttacacttttcctgttttccttttctagaccttcttcttcttcttcatgtatgtggaacggcaattcg

SEQ ID NO: 40681 - DNA, 1200 bp, Heterodera glycines
ataattagggctgccaaaaatatgcacgaaaagtggccaaaatatgcgcataaatatgcaaataaagtctgaaatatgcaccaaatatgcacaaaaatcgcaaaatatgcacaaaaaaacttgaaaattaggggtgcaaatccaataaaaaatttttattcctcataaattttatcggtttttttttgcaattgaaaatcaataatttctcaagattttcggcactaaagctcatcctattgtctgccaaaatttacttaagggatattcaaaacggaaaatattttacgaaaaatggcaaaatatgcaaaaaatcggaaaatatgcacaaaaaatggcaaaatatgcatgaaaatgtaaaacaagcaaaaatatgcataaaggcccaaaatatgcaaatttaaaagtcccgatttttatacgcaaacacaaaaaagaaagtgtttttcgtactatttagagcatggagaagccaggaaaaaaatatgcatttgcatacttttggcagccctagtcataataaattatgtttaatcataattattatgcttttgatataatcggttttgttaaggtcaagtcctaaagcgatttggacacttcagtcccgagtctgtaactctgttcagaattgtcgccgcgccctaaaaatagtaccattcgactcccctcactgaaaggaatctattgatatatataattcatatgcgaaaaaaaattcgcagtattctttttaccttgttttagcgttttagatacaatttaaaaacaacttctaagtcttttgttatcaaattctaaaactttggatatctgaaccagcgaattaaataattgaacgagtaaaaaaataagagtgtgaaaaaattctgctttttctttgcgatttatttataaaactcacctttttccaattgaggacacgtttaaacaaaaggcagtggaacagtcgacatgacgaaatcgcatccggaacggcattttcagcagggacaaaaggcataagttcgaacaaaagttcgggcggaaggcacttgagggtcattagtaagcaaaatagaacgcagcaacagaggacaatttggtgtttaggattaattagcaatgagtaattagcatggaaagccgcagcagacactggagaatgtttttggtctactgcggcttggaatttgttgtgtttggctcgttaaagcagag

SEQ ID NO: 40682 - DNA, 1067 bp, Heterodera glycines
cggggttcgacataggtcgaaattgatgccggattcggattctcctaccctttaaacccctaatacaatcttttctcgaaaaaaatttcaaaaatttgattttttgaaaaagggggactaccatcgttactatggctataaacttgcaattaggcattggaattgaccgtctctttggcgttgtgtttccgatatggtaataattaagttcggaaaaatatggatataaaatcgcaaaattttttattttttgctttttttaagaaattttaaattcaatcagtattttcgacaaaattttgctaaaaaatgtctttttcggaatttttctgtctttaggggccaaaaggccaatttacctgatgggagccgttctaatagggggttttttggaaaaatgccaaaactggacgtaaaatatggacttaaatgccaaaatattagagtccggtaaaaaaaaatttccgggagcgggagcgggatcgggagttcaaaattttccgggacgggagtcccgaacgggattcccgtaaaaatcccgctcccgttaaaatcccgtccatttttaacgggagtcccgggcgggagcgggagtaattcgaaaatttaattaaaaactcacaaaaatatttttaatgcacaaatttaaaggacaatcaatttattaaattgaaaatatatagaaaaatttataaaggagaaatttgaaataaaaaaatcttatttttgagtcaaaaatcagaaaattttttcaaattgcttaaataaattattttttataattaattcgaacaaaacatttattaactttatatttttgactccctttattaattttacaaaattttttgcggtgtatttcttgaaaaaactttttggtgaccaaggaggaggagggaggccggcggtgccggtaggcgccgccgggtaaaaattgatattggaatacaatacattgtcagattttgtccaaaaatgaccaatttttgcaattttttgagcaaagttttttaagaaaattaaggattttaaaggcccggcggtgccgatatcgccgccgggaaatt

SEQ ID NO: 40683 - DNA, 1317 bp, Heterodera glycines
  misc_feature (1238)..(1238): n is a, c, g, or t
attataatctatataatcatttacgaaattttgttctaaatttcgatcatcctatgtatccatgtcctatgtttgccaagttctgttgctttaccgtatccctacctaatgaataatttaattgaaaaattttgtattattaacattgtgcaattttccaatttcattcatcgaaaatggttttgaattagctaatcaatgatgattagcatcgccaaatgctgctcttcctttttgcataatcatttcacaaaaattttttagatattaccatccaaaaaaaaaaccctgtccttcccagtccacccattaaaagtatttttttttaattatttaattaaatttaaaaaaattaaatgtaataaaattcacttgcacacatattcagcagaactccccaagacagtagtaatgatgcgcaacgcaatgcttctcccggttgtctttgcgatgcttttttacttcagcgcacttttgcaatttggatacggtacagttactgtaatccaattttcacatattgaaaaaactgaatcgaaaaaaatagtataaataatttataatgatattaggaaaaatttaacaactttaaaatacaattaaattcttccttcgcattttggcatttttacccgtccatattttggcacttttttttaaaatccaccttctaacgattgacatttaattcattaaaaaaatacactaaaagaaagaaaattcagaaatttttggtaaaatttcttaagcatttcattttaataaaaaaaattattttttattatttttttcactttacatttttagcattgaaatgccgtgccctttacacaacggaaaatgccacggcaaatgaattaattaagcaaataactaatccaggagattttaaatgcactcgaaatgagaagaactgcggtgtaacattctgttcagctggttgatgctgaaattatttttataaatttaaaaaacaatttaaaaggcaggcgcctaaatcaaaaatatttgagagttggaaatgccatgactttttcttttcaccctaaaaaatattaaatataattttctaaaaaataaataaatagaatattagcatattttgtctcaaaatggatattttgcaaaaaaaaatgttgaaaattttagtttttgtgaaaaaatccaaaatttttatattttgagatttttctaagctatttaggtctttttgtgacatttttagtccaacaaaattnttcattaatcttttggtaaataaataaaaatatatttgtatgacaccatcaattttttaggcaaacttgaatttaatac

SEQ ID NO: 40684 - DNA, 1042 bp, Heterodera glycines
  misc_feature (847)..(847): n is a, c, g, or t
  misc_feature (882)..(882): n is a, c, g, or t
  misc_feature (970)..(971): n is a, c, g, or t
  misc_feature (993)..(993): n is a, c, g, or t
  misc_feature (1001)..(1001): n is a, c, g, or t
  misc_feature (1003)..(1003): n is a, c, g, or t
ggttcggggggacttgccccgaaaaacaaaaaaaatcgattttttcaaagtgtccgtttggggtctccaaccattatggggagcaaaaatcccacgcagaattaaagtacaggctataggagagctattcccgaaggattcggtcttccccataaatctgggcgcatcggttcggggggactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggngggactgccccgaaaacaaaaaaatcgattttttncagtgtccgtttggggtactcaaacaattatggggagcaaaaatccacgcagaattaagtacaggctatagggaagctattcccgaanngatcggtctccccataatctgngcgcatcngntcggggggacggccccgaaacaaaaaaatcgattttttc

SEQ ID NO: 40685 - DNA, 861 bp, Heterodera glycines
caagaaagttggatttggtttgcaatgaaaaaactcattgttcaaaaactaggctggcgcgaaaacgacccggtacgaaaacgtcctggcccgaaactttattagatattttgcaggataagagaaaacatttagggctatcgaatgatatgaagatttaaaaatttggttgcttttgagcaaaattatatcaaaaaatatttccatttgatggtttttggctaatgtcatagaaacaaagccaagacaacgggtcaaagccggcccaccctcgagtttttccctcaaaagcttccacagctcattgacatattcaatggctagtcgccaaaaaaaaaaattactacactttttagtatgataaatagggcataaaaataaggatataaaatcggctatatggacataaaaagtggaccaaaaaatcgcgcaatatggacataaatttttcgaaattagcggtatatactttttcaaaaggtcttcaattacgctaaatgtaaagtaaaatgtttaaaaatagttaaatatggtattaaaaatcattttagaagaaaaaaacattaaacctaaaatgtttactaatttttagcgaaaaatcaactcgaaaagtaaaaaatatggattatttccaaatataattctacgcaactactgattaaattccatgaaataattttttttttaaattaaatatgaatttttaaaatttactttcactaaaatgagtgcattctccacgtaaattaacattttgagcagttccttctttttctccatttgtggcaacgttttggccagcgccatctcaaacccaagatgcatttgtttctttttgatcttggaagttgaaaaaattta

SEQ ID NO: 40686 - DNA, 911 bp, Heterodera glycines
  misc_feature (18)..(18): n is a, c, g, or t
ttcaaaataatgattatntcggttctagacaattttattctccttttaaaaaaaaatattcgacctttggaacatgaaatacccacaaaaattcactatgtttagcgtttaataactttccttataagtaatataattaaacattcttggtataattcgatagctctaatggtcctctataagtctataaaaattcatataatttaaataaatattgaaagagttatgatcagaaaagttaatcattcttttggtaaggtaatttcatcataatgatactaaaaaaaccgggtaactggtcaccttacccgcagctgcgggtaaatcaatgagtaccgggtaaaattcatttagtatgggttaacccgcagctgcgggtaggtttaccaggtgttacacgggtaggtttacccggtaactttacctcgttctttggtacgggccccgggggtcttttggtcaatgttttgcacttccctttttcccatttgattccccccccccgggcgaagtgtttcaaaaggcatttatttattattttcatttttttttacatacatattcattcaatgtaaataaactttaaatctccaattttcatctttcatttgaattttttttaattgttttgctgctctgatgctcattagtagtaaaatatttttgtaactgattttataacttttcatatccccattttatttaaaaattgaattaaaatgagaaatttcggtaattatctttattattattaccagcacaaaattctgcacaataatttcataaattgactctcgctttacattctccaaaaaataacttcacatgaacataaaatataaaaaaaaacaaaagatactcacgaagtttaatattttaatctacctatgtatatactatgtgagtaatgt

SEQ ID NO: 40687 - DNA, 1144 bp, Heterodera glycines
  misc_feature (14)..(14): n is a, c, g, or t
  misc_feature (36)..(36): n is a, c, g, or t
  misc_feature (130)..(130): n is a, c, g, or t
  misc_feature (919)..(920): n is a, c, g, or t
  misc_feature (926)..(930): n is a, c, g, or t
  misc_feature (935)..(939): n is a, c, g, or t
  misc_feature (941)..(943): n is a, c, g, or t
  misc_feature (946)..(947): n is a, c, g, or t
  misc_feature (951)..(955): n is a, c, g, or t
  misc_feature (958)..(958): n is a, c, g, or t
  misc_feature (961)..(961): n is a, c, g, or t
  misc_feature (967)..(967): n is a, c, g, or t
  misc_feature (969)..(971): n is a, c, g, or t
  misc_feature (977)..(979): n is a, c, g, or t
gcatcagagagccnttaattacctgtaaataaagtnttgtgtgtttcagagcactttctgaaaaaatacttatgaattaattttgcaaaaaataaataagtaatgaaaaagtcagaatttcgaaaaattntaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagagaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatactcttaaagaaannaaaaannnnnagaannnnnannnatnncccnnnnnganagngaaagnannngagggnnnaaaccaacttgcaaataaaatttggtgcgtttcagagcagtttctgaaaaaaatatttatgaattaattatgcaaaaaacaaataaataatgaactctcttccttaataattttcctgcaccgaaggtactcactcggccgcttcgcggcctcgtggtgggcctt

SEQ ID NO: 40688 - DNA, 1487 bp, Heterodera glycines
tatgaaaaaggggttcattttaaaattaacaaaaaaaaaatacaagcaattaattaattatgtgttgtcattgcgacttcatccatataggtaggtattactgtgatttggaaccgaaaaaaatttcagaagatacacccctaaattgaaaaaagcttcccgaaattgattcacgaaaataattttttttatttaattgattttcaatttttttcaccttggcattaattttattcaaaaataaaattttaaggagtgtcgttggtgcaaaaaagcgttactttggcttcacttcttcgccaaccgagtaatacatacggggaatattatcaataatatttcgacatttcgcaatttcaaaggaatatttttaagacctattactttatttgaagaattaaaaaaatatataatatctatttttttacgaaaaacaaagttaattaattaattatgtgttgtcatcgcgacaatcacccgtatagatttttctgtaatttagctgtatcaaggacgacgaaaatattctcaacactttagaattttcattttaatttaaatcaaataaaagtaggaattttcttatcacttcgcgcttccgtcgatcaatttaaatttttttgtttgttttttaggtcagacggaggtggtcacccgcacaatgtcacaacagtgggaagtacagcatgatatgtatgattatgatcattaccctaaagacgatggaccaaaagaaaaaggctccaaaaactgctgcactataatgtaggaaatttggacaaatttcagacgctttttcgagtttggcgatcttagaaaattgtgtaatccgcttttttgaattgtcgaattgttgagtaaaatcttgttgttgctaaatatttgtcttacatatggtcaacaatttgggacacatttgcgaatcaaaattgaattttcaatgagtaacaaatttttgagtgacaaaaaattaattaaattttgcttttatgtttaccaggaatagaataacccaaaaaaaacactggacgtcgtgattcgaattggcaaagtatttttgaaaataggaaaaaattacgaaaatggagtccaacaaacccaaaatttcgcaagtcgaaggtcggaattgcgtttcatccctgatgcttactaggccaaaatttcaaacaaattcaaacagttgatttgtggtaaacagttttgatttgcattggaaaaaaataaatttaatctttttaatgctacagtccaaaaatgttttatgctgaaagcattttgttgctatttttgaattaagtaggtgttgaaaataataaattcaattatactatcaatattaaaatataaactaaaaaagaatacaataaaagcattccatctttgagcaaaaaaatcacattaaaacgaaacttttaatttcaaatcttgaacccatcaaattgattgacaagtaatttactagaggattttttatttttagaaaaaaa

SEQ ID NO: 40689 - DNA, 816 bp, Heterodera glycines
  misc_feature (18)..(18): n is a, c, g, or t
ttgccattcaaggacggnatcccatccctgggataaaaaccttaaacctgagggtttcggggggtgttgatcacgaatctgatatccatttcgaccaatttcggacttttgtctaacactgacactcactgggtttgacccgtagttataccggtaacattttcggaaatttcatattactttataaataatttagcgattttggataaatttttcaagaaaattaaggattttaaggttcggtggtgccgataggaacaacggccgggaaaaattttgaagtttcagtgctatttttttcggtaaattcgtacatttcttgatcgtatgtatttctaatataacattaggtaatagtgtagtttatcccccccccctttttgacaaataaattttcaaaaattttaatgagatactcacgtggccccagggttttgacaggagcctaatttcgattacgaatcgcattttcattatttaggactaccggaacctggtgacattaattaatgaggtaaatctccccatttttctagcatggagttgcaaaaaccgtaccatttgtcttaattccttgactaaatcacagcttctatatatactcggtttgtcgttttaatcggagacggcaatctgctgacatcaattaagcacagtaaatctcccaatatttctaccataaaattgcaacaaccggcatatttgccaaaatatcctgacaaaatcctgaattcaataaatactcggcttcttctttttaacgaggactgcagtctgctgacatcaatgaatcatgtaaatctcccaatttttcta

SEQ ID NO: 40690 - DNA, 1471 bp, Heterodera glycines
  misc_feature (36)..(36): n is a, c, g, or t
ccactataaattgacccgaaaattttcaaaaataantccctctatttgtaaaatttactcaaaaattcatcttcaaattatttacatttatttataaaatttttgattttaaaacttttatctcatttttttttacttttttttaataaattttatcattttacaccccaaactatttttcatttttttgagcctatgttcgaggtttttaggatctaaagactacctatttgcagtttttgagcctaaaaatcttagccctagtaattaattataaatatttagctttaatttgaaaaaatcaaaagaaaaattgacaatccggcatgagaagatagtttttttatttcaactcttattttaaattattaattgagaagcattgaataattaatctaatgagttacgagaataaaattaattctaaaaaatataaattttgatctgaataaataaaattataaaaataggtattggcgtttttttattttaatacaaaaaataaggataaaagaaaagaaacaaaactaaatataaaaaaattttggcaaagaaaaaaagcaatgggaaaattgaattcacacagagtgcagggcacgattgaggaaagttttagacaagcgtctttattttagaaacacattaattaacataaataaatcgactaatcttaaatgaattgactaataattcatcctgaaaataattaacaagaaaataaactattttttggcggaggagttttttaaaaaaggctgagtatctaaattaataaaatattttgacaaaaataacttataagtttttaattaaacaaaaaatattttatattatagttattcattccttcaaaaaactataaaattataacctacacgcaaatgcgttcgagaaaaattcttaaaacaaacatttcaaaaagcttggcacggatgagactcaacccagttggtgccttcgtcagattcagtcatttaatttatttaataaaattttttactaaaaatatattatttaaaaattaaataaaaaaatttcatatcgcaaggaatgcatgaaagtaaagaaaattatttttgtttgataaatcaaaaaaataattaaatagattaataaatttcatgtaaagaaaaacaaaaaaatgattttttattgagtaataaatattatgaaatactaatgaactaaattacattattataacataaaagatgcttatttcttgggtaaaccctacgaaatcaaaaaagaccaataaaatttaatgaattaaaattgctctaaattgttttactcaagcaaataacaaattcaataaaatttttattgctttttccgtaatttataatgcttctaatttttgtcacatgtgttctctagtgatgctcgagagtctcggtctcgagtctcgactcgagaaaagtctcggtttttttggtctcggtctcgagtctcggtctcgggttttcag

SEQ ID NO: 40691 - DNA, 776 bp, Heterodera glycines
tatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggcaaaaataaagtagaggctatatcgaagctattcccgaaggattcggactcctcataaatctgggcgcatcggttcggggggactgccccgaaaacaaaaaaatcgattttttcaagtgtccgtttggggtactcaaacaattatggggagcaaaactccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaac

SEQ ID NO: 40692 - DNA, 1729 bp, Heterodera glycines
gtaattccagctctcaaaatgcatagaattattgctgcggttaaaaagctcgtagttggatctgtgctagccgtccggtgcacactttgtgtgttactggtttggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacacttcttagagggatttcggtgttcagccgcacgaaattgagcaatacagggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaat

SEQ ID NO: 40693 - DNA, 645 bp, Heterodera glycines
aaaataaaaacccataaaaatggcgttggtattaatgtttatgtgtaatatatttatataaataaaaaatcaacgtcaattttttaatttccgtaaaaatatatataattaaaatgttgatttgtcttttccccactttttccatttcaccaccaccaattttgttattgatggcctcctctcctacacactgccatttctttataattttcattttattttacataaaatcgtcaagtgacatgtcaaaaattgattaattcgttgtttaagcatctcatattatataatttcccaacgcatcctttttttattattttattttctcaatttcctccattttcttttgcatgtgttcagcaggaggctgttttggaatttcctctttctaagaattttgactccgataaaattatgaattttagagcaccaataaaattgccacaattcggttttcttgaaaattaattttcaatattttttgcgtcggaattcaacaaaaaaaattattttcataaaataacgactaaactcccacaaaattataaacaaaaaaaggcattctcaggactttaacctgctaccacagcataccgtgcttagctctaaccaattgagctacagattttctttcaatagatccct

SEQ ID NO: 40694 - DNA, 906 bp, Heterodera glycines
ctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagaatgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcgatctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacaaaaaatcgattttttcaagtgtccgtttggggtactcaaacaattatgggggagcaaaa

SEQ ID NO: 40695 - DNA, 1225 bp, Heterodera glycines
  misc_feature (1079)..(1079): n is a, c, g, or t
  misc_feature (1099)..(1100): n is a, c, g, or t
tatattttcagactttccattctgtgtccggttccaagcattttttcagcatttggatttttcctggattttctaggcccggcttttttcagaaatcaatcttatcaaactactttccatacctaggagtccgccataaatttaaagacctaaaaattgaaaaagcatcactttgaaaggtatgccatgcctatggcgttaatttttagccaaaattaataataattaatttttccatttttgctgaaataaaaaagcgacggaatgcatccgccgagcagcaggaggacacccttataaatatacaaatgagtcagtgaatcaccatcacacaaatggggacggacagaatgttttagtttttgcgggttggccaaatggcaaaaggcgaaaaaaaatgagtcacagcgatggcaaaaaaaagggcaaagccaaaaacaaatattattattattatttattacagatttatttggaccatcataatgttgttgcttgtatctgctagaattattggagaatgataaggaaaaaaatgttgttaaggaaaaagagttcattcccccccccccaaaaaagtgttgaattttacaagaaaaaaattcaggggggtaagatgagaaaattcatccgacaagaaaatttgaattttgggcctctgaaaatctctacttctaccgatcgcttcaatagaacagaaattctataggagaatggggctggctgggctgcttgaaagcctcggtttttcttgaactaataaatttctcggattttccttgggcatcggttgtcgagactccaattttcactctcgagttcaagctttcgactctgatcagttccgaaaattattttttgtgactcgggggattcgggaattcaatctctgacaaatgtgggggtgggggagggactccgtttgggttttctgttgaagccatccatccccgcgggtttgaagcccaatttatacccaaaggtgccgcccccctccgccccgccaaatgctgacacaaaaagcaatgaaaaagcatttggtggaagtgaaaaacaagattttggtgggctgagattgngctgattgcttgttgcttannattaaattgaaagtgtgtgtgtttggcgatcagattaatctcccgtcgccccctccttgggcgacggcggcggggagggaggggggaagggaggaattggacgatgatcaaagcattgtaatgtg

SEQ ID NO: 40696 - DNA, 752 bp, Heterodera glycines
atggccgaaaaagtgtgaattggggaggattagaagaaaagtgtcaattgacaattcatcttgcgaataatttgacgagaacactaattatttcatttaaacgccccatttaacaatttaatttgaatttaatttttcagcctttcattttcttttccgtgttcacttcgctttcgttgtgccctttttctgctgccaatgagtcgaaccctttctttcccctgcggggggggggacttcgttttctgtcaattcgcaaaaatagacgcaagcattggccaaaacagcccagccgtgctgatggatggacttcccgtgatgccctctcctcccatgcgatgctccgatcagagcgaccaaaatgcctgggggcatctgccagagaaaggaaaaacagagaaacattgtgcccaccccgtccgctcatttgttatgtgccgcggtccgtccttttccctccctctctctccgcccttctttccaagagtggcaactgtctcgaactctcagacactttctctgtctgtctgtctctctcaacccacttttctctctcctctggcctctctctctttctctgtcgtctcttatgctgcggtaaatctgccgatcggaaaggaaaagcgaagggaggtgaagccgtaagcactgaagaaaatttcagaatcggaatgtcgtcgtcgagagcaaatggcctcagaaagggtggtgggtgggaacacacaccgaccgatgacggaaagagacgggga

SEQ ID NO: 40697 - DNA, 1080 bp, Heterodera glycines
aaaaatcagtacagttacgagccagccctgctttaaatcgctaatcctttttttaaataccgtatcgctggtgcatttttatcgactactgctggagggcggaggttggaaaattttcaaaaatatagacaaattttctccaaaatttttcatttcggggttatggcaaagaaaggcccttgtaaataatgtgagttttccgcgcgacctgtcgccgatttccgtccatgtcggcacactcaatttttgcttccagcccggcatcgctgtaacaaattcggccaagttttggcaatgtgacaattgcagtcggaatttgaagttgtccaaacacgatctgaaaaaaatattacaaaatctaaaatattaaaaaaaaaattttttattaatgttcggaaaataacattttaaaaagtcagttcattaagagataaatcaaatgatcagatccatttttcatttatgacagtgtcaacgttttattttttttatttccaaaaattaccattttccaaaaatctcactttaacgcctcattaaatttttgattttttaaaataaaaaaatgttttatttatttttgtggttggaagattagttttattccatcatgctttcctatgtatcggaccattatacaaaatttacttttttccgatagcgaccgtcagatgttgcaacaaaaactgcaaaaaaaaaaaaaaaatatttttatttaaaaaatttaaaataaaaaattaatttaatttatttaaataaatatgaattaaaatttcggccaaaatgacttgcctacgcctgtttcgtcaagcggttggctccaacgccttttgcgtcggccagccgcctccgcgttcgcaatgttttccgcgcccacaacaccggtgacgtaaatgttgctaaaaacgaagaaattttgcagaaaattttcgaaaactctttttcaaatggaaaattcgcaaaagtcttccttttaacattgccgatccaattttatggcctgcctaattaggcgcaaattgttttaaattctgtttaatttgcaaatggtctaagcaccataaaaataataaattaatt

SEQ ID NO: 40698 - DNA, 1158 bp, Heterodera glycines
atacttaccttatccgctgatgctccttgaatccaaaatcaaatttatgaacattcctcggcccctctccaccgggcattgtcacacacgttattttcatcgtaatttgctccgagagcaacagcattttcttattttcatctccgtccccgctctgccccaacttattaatctcctgcataataacatccgcattattctgggggaacgcccgatacggcacccacaccgggaaagcaagcccggcgcccgtaattaccactccaaacatcctcactttccgcttcatcctttcttccgtagtcttaaaagccgccttaatcattgtgtcgattgcgtccctcatcgcttcatcggggcgtcccacatccgggttgatcgtaaattccgcaatgttcttcgtaaatccaaatttttcgcaaatcgtcgaacgataatccatcaatttaaaagtttccatttcttcaataaaattgtttctgaaaaattattgaataaaattgtctcttaaatatattattaaaaattacttacccgattgatctaaaatcccattttttagtcgacggtccgctttgttgagaggttccattgcgttttgcagccattttaataatatttaataatttctaaatatttacgcacaatcttattttagcaaaatccaacttttggttgaactgattgggggtgaatttggagagcttttatatggggtgagtgatgtgcaaaattggacctgtcaatattttgattgacaggtgacctaattttggtccagattgcgaaatattgggaacaaaaaaaaaaacaaaaaagtcacgtgcatatggcgaaatgaacggggaaattgcgaaataagggaccaatcaatcattttttggtccatattgcgaaatacttggaccaaaaaactaaaaataatggttaaatttaaataagaaaaccatcaatcattttttggtgacaggttttcaaaaatatttgtctcatattgcgaaatatttggatgaaaaaaaaacaaaaaaaaaagtcagttcagattgctaaataatggaaaaaccatcaatcaaatttattggcagatgacctacttttgaaagttttttttcccatcctattttatttattcattttcaatttatatttaaatagtta

SEQ ID NO: 40699 - DNA, 679 bp, Heterodera glycines
  misc_feature (653)..(653): n is a, c, g, or t
ccataggggtcatatgcagggttcggatcgaaaatttttcaaaataagaacattaaggccaaaaaataagattttatggtcaacaataagaacatttcgaaaattgcttcaaatccgatatttttacaatttattcgatcaaagtatcaaatattatatttttcacctccatgattatttttaacaattttggggagaaaaatagcaaatttagtgcaatttttatctaaaaaaaataaaatttttaacaaattttttacggcgcatttttccaagaaattttggagaacgggggaggggagtgggtcctggaaaaaattttgttatttctttgatttgttaacagattttgtctaaaaattccataaattttttaaatttataggtaaaataagaacatttggccataaatttccaaattatgaatatatttaagaaatatgtaagaacaaaataagaacaatagcccgaaataaggacaaatcttacaaataaggacatttttattttgtaagatttggaccctccaaataaggacaaatcttataaataaggacagatccgaaccctggtcatatgagacgggggctggggttcgagtccgcttggctgcggtttattatttttatgatttctgttacaaaaatcatcgnacaaaatgaaggttcttgcaaaatca

SEQ ID NO: 40700 - DNA, 992 bp, Heterodera glycines
gtaataaataattatatttaaataattttagtgaatgaaacaaattatatttaataattattatatttacaaaaattcattttaaggcaaatttataattttaacattaaacaaatataatttttaatttatttattcaaatattccctttctttgctattaaaaaattaaaaaaaaataaatttttgaataaaatttttcaccattttgttgctggtccggttcctcgtcaaacagttcatccagcaataattgagacattttttaatatatatttttttatttaattttcattttataaaattaaaattgccacttatgcacaaatcaatttgtcttttttatttgtcgacgtattcaccagcaacagcagtaaaagaaaattgtggtcgaataaatggaagaaaaattggacacattattggggccattttttgttgttgttaaattttcatcacatttttgctaaaagactaaaataatttttaaaatgtttaaattttaattatttttgaaattaaaatgaaatggtaaaattaaattattcaattaaaaactttaaaaaatttgaaagcttttttgttcaagcattaaaattcaatttttaataatgaaacttcgtaattggccttttgaaatgtggtgtaaagcataatggagtaaaaaaaaggaatatacccaaaaataaaataatttttgagaaaatcttttaattccaagattttccggattatttggtggttggtacgcttttaaaataattaaatatctatatgtgcatttcacttaattaatggtttcccaaataaaatatttttagagctggattggatttttatttatttttggatttaataggaaaatggcgattaattttgggtgcatggtttttggttagttttcattcattgtgctgaataatggaaagtgagagaaaaaaaagcaaaaatggaagcaatgtgtcctttattttaaaggaaaaaaaagagaga

SEQ ID NO: 40701 - DNA, 1231 bp, Heterodera glycines
  misc_feature (75)..(75): n is a, c, g, or t
tacgttttattcgatcaaaaatatttaataataattggtcgttaaattctagaatgtctgaaaaaataaaaattncgggtatctataaaattgacccattaagagaagagctttgctttttcgaaaatccccacaaattccattggtccaaaattgaaaattttactcagcccattatggttaactaataaaatttaaaagcccagggagcaaaggcacacacacaattatggtcaataatatcttttataaataatgaatgaacatcggcggatcttcttcttcatttctgcatcgttccatcaacaatttcggtaccctttcagtttagggggcagattcatatacatttttatatgcctataaatgtattcattttacattgtttttttaagcatggaaattttaaaagactttaatattcatttatttactcttctgcaaaaaccagacacaatgtaaaatgaatacatttataggcatattaaactgaaagagtaccgcaatttctcttcccccaaaatggcaaagtgccgcctccattcgttcgttcacttcgacgactgtgacgtggtgcgctccttctccttgcgcttctcctcccccttcaccgcgttgtccacgatgcgacgcgtgtcgccctccggatgtccatgtttgtgctcaacctgccacaaaatgaggagtggtggtgggcagtctttaaaatgcctgcacaattaacaatggatggtaaagcgagcctcattttggcatcaagagttgaactcagcagttcaaattgtttgtggtagaattcaatttaattttctttactaaatgtaatttccattaacgcatttttttgcaaaactatattgtgttgaaaatttatagaaaaaactatttgaaatttcgagtggttgggggggggatacgtcccactgagaccgtccctgatcaaaatggtccttttttagaaaagccaatgacgcacaatcagccttattatacaacaaacgatccgacctgttcggacttggtgcgcttgccctggttgctcttgataacttcaccgtcacccctaaatgcagtaaaattgattaaaacagaaaaaaaatgtaaaacagagcactaaattaggaccttcaccaaaaaacccacctctcatattcgtcagcgatttgagccgcggattgattgctcattttgttgatgattcgcgaagttttattatttttggattctaaaa

SEQ ID NO: 40702 - DNA, 924 bp, Heterodera glycines
aaaccaatttttggtgttcctaatttacccgcgagtcaaacatccgaatcaattaaatagcttctgagataataaggtttatcataaaatttcatttaaaaataaacactcaattatcggtacgaacgatactttccaaacatgcacgcgtttcgcgctcgagctatttatcatcgggcttgtcaatccaaagcgaaacaacaaagatgctgttttgaacgaataaagggcataggttattttgaagaagtgtcaaagaaacatgcagcaataagcctgcaaaatctaataagtggaaaatacatgagtatagaatttattttcagaaagtgtcaacatacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacatacttttggaaaaatatatttgcaatttatcaacaattttgagaagtgagttagaaatgataaacttcacgattcaaaccaattttcggtgctctaattaaccgcgataaaaacatccgaatcaattaaatagcttatgagataataaggtttatcataaaatttcatttaaaaat

SEQ ID NO: 40703 - DNA, 898 bp, Heterodera glycines
  misc_feature (11)..(11): n is a, c, g, or t
  misc_feature (887)..(887): n is a, c, g, or t
aatttttaaantttgaaaaaacagaatgccaagaattaaacttatttttaaatttgagaaaacagaatgccaagaattaaaataatttttaaatttgaaaaaacagaatgccaagaattaaaataatttttaaatttgagaaaacagaatgccaagaattaaaatatttttaaatttgagaaaacagaatgccaagaattaaaataatttttaaatttgaaaaaacagaatgccaagaattaaaataatttttaaatttgagaaaacagaatgccaataattaaaatattttaaattagagaaaacagaataccaagaattaaaataatttttaaatttgagaaaacagaatgccaagaattaaaataatttttaaatttgaaaaaacagaatgccaagaattaaaatatttttaaatttgagaaaacagaatgccaagaattaaaataatttttaaatttgaaaaaacagaatgccaagaattaaaataatttttaaatttgagaaaacagaatgccaagaattaaaataatttttaaatttgaaaaacagaatgccaagaattaaaataatttttaaatttgagaaaacagaatgccaagaattaaaataatttttaaatttgagaaaacagaatgccaataattaaaatatttttaaatttgagaaaacagaatgccaagaattaaaataatttttaaatttgaaaaaacagaatgccaataattaatttataaccctttttttataactaactgaagccggcagttggctgaggacggattcgagcggcggtgcatcatcaaacaaatccgcaccgtcccgaacaggggagtacggtccatcaagggtaggggggagggaatcgtcagataattggctcattntattttctttc

SEQ ID NO: 40704 - DNA, 1432 bp, Heterodera glycines
aataaatgaattattgtagggccgagtctgaaagtggtctctaaaaacggcattttccaagaccatcaagtaacaaaatgttttaaatatggccttaaatttgatctatgagctctcaataaacctgtacagctccaaattcatgcatggagtaggagcagtacaagctcagaattgagaaagaaatagtgtaatgatggattgcaaaaaacaataaaatatctaattaaagttattaatgcgtttcattctttttcaatttttatcgtttatagatttaagccattaaagaatattaatttagaataattaaaattaattaaccataaaacagaatatccggatattttcttattataaaaataatgttaaacataattttatttattgttccactctttttcaaacaaaagacaccgcatgatgagaagaaatctgcaaaaagaactaaattcacaaatattttaaataattgtaaaatttaaaaaaagcataaattagataagaatcatttaacaaagaaacatttcattcaatttcacaaatttattttcgcttcgattagataaatgagaaatttgtaagaaaaaaaacacttcaaataaacatcaaaataaattatatttaaaattcgatttaaggtcgataaaagcaatgctaataaaaaacgaaataataaatcaaataaataattaaaatctcaatccttaagagttctcaaatgaacaattttgagttaattcagtaaaaaaaatattttaaaatttacatttaaaagaaattatttataattaaaattacctaaattatttaaaaaataaaaagaaggccttagaatataagaaataataaaaaatttaattgtcttacgattatgaaggattattatacgtaatttgatgacaaaaaataaaaatattacataataataataaaattaaatatatatattaaacaaaaaaaaaaagattcttggtaaaaatttgtggctatgactgccaagtggaaaaaatgtaaaatgtctcttaaatgcccaaattattggaatgtcaattaattgaaaaaaacattcggtctcaaaataattgatttcttcttaattacaacaattatattaattttaatcatgtcgcatctgcttgttaggtaaaaaagaataacattttatttacttcgaggttattcttgaaccagaaagattagagaattgaataagtcgtggtttaacgacttgcttaacgcctaacaagcagtttcgacaattaaaaaattaatatcaaaaataattgaaaggtatacaaaaaaataaaagtaataaaagtttctggtggattaaacttgaagattttttgaattttataaattttattaaacatattttgaaataaataattaaattgaaaattttgacgtccattttaattaaaaatat

SEQ ID NO: 40705 - DNA, 859 bp, Heterodera glycines
ttgagtcccagtgattggaatgccgcagatttgagtcccaatgtttggaatgccggagatttgagtcacagagattggaatgccggagatttgagtcccagtgattggaaagcttgagaattgagtcccagagattgaattgctggtgggttgagtcccagtgattggaatgctggtgggttgagtcccggcgattggaacgatggtggattgagtcctggcgattgaaatgctgtgggttgagtaccagtgattggaatgctggtggattgagtcctggcaattgaaatgctgtgggttgagtcccagcgattggaatgctggtgggttggttcccggcgattggaatgctggtgggttggttcccggcgattggaatgctggtggattgagtcctggcaattgaaatgctgtgggttgagtcccagtgattggaatgctggtgggttggttcccggcgattggaatgccggagatttgagtcacagagattggaatgccggagatttgagtcccagtgattggaaagcttgagaattgagtcccagagattgaattgctggtgggttgagtcccagtgatttgaatgctggtgggttgagtcccagtgattggaatgctggtgggttgagtcccagcgattggaacgatggtggattgagtcccagtgattggaatgctggtgggttgagtcccagtgattggaatgctggagggttgattccggcgattggaatgctggtgggttgagtcccagtgattggaatgctggtgggttggttcccggcgattggaatgctggtgggttggttcccggcgattggaatgctggtgggttgagtcccagtgattgtatgct

SEQ ID NO: 40706 - DNA, 368 bp, Heterodera glycines
ccagaaaaaagggctcatctctttttttcgagaaaatttcacacctcacaaaagcgcttgcgtatcgagacggagggccgggcacaatcgccattttctttcacagatggattttatctttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttcgagaaaatttaatacctcacaaaagcgcttgcgtatgagacggagggccgggcacaatcgccatttaatttacagaggatttt

SEQ ID NO: 40707 - DNA, 1239 bp, Heterodera glycines
agttttttggttattcttcaagagataccttttgaaaaccaataacgacttaaaattacgattgcttaaattaatataaaatattgaatcgaatcaaaaattaaaaggaaaaatataaataaagtatctatgatatattaacaaaatttaaaaatgaataactacctttcataaaggtaaatttcgagaaaaaaacgcgtaaaaggctgaaaaaacgaaaaaaaattaaatatcgaaataatcttaagatccaaagtatttaaatacataaataattacaataaatttaaataatcgttatttctgttattaaaaaatctgttcaaacattagtaaataaacgtattaatatgaaccaataaaaaaggacaataaccaaaaacaacattcctgcaaatactcaaaatttaaaaaaaaagttttaaaatgagaagcggcaattttgtcaagaaatttaaatgagacattattactttattggtagaggtttattctataataaaaaatttatttatgttgctttaacaaatgcaataaaaattttaacttgacttgaaagttgaaaaattgtattagtttaaggataaaggtataaaaaattaaatttgaaaaagcatcgctttttcccatagtattaaatacgattgaactaaatttaaaatttatagtaagaaatttaataacaaatctaaacacattcaaagatggaatttcttctgtagctgtcaataaatatcttataaatttctaatcattaaacaaaataactgctaatataaaaacaaatttacaaaaatactaaaaaacagcaatccgaatacccgattacaaggagtcgcgccatgacgcaaaagtttaagaattttctaaaaattttaatttataaaatataatgttaggcatttttctaaaatttttcttcagcttcctataattatgaaaaaattagtacaacttaaacaaaatatattctaaatcatttaattaataaaaaaacagagaaaatcgatcaaataatatataaacataaaactaaatactttaaaactatcgattagaaattatcaaaattaataaaaatttaattttcataattttcgcaccaggaataccaaaaaccttactgaacggtaaaccaccaaaggggaccatggtccgaaatattacagcaatttattttacacattctatttcaacagtattacattgagtctacagtatctctgcttatatgatact

SEQ ID NO: 40708 - DNA, 935 bp, Heterodera glycines
ttcaatcaatgggactcaacccaccaacattccaatcactgggactcaaccctccagcattccaatcactgggactcaatccaccaacattctaatcattgggactcaatccaccaacattccattcaacgggactcaacccaccagcattccaatcactgggactcaatccaccaacattccaatcactggcactcaattctcctacatttcaatcactgggactcaacccaccaacattccaatcattgggactcaatccaccaacattccaatcaacgggactcaacccaccaacattccaatcaacgggactaaacccaccaacattccaatcaacgggactcaacccaccaacattccaatcattgggactcaatccaccagcattccaatcactggcactcaattctcctacatttcaatcactgggactcaatccaccaacattccaatcactggcactcaattctcctacatttcaatcactgggactcaacccaccaacattccaatcattgggactcaatccaccaacattccaatcaacgggactcaacccaccaacatttcactgggactcaatccaccaacattccaatcactgggactcaatccaccaacattccaatcaacgggactaaacccaccaacattccaatcattgggactcaatccaccagcattccaatcactggcactcaattctcctacattccaatcattgggactcaatccaccaacattccattcaacagtgactccacccaccaccaatccattcactgctacacaattctccgacaatccaatcactgcgactcaacccaccaacattccttatcacatggactcaacaccaccaccattccaatcacagttgactcaatccgccaccattctaatcactgggactcaatccaccaacattccat

SEQ ID NO: 40709 - DNA, 904 bp, Heterodera glycines
aatatcgtaagattgtttgatagggccagacaagagaaggcaactggttggtaccaagtttgcggtaaaaaaatgagaaaaaagagataactattttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatatcgtaagattgtttgatagggccagacaagagaaggcaactgttggtaccaagtttgcggtaaaaaaatgagaaaaaagagatagctatttttggtcaagaattttttttcttgcgtttcaaatatcgtaagattgtttgatagggccagacaagagaaggcaactgttggtaccaattttgccgtaaaaaatgagaaaaaagagataaccattttttggtcagattttttttgtttgcgtttcaatatcgtaagattgtttgata

SEQ ID NO: 40710 - DNA, 1082 bp, Heterodera glycines
gggtaattaaatcagaatctaaaaattcattttgctctctaatatataaaattaattttcttttagtaattttgtaaatataaaatttgaatttaataaaccaaattatttgacttacattcgaatcgaacatgttacaattgtattcataatttttattgcattttatttaattaccaaacattttatttaataatcattttttaattaataatgtttttttttgtttttgtttattttttattttattttttgttaattatttatcttttaatatatgatactttattttgttttatcaatataaatttctattattatcttccagttaaatttatttatttattttttgattttttaagcaattatgattttactcgctgtcctaatgctcatttaggttcacgtttcttttccattattgtttttttcatttttcaatataaaatatattaacaatttttctaaaaattttaattattaaagatagttgaaataattttgtaaaaaattgaagaaataattttatgcatttttttattggaaaatcgcaaaattttgtattttttggacaaaaattgttaatattttaattatcactatttattatgatcataatttattttttaccagtttttatcttggattttttaagtcctttaattcagttaaattttgtttaattaacattaattcgtcgcctttttcggctccatttagattgaaattttcaaaatctccattaacaattccagttttataatcatataaaaatagatgaaaaccaaaaattctttctttactaattattttaattgcttaaaattttactaacgtaaataatttttcttcaataaaattattatatcactataaattttatataattaattaataaaagttaccctataaattatatttaaaaaactattaccatttcagtaaatattttaataatgtgtataaaaaaaataataatttttaacaatatactaatcaaacttgaataattaaaataatgattaaaatctcaatttaagatcctctgaaaagggatgaaatttcagtaataaatgaatata

SEQ ID NO: 40711 - DNA, 788 bp, Heterodera glycines
ctaatttccgtttttggcatttttgcctttgactcaccctaagagcgtcaaacggcagcaacagcaatggcgttggactccgcaacagcagcgctgggtgccaataaacattgcgaatgtgaacattgctcagaatggataagcgcactgataaggagccgaaccgaccgaccgatggacggacggagacgaaaactgaggacaaaatgccaagaatatgtgtgatcagtgacaaattcaaacccaatgccgcgccctttcgattgccaaagtgcaaaaatgccactgataaataaacaaagtgagagcaaaccaatggaattttagcaaaaatggagaatatatccttgaaacacagctgaaaatgggttagccaacagctgctgatgttctaattttgtgaaaaaaatcaaaaagttaaattgacaaaaaattgtttatattctgaatgttgaaattgaatatattttctaaatttcattacccaattttaataaatttattcattggaaaaggaaatttatgagtcataggacagtattttacatttttatgtccttcaaagagcttcatttttggtatttcagtctttttcggcacttttcttccagcaaaacaaaaagaaatagaataattatctttaccggatttttaccatttttccaaaagatgacctgtaaaacggtaaatttatcgagctttctagagcgaaaaagctggttaatttggggtaaatggtaatttttgaattttattaatcaaattaaatttaaaattaatatttttgc

SEQ ID NO: 40712 - DNA, 1361 bp, Heterodera glycines
  misc_feature (84)..(84): n is a, c, g, or t
aaaaagcatgaattacagtgtatgaaaattataatagaaaccaaaattccaaaaacacaataatttatttaaaggttaaatttnaaaaagcatcgaaggaaattcaagcagggcaggtggagtttatcatgaaattatatggaataatagcataaaataaaattgaaaatgctgatgaaaataaatgtaaaagtaaataaaaaataaattgactaattccatcatttttatctttgaaaacaattttgtccagataattgaattaatgtataatgaaaatttaaaaataataaacattatttgaaactgagtaataaaaattttttatagtaagacaataattatttaaaaataagttcacttttaaaataattttttttgactgattaattgatcagaaagatattgatgaaaaactttaaacgcaaaaaatcaaacaaataactaaattagtaagaaaattaaagtagatcatataatttatcatgataaatcttctatcattgatttaaacaaaaaaatatggatttttccttatttcctagaaagtatgcattgttgattgaaaaacgttatttattcgattaactaatttaatcaaatttatttcctacttaaaataatgtttctttttaaaaatatctttatgcattgcaaatttatttggtgaagaaaaaattttaaaaaagttaagaagcgagtcgccgcacagcagggtgctggctaaagggcctattggaacgctaggagcagggatggacgaaatttcgtgtcgttttctttcgtcctacatttattttcgttcattgcgttttaaataaacctatttgttctcttcacttcatcattttattttcttctatcgtgtcctcaatatattctttgctgatttcaagcaaaagcgagttttgttgcaccaaaattaatataaaaaaattcgtgtttaaaaaattggttttattaaattattttcaggtaaattttttttcgaataaagaaaattttgaggatagttttttgtgtgttagcaacttctaaaaagtaccatgtattataatttaattcctaaaagtttagatttttaatttgataatgttattaactgaataattaattagtatggcttatatttatagtttttcaaaaaactataaaatttttgaaaaaaaaactattttcaactaccttggcgttttgcccaaaatttgttaacaaaaatgaaataaaaacgaaaaatacactccctaataatcgacttaatttttttcaaaaaatacactcctaagagtcgaccccaaaattttcaaaaatgcacacataagaaatgaaaaaattctcaaaaattcatctccaaatttatt

SEQ ID NO: 40713 - DNA, 1027 bp, Heterodera glycines
  misc_feature (1012)..(1012): n is a, c, g, or t
tgctagatattttcacttttttgtcggtaacgccggacacagcttataaaattttaaatttttaacgaaaaaatattcaaaaatctgattttttacaaatctgatatgtagcagtttccataaaaattgaaaattcctggcgtccatcggtgccatcatttgtttttccattccaatttattggaaaatttttttataaaaaacaacgccattcgggtttttacaggaacttcttcaacaacggtccgttgtctacaggtcaaccgaacaatatgttggcatttattacccttgtttgttaattcccttttagtaacactgtgcacgcaatggaggaattattgcgggggatgaatatgtacaaaatcggatttacagaacccaaggggacggtaaacggtgtgccgccaattaaaagatgtcgaccggacattaaggaatgtgcgagagttgtgatggagaccattcggaacggggaggagagcgagccgttcagcgacgaattggcagccgcaatgaagcggctgtgggcggacccggcactgaacacggccacttactcacgccgactcgaattccatcttcacgactcggccaaacagtgggaccaggcttatttgttagccaagactgactaacccattgcccaattcagcttcttagacagtttggatcggatcagcaacccctcctacaggccgtcccagcaggacatccttctgactcggatcaaaacgacgggaatcgtcgaaattcaatttctaatcaaaggcgttccgttcaggtggaccttcggcagagaagcggacaaataatgggaattgagtaatttttagagtttttgacgtcggcggacagcgatcggagaggaaaaaatggattcactgttttgaggatgtcaattcggtagggatttcgcaaattaatttgcaatggtaaaattgccaaggtgattttcgttgcggcatttccgagtatgccaagtgctgtttgaagacgagaccaccatcgnatgatcgagtcgatg

SEQ ID NO: 40714 - DNA, 1233 bp, Heterodera glycines
  misc_feature (144)..(144): n is a, c, g, or t
  misc_feature (164)..(164): n is a, c, g, or t
taattcagtagaatcagtgcccatctctgtagacgagacgctgaaaaaatcgggattccgtttttggacccaaaaatccccagcaaaggacggtgatcagtgcgtaaaatgaattttcgaccaaaaatatattggtggaatttntgaattgcaaaaatgagtcncagtccttccttctcaatttgcgagtaattttgttccgtctttgataatgtccgggcagcgtgttgaaaaactttttcttttccgtccggaaaacggtgagaaattgttgcgccgattcctttgttgctggcgtcagctgtgacaataattggcaaatgcgggtcataatgcgttaatgctaaatcggataaaaggattgcttttgcttgatcgaaagcttcgcggtgcttttcattccattgccattccactccctgtttgagcaactcatccaatggtgctctgatttgatggatgtttttgatgtactttccacagtaattgattgccccgaggaatgatcggagtgttgtgatgtccgtcggtggtggcatttcctgcagtgctcgtgttctgttttgatcaggacggataccatcggacgaaacaatttgacccaaaaatttgatttccttaactaaaaatttgcatttgtccatttgaattcggaacccgaattcttgaattcgcttgaaaaatttaaaaattgttgaaaaatgttcgttcactgtgcttgaagcaatgatgaaatcgtccatataaccgacaacgccaggaattccgcttgccaattgatccattgtccattgaaaaatgcctggtgcacttttgattccgaatgccagtcgttggcattgataaagtcccttgtgagtgttaacgcctaaaagttgacgcgactgttcatcaacgctaatttgcaaataagcgtccttaaaatcaatttgggaaaatatttttgctccgtttaattgagcaaaaagtttctcaggccgtgggagcggatgatgatgtggttcgagtgccgcgttgagtccggtgctaaagtcgaaacatatgcgcacttttccatttgctttgcgcactgccacaattggtgcggcccatctgctgtagtcaacttttttgagaacacccaactcgatcaatctgtccaattcggtgtcaacatcattttgaacactgcaagggtaccggacgtgtcccacagaaaaccgaagaggaacttctcctagagtctgtagttgt

SEQ ID NO: 40715 - DNA, 1165 bp, Heterodera glycines
ggagaagcaaggggctgtgctggggcctaaaattgggccacatggagaataattctgattctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgaggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggtttaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgaggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaaggctgtggctgggggcctaaaatttgcgccacattggagaattaattctgatttctgataaagacccagaaataactattgtttctttccataccttcttgaagagctcgagctgctct

SEQ ID NO: 40716 - DNA, 898 bp, Heterodera glycines
catttcaatatcgtgtgagtgtttggtagagccagactagagaaggcaaatgttggtaccaagtttgcggtcaaatccccaggagaaaaaagagagccattttttcggcaagaatttttttcgttagcatttcaaatatcgtgtgagtgtttagtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaagagatagccattttttcggcaagaattttt

SEQ ID NO: 40717 - DNA, 1337 bp, Heterodera glycines
  misc_feature (10)..(10): n is a, c, g, or t
  misc_feature (1208)..(1208): n is a, c, g, or t
  misc_feature (1253)..(1253): n is a, c, g, or t
  misc_feature (1274)..(1274): n is a, c, g, or t
  misc_feature (1293)..(1294): n is a, c, g, or t
cgagaagaanaccttttttcacagagcaaaacagtccaatgtattgccaagcttgatgcagatttatttaatcagccgctttatctcgtcaatttctgtgagttggatattgaaattttgccaaatagcagtaattttctgataatagtgggtaacgcagcagcagcggctacgcgctaccattttgaaattgtcggattgaaaatgtatgttaagaaagtgtcattaatggacggtctagcattggacattgcacggaaattggaggtgaagcccgcccggtacgctgtgcgaaagacaatgatgaagtcgttgttcattagtcagggacgatttgaatttaatgcgaatctgtttatggaccaaatcccccgtcggataacgttgggtcttgttgcaaactctgactatgtcggagatcctcggcgtagtccttttaacttccaaccattcaatgtgcgtgagatttccatagttgccaacggcagagcattcccgcaggctccgtactctttggactacccacggggaaaatatgtccgagcattcaacgacatgaacgaggctgtaggcttcagcaacacaacagaaggtaacggcataataatttggtacaacccattgtatctacgttttcaatatgaccaacagtggagatgatcaacccgggctttttgacttgatcaggaatggaacaacagctgtgagcattaaattcaatgagggcgtgcccatcggaggaattgtactggttgtgatgggagagtgtgatgctctagtgatgctggataaaaacagatcgatttcaactgacaccaccatttaagttttttcataagaaataaacatgaagaactcactttcttttgccgttgttttgttgatcgttctaattcaacaccaaaccctaactctcattgttgaggagggagtaaagccagaaaatattcctcactataacgaatgggcgaaacagcttgggcttaaagctaatttaaacaagacaacaaaaaccaagaatggtgtggcagcatcaactgtaaaaactacaactgtaaaaacaaaagtgggcacaacatcatcaaacagtactaccaaaggcacaccacccaaagctgcaaaacaattttcagatttaaatgcccctgtttcaatttttccgggaattcaactgtgtaaggacatgccagctgctgataattacatgnggcacatcttctgctgggctgtgtttgcactttatgctatgatgnatgtatctctgatcatttatncattacgctcgatactttnnggataaacacggcatcatgagaaaaaacacattaaaaattcaa

SEQ ID NO: 40718 - DNA, 866 bp, Heterodera glycines
taacccccgatgcataatccgttccggagagcctcttcaaaattttttccattaccctaagagctgcggcaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaccccgatgctaatccgttccggagagcctcttcaaaattttttccattaccctaagagctgcggaaattgtgaattaattctcagaaaaatggctatctctttttaggacaattttctatctcgtaaccccgatgctaatccgctccggagagcctcttcaaaattttttccattactctaagagctgcggaaattgtgaattaattctcagaaaaatggctatctc

SEQ ID NO: 40719 - DNA, 915 bp, Heterodera glycines
gtgatgaaatgttgtggggtgtcccagtgatgaaatgcaggagaattgagtgccagtgattggaatgctggtgggttgagtcccagtgattggaacgcaggagaatagagtcccagtgattgaagtcctggagggttgagtcccagtgattggaatgcagtgcagtagaacagagtcccaatgactggaatgctggtggattgagtgccagtgattggaacgcaggagaatagagtcccagtgattgaagtcctggagggttgagtcccagtgattgaaatgttggtgggttgtcccagtgattgaaatgcaggagaattgattcccagtgattgaaatgttggtgggttgagtcccagtgattggaacgcaggagaatagagtcccagtgattgaagtcctggagggttgagtcccagtgattgaaatgttggtgggttgtcccagtgattgaaatgcaggagaattgattcccagtgattgaaatgttggtgggttgagtcccagtgattgaaatgtggtgggttgagtcccagtgattagaatgctgttgggttgagtcccagtgattgaaatgttggtgggttgtcccagtgattgaaatgcaggagaattgagtgccagtgattggaatgctggtgggttgagtcccagtgattgaaatgctggtgggttgagtcccagtgattgaaatactggtgggttgagtcccagtgattgaaatgttggtgggttgtcccagtgattgaaatgcaggagaattgagtgccagtgattggaatgctggtgggttgagtcccagtgattgaaatgctggtgggttgagtcccagtgattgaaatactggtgggttgagtccccagtgattgaaatgttggtgggttgtccccagtgattgaaatgcagggacctgca

SEQ ID NO: 40720 - DNA, 969 bp, Heterodera glycines
  misc_feature (937)..(937): n is a, c, g, or t
  misc_feature (949)..(950): n is a, c, g, or t
ttattcaatttttaaaatttaatatttgccggcggcgaaggccccccacgaggccgcgaagaggccgagtgagtaccttcggtgcaggaaaatattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctcccccataattgtttgagtaccccaaacagagacactntgaaaaaatcgnnatttttttgttttcggggc

SEQ ID NO: 40721 - DNA, 282 bp, Heterodera glycines
cgctgacccgtccccgattttgtcctctttgtcatgcttcaatgtcaatttgattccactgatcatcactttcccattcaatcgcttccttttcccattttgtccatttgctttcgtctcgcgcaattggacaacggacgaacagaaaacgatggctattggaaattcttttaagcgtcaattgtttttgagtaaattcgttggtctgatcaaagggcataacggagtcagcaaagggccgcggaaaccaaacggaaacaatgaaattggcgggggaagaag

SEQ ID NO: 40722 - DNA, 1027 bp, Heterodera glycines
tagaaaatagtcccatataacccaagacataaaaagtgcttttgcgcaacatctcccctctggtgtctttcatttagaaaaggcactgaaccgtatacaaaaactctcacattctaaaataactcagtaaaaacagcttttaattttaattgttctgaaaccaataattttatctgtagaaaatagtcccatataaaccaagacataaaaagtgcttttgcgcaacaatctcccctctggtgtccttcattttagaaaggcactgaaccgtatacaaaaactctcacattctaaaataactcaattaaaacagcttttaattttaattgttctgaaaccaataattttatctgtagaaaatagtcccatataaaccaagacataaaaagtgcctttgcgcaacaatctcccctctggtgtccttcattttaggaaggcactgaaccgtatacaaaaactctcacattctaaaataactcaattaaaacagcttttaattttaattgttctgaaaccaataattttatctgtagaaaatagtcccatataaaccaagacataaaaagtgcttttgcgcaacaatctcccctctggtgtccttcattttaggaaggcactgaaccgtatacaaaaactctcacattctaaaataactcaattaaaacagcttttaattttaattgttctgaaaccaataattttatctgtagaaaatagtcccatatgaaccaagacataaaaagtgcttttgcgcaacaatctcccctctggtgtccttcattttagaaaggcactgaaccgtatacaaaaactctcacattctaaaataactcaattaaaacagcttttaattttaattgttctgaaaccaataattttatctgtagaaaatagtcccatataaaccaagacataaaaagtgcttttgcgcaacaatctcccctctggtgtccttcattttagaaaggcactgaaccgtatacaaaaactctcacattctaaaataactcaattaaaacagctttta

SEQ ID NO: 40723 - DNA, 645 bp, Heterodera glycines
aaatctcttttttacctcttttttttatgggaccagtaaaatcgatgattacccaacaacagcagcaaaaccaagaagttcaagcagtacaacaacaacagcaaattttgatgggaaatgagatgaagatggacaacagcaaaaatggagaaacaagggaagaggagggaaatagcattggggaaggaggagagacggaagagaaagagaggaaaaggaaaaattcggcgcaaaaaggaggagagaatgaagctgaaaagagaaaagaacagcagcaaatcggcacttaatgttgccggtgctaattgctaattttgtgtgtcgtaaatcccgcgtcaaaatcccgaaaattaattgccacaattttcaaggagaaattcatacattcgatagatagcaagccatttttatacatccgatttatttatatatatttgagaggtttttcttcataaaattgcatttgatcactgatttgaattatgatcgatcgaccattctcaattaattaattcatttctttcttatgcggctgatcactgtttttgttgttttgtccgtcactcatttgtcagcagacgacgccccctttttcgctgctttgtcccgtttcttctgccagtggcggagacaatggccttaatt

SEQ ID NO: 40724 - DNA, 995 bp, Heterodera glycines
aaaaatgtctatctctttttttggcaatttggtaatagaattctctttggaaacaatgacagtggctgtcatcaggtgttatgctctaaaaatgattttggggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtggggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtggggtatggacggaacgaaaaaaatggctatctctttttttggcaatctggtaa

SEQ ID NO: 40725 - DNA, 907 bp, Heterodera glycines
ttttcctgctttgatgttttccgtgcacaccgattcgctcccaagggtaccccaaaaccagctttcttcgtcactggcggcagaagctgaaattatacaaaaaatgggacgaattttgcctgaatcacgcaatttttttttgaggcttccccggcataaaattataggtccaaaatttcaaacaatttaatttttttgtgcacttggtaaaaaatattagggtatctgaaaactaaaaatggtttgaagtcggaaaaatttttggaaaattcctatggtgcggggcacaaatgatccgggtcttgcgggggacgaaaccaattgggtagcactgtttttcgacaaaaaaatcgtcataacttctgccaaaatcgacaaaatttaacatttttggtatcattcaatagcctttaatattctctatttccttgcaaaatttacgaaattttttatcatatttgaacaaagttatgggcgacaaaaattttcttgaatttcgcataaatttatagagaatctttaaggctgggctattcgaatgatattgtaactttgtcgtcttcgacaaaaatattatagcgtttgcgtttttttttttgacgttttaccctctcaaggggtagaaaaccgaagcccaacggaacgggctctaattgagaaaatatgggcaattttcgttttttttgctagccgaacctccgttttgaaacaccaattttggcttgctgctatgctgtgggaccaactggagcatggaagtgcaaaaaaggccattcaaagtgtgcacaagtcgtgccaatttgcgttcatcatgctcatgagtttcggactgactaaaggtaatgagagtaataatggcattttcaggactaatttacgataattagtcaaactggattttgactac

SEQ ID NO: 40726 - DNA, 601 bp, Heterodera glycines
  misc_feature (20)..(20): n is a, c, g, or t
  misc_feature (50)..(50): n is a, c, g, or t
acaatttcactttttggccncattttttatctctttccctattccatatntaaatggcccccaaatcactcccaaatcattcccaattcacattcatttcacttttacaggcaatcaatgcctatccctttgcccgctctcacacactctctctctctttctccctttgcccatcctcggaccacttttgaccatttcttttcctggtccctttctctctttccacctttttgcacttctcctggcccaacatttgtcccacttggattgtcccggtgaatcccgcatttctgtgattatccccccgacggcccctctttctgtgattgtgatcatttgtccccccggtgatggcgcatttcatttttttttttttgtattgttcacatttaaatatcggtttaattacccaagtttgagtttgagagggaacaataaagcattattttgttgtgtgaattgtgctttcgaccaattgcccccgacccaccgaccgagcccatctgccccaaccggtccccgtggcactaccttgtgcaaaatttgtggaggtttccacaattggcgctcctgagtgggatcttcgtccgccaacaacagc

SEQ ID NO: 40727 - DNA, 852 bp, Heterodera glycines
gtcctcgtaaaaaaaatttgggggcgatttgaatgagaatagctttagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacattttttataaaaaatttaaaaatgagaattcatgcgagattttctggaaagaagcttaatatggcctagttaagctgtaaaaaaaatttggggcgatttgaatgagaatagaaagagccaggttcgatgaagttttggtaagccaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatg

SEQ ID NO: 40728 - DNA, 997 bp, Heterodera glycines
ataaccgtgttcagcgacctcgaaaacccctaaaaatatgttttccttttattttggaatttggatttttgttcgaattggtcaagtttttaagataattttttcgaattttttaccgtttttcttaaaatataatcattcatttaaatactccaaaatttcttcttgaaatagtttctttcattttgaatcggtttatgaattttcaggatttttgaaataaatgatttttgttgtagtgttttctttttgatccgctttgacccttttgttgataaaaaataaaaataataaaataaattatttcatttcaattggaaataaatatttgtaaactaaaacaatttgatgatggaattataaaatttttagctatattatttaataaatgaagaaatgagaatttattgctttagattacttataaaaagtcaggacgaatgaaaaaaactttcattttagtttcacccaaatcagaattatttttatttaaaatctttaaaatctaatatttaagggttgtaagggttagggtatttaggcaaaaaccgggttcgggtattaccgggtccagaaaagacgggtccgcttcgggtttcatgtttttaaaccgatccagtgtccgatacccggtaaaaccaggtattaaaaaaattttgaatttttattttttttcaaaattataatttaacagaaaattttttgctgtaggaacaggccttgcgccacatgaaggaacgacagcagctgcaattgcagcaggaagacatggaagctgactggtacatgcgccaagcacgaggagacgaggtgggtggtgatcggatggcatgggacgttgaccaggatgcaattttatttatggacagtttgacgagactatcggccaccaagacttccggctgattcaagccgatccggggcttcattcgcaaaaccgcatcgcaatgaccagacttcagccgcagaagccagcagcgccatgatattgcatttt

SEQ ID NO: 40729 - DNA, 1082 bp, Heterodera glycines
tgttggctgtctatggtgctaagtgggcaacaaaagttagtatatatcagtgcaaagtagtagaatggagccataattttttgcattattatttcattaggatgacacgcatattgtaaagcggcgtcagtgttcagagctggggggggggggggatgagtctcgggattattaacttccccccccccttcctctagggcatacagtagtacctgggttagactttctactgtgttacggtaagatttttcaaatttgaggacggcaaagtgaagcgaagtgacacgcgagaagaagccgatgtttatgaggaggaggaggccaagtggggggaagagaaagattttttgcaactgtcaaccaacggacattttgaagaaatgggtaatggcgttttgatgaaatgggtagataatttgtagaaataggtaatggcactttgaagaaatgggtaatggcattttgaagaaatgggtagggttggcattttgaagaaatgggtagggatggcattttgaagaaatgggtagggatggcattttgaacaaatgggtagggatggcattttgaacaaatgggtagggcattttgaagaaatggataatggcaattgaacaaatgggtagggttggcattttgaagaaatgggtagggatggcattttgaacaaatgggtagggatggcattttgaacaaatgggtagggatggcattttgatgaaatggataatggcaattgaacaaatgggtagggttggcattttgaagaaatgggtgccgaaatgggtacggaattttgatgggtagggccgggggtaggaaactgtcgtaaatttaaaatttggaatttgttggcttaggaaagcccaacaaagcccaagaacatctcctgttttatggttttaaaatttaaataataaataaactcttttacatttggcgtattgtcattcaggtttcaatgcaaaatttgcgaatttaaaattttctaaccaattttaaattattttttatatcaaaatttaatttaaaataaaacttaaaataatttttaaaatttttatcttaatttatcaatttta

SEQ ID NO: 40730 - DNA, 1143 bp, Heterodera glycines
atgacatatgaaattgaaatgccgtttctcatttttgtgcaaaacaaatggcgaaattggcgcaatataactacaatttaaatattttccatctaagttttattattatattgcattttaaatgattgtttaggcgcagttaataaatttaaagttgtactgtaattagattaattaattatataattgctttgtgttgtccgttccttcgatttcctcccctccttcaaaatgttttgccgttatcctttcgctgtgcttttgcttttcggctttggcattgtttgtgccaatgttcggtccgatttatctgaggaagacgaaactgatgcttttggtcccccccccccccccccccgccttcaaaattttgaaaaaaaaaaataaaataatagaagactcagcattttgaaatttttataacaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaatatttattcatctccctttttgataatataagagtcagagtgccttattcaacttgtaaataaattttggatcgcgtttcagagcagtttctgaaaaaaaatttatgaattaattttgcaaaaataaataaataatgaacaagctaatgtgataaaacaggttaattcttttcctttcagtatccctgcaaagtttggggcgcttctgataagtttctgaaaaaaaagttaagcctaaactttttggcctgtttaaaaaggaattaaaaatatttaaatatttattcatctccctttttgataatataagagtcagagtgccttattcaacttgtaaataaattttggtgcgtttcagagcagtttctgaaaaaaaatttatgaattaattttgcaaaaataaataaataatgaaccctcctccttaataattttcctgcgcccaagggcgcactcagccgcttcccttactcgtggtgggccttcgcccccccccgacgctgatgccgatgaacccccaccaccacgttgaagccgatatttttacggatgaagtccaacaccaccgga

SEQ ID NO: 40731 - DNA, 879 bp, Heterodera glycines
caacggtgatcagaagaggtacaccagtgatcagaacaggtacatcagattagaagaggtaaactttgattagaagaggtggaacaatgattagaagaggtacagcagtgattagaagaggttcaacagtgattagaagtagtacaacagtgattagaagaggtacaacagtgattagaagagatacaacagtgattagaagtagtacaaatttgattagaaggggtacaacagtgattaattagtaaattcattaaattaaaatgaaaatattttttaacaaatttaatttaaaaaaatacatgaaattctatcaattaaaaaaataattaatttaaacttataaaatgtattcatcaaaaaaaaaattaatttaaatataattttttatttattaactcaacaaaatattttaaattaattaaaatcattgaaaataacgtaaaaatgcacagaaaaataatgttacaccgtccggactcgaactttgcccccccccccaaaaatgatgcctcagaatccccaatcacacagggattctgagatcttgacgatgtcaaaagtaaaatctgatcacgtattcgtgatcagcggcccaaataacgcctaaagacatgtttttggaagatttttggtgaaaattttttttcacttaaaaaccatgtgcacccccctttggtcccgaagcccaaaatcacttttatttttatatctttttttaaagaagtgataaaaataccaaataaattttataaaatagagcaagaaattgcggattttagtattattttacttttccaaaataacttttcagaatcgagttcagaatttttttctgaaaattcgaatttttccagaacttctggaataacttttttt

SEQ ID NO: 40732 - DNA, 1016 bp, Heterodera glycines
tccatattttagcaaattatgtaaattttatttttaaatatataattttcatatttgtcgatattttgaaaaactccaacaattttaggcaccaaggagtccagaaattaaaaaaaatgacccaaatgctaattttggtgaaaatttttggctagaaatggtttgaaaaaatgaaaagccaaaaaaggcttaaatctggaaaattttcaaaaaaaaatcctagggggttaggaaaattttctgtaaaaaatgagtatgcctgccaaaaagagcacaaaatactctctaccaaattgattttggtttaccagaaaaaatttcccaaccccctaggaatttttttcgaaaattttcacgattttcagtgtattttaggatgttcagatcaccatgaaggagtgatctgaccatgttggtcaaaaagacttttttgatcaggaccaagagaatgattagcaggaattttttaaaaattcctttttacttcttgacaaaattttcattaactgttttttcagattttttttaatgatttcattaattaattcaattggattcaaaaccaaatttactcaattttaatcaattaaacttaactgatgctattaatgaattaaattggattcattccaaattaatcaagttcaatcaattaattgagcaaattaattaattcattaatcgatttttatataaaaataaaaacaatatttatcaaaaaaatattttagaaaatattcaaaaatttttttatccatttaacaattattcgattattattttttaattaaaatatttctcaccgaatttttattgctccgccgttgtttgccacatagctcagcggtgggggtagaggtggtgaaaattctggcggcgcctgcgttggcctgaaaaattgacttgttatttattttatcatgtaaaatttataatttcaatttttgcaaatcaaatttcattttttaccacccgcccaaaactcacattggccgcgatccgacgagacctccttg

SEQ ID NO: 40733 - DNA, 1380 bp, Heterodera glycines
  misc_feature (1297)..(1297): n is a, c, g, or t
tccctaattggcattcattcgtttttctattcaattaaaattaattttgtttttaagggcgcttttctcttcgccgttctgctcaatttcaagcacatttttctgtattattcgcctgcgtttgtcgccttttatctcttccgttttttgtttccgatgggtcgccaatttttgcgccgctttttttcgctcgcttctgttgttggcgttgtgtccatcgcttcgtttggccccttctttttgatcggtgaattggaattaaatgtttgacattgaaaaacattttctgtgttgttcttatctgagaattttgtgtcagtgggcgatgccgagatgcgccacttggaaaatttgcaaaaaaaaatttggagaatccaagatatagactcgcgttttggcctattttcccgttttcctgaccacaaaattctttttactcccctctaatagagccaccaaagtaaaaattgaatgtttttttcaaatttataaactgttttttagttttaaattttcagatggttttttcgccctccggcacattttggcgcgtctgttccccttcaaacgtgggcttacccacgcttgctgggcaccaaatttttgggcactttacaattttgcggatttatttgcgcataaaattgtcgccaaaattgtgtcatcgacaaattgcagcgcgtggcattggctgttgaagcgctgcccgcccggcacgcccgactacacgcgggggcttgttcaggtgactgactcggcacggattggtcttttttatgccatgcaaaccgaaatgccatgttaagaattgcaaacaattttctatatatttcaagggaaaaatggttttccataaattttaaaaatttaagttttcctgaatacgataataagaaaatttgagtgggtggggtaaattttaagcaaatgctttttttgctaaaactaatgggttttaaataaaattaaaaaaagaatttttgcgtataaagtcggctttaattttaatggttccccatttcacacaaattaaattttcttttactcacttttcacatttcctttttacacgccccactttatttatcagactttggcaggaatatgagcacgccgttttgccaaacatcagtctttttaagaaattcggaaaaccgccggacgaatgccttttgatttcgctgaccttttccgcctttgccttcttttgattcggttggcatgtccatgaaaaggtgctatgtcattatttaaaaaccatcattatgtgcgttatttaaaaaaaggggcggaatgngcatttttgcttatggctttgctctaataaaaggcaaatttttaatccggtgttattattcgagtagatctaagactatagag

SEQ ID NO: 40734 - DNA, 1169 bp, Heterodera glycines
  misc_feature (89)..(90): n is a, c, g, or t
ggggtatgaaaagtttatttgggaaaaaaagactttacaaaataatacccctgggagaagggagtgggaaacatgatttcaaaatttcnnaattttttctagtctaatctactcaaaacggctcagaatcaaataaaaaaacattcacggtgcgaaaaatggggttgacaaagtttattgggaaaaaagactttacaaaataatacccctggagaagggagtggaaaacatgatttcaaaattttcaattttttctagtctaatctactcaaaccggttcagaattcaataaaaataacattcacggtgcgaaaaatggggtttgacaagtttattggggaaaaaagactttacaaaattatacccctgggagaagggagtgggaaaaaatgatttcaaaattttcaattttttctagtctaatctactcaaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaactttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcagaaattaattcataaatattttttcagaaagggttctgaaacgcaccaaattttatttacaagttaataaggctctctgatgctttttctatcaaataatggaggt

SEQ ID NO: 40735 - DNA, 945 bp, Heterodera glycines
aaaaatcgattttttcaagtgtccgtttggggtactcaaacaattatggggagcaaaaatcccacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctcccccataaa

SEQ ID NO: 40736 - DNA, 630 bp, Heterodera glycines
tagagcaaaaccagtttaaataatatattttacatgaaaagtttaagcatttaataaatatttttgtaaaactgcagctcttcaaataaaaaacattaatattaagaaacaagaaattgattactgcaatgataaaaatattgcaaaaaaatactttaattaataaaattaaacccatatttcttataaattatactaatccatgaaataataattaaataattatgtttcaaataaaagtaacaaagaacaatgattctggtgttcgtatgggattgacatgataagtattctcaaatataacaatagaatttttaaaaattaaaaaatcgtatataaattattaaaacgatttccaatgaaacatcttaatataattctgttatttttgatagctatttgccaataaaagcaaacacagcaaattgcaatcaagccttgctccatggaggagcagaaaactttcgtgctgtcaaggcttgaagacgacaactttttgatcgccattgttcagaaacacccccaatgggcaatgcagatatcctacaaactcttatggcaatttaaatgagacatgagcacaataaaaaaaattatacgtttgacaaatcaataaataattttcatcaa

SEQ ID NO: 40737 - DNA, 828 bp, Heterodera glycines
atttattggacattattaagcggacgaagagaaagaagagaagagagacaatgagaaagagagagagagagaaagggagagagagagagagagtggaaaatggagagggcggaaaagaaagagacaaacgaagaaaacgaatttgaacaattagcagagaataaacaatgaatgaatgccaaacaaaggcaatgccgaaagcaaaagcaaagacaaaaaattgccaaatgacgaagcataattaattaattaataattaccaagtgattaaacaaagcacgtgattaggcatatatgaattgaataaaaaagacagaaaacatttgtcaaaaggtcggacaaaaattgattgataaaattgtcaacaaaaacataccgagaaacgttagtgctgtcggcaggggtggaccgatcaattcgccatgagacgcaggcgccacatgtccctctcctgctggggctctcccgtttccgcaccccctcttccgccctccccctctgccaaatcctaccctttcctccccttcccttatccccaccacatatctcatattagaggttaaaggttcaaaaaatagtagaaaacatttgagaattttatgcactgtatttgatatctctatcaagaacataagaaaagttattcctatatttttgcaaattttcaaattgtcaaaaaaaaattcactactcggttctgacaagatattttgcaaaataaaaatagcccatatatccgctattttttgctttatttgataaattttatttcatgtttttatcattttttagtaaaaggttctaaaaataaatagtgattttgaaatt

SEQ ID NO: 40738 - DNA, 822 bp, Heterodera glycines
ggggatccgtcgcttgtcgtctggggacgaaccggttctgttgcaaagttgattaaagaatagagaaatccagataaaagttctctattctatgtgtattattaggcaaattttataattcattatccgttgaaaataggaagaggctcgattgtattctttatagaggtcagtcgttttcagttatagaagtgaggggtccctgtccgtcgtattcgaggggttgcgtatagaaggagggagggatcatatggagatcggagagaggggtgtccgcggccgtagatttgagggggtcccattcgtggtagtgaggggttattgataaatcggagggatcggccagcgatcagtcagacaattgatcagtcgttgggccaaaaagtgatcagcaagtgaagacagggccaagaagtgattggcaatcggagacagtgcaaaaagtgattggtaatcgaagacaagactaaaacttgattggtcggagatcagctaatggccgccgagccaattggtcggccggtgataattgaaaatttgtatgtatatttttctgaatttcggcctccttttgccctaaagaaatgaaatttgagccaaatatttgggaatagaaagagccctcagacttaaatttaaaagaaaaggaaactaaaaatttaaggcattttctttaaatttcactaatatttccaaacaatttccccaacaagcattaaatttcttagatttttttcaaattttgcccttaaaatccataaatttgccatttaagcaaattattttcaagcctgtgttacattgttacatctgaaaaattgc

SEQ ID NO: 40739 - DNA, 1369 bp, Heterodera glycines
  misc_feature (28)..(28): n is a, c, g, or t
tgttctttttttgtctataaataatttntggttgatcagattttcttaaaaaacataaaaatcgaaaaattctttaatggactatttcctatttcaattttcatttttaattcattcctttccctcatcaattagtctatttcccaaaatcccccctctcgcgctaattggctaacattcggcggttgctgctggcgaagtcggagttgccgaaacggaccgcgcaccaaaggcgaacaactgctgttcgtgttgcggtgttgcggatggagtagcagcagcagcggcaatgaattggggcatcagcagagaagacggaccaatttggggggtgccattgaaatgtcggggacggacagcggcagacgaagagacggagcagtccaagaaaaacggatttgaggaggaggaggaggaagatggagtagcagcaaaggtgcttaatgtggcatccaattaagtactaatgagacaatttatgtggggaattcgtgttcaaattttgatttttaattaaggaattgcttcaataacagggcctttcccaaggcgaaacaggcaaattattctgaccttttagttaagttcggataaagctcaaaagcagatttgtcaaaaaacccaaccaattgatttcttaaatggaccaaaattaccaagtttgtttttttgactttttttgtccaattttccaactccacaatttttttttgtcgtttttgccactattgcccacctcattaattaattaactgctcattttccatggcttggctctaattaactcctgattttccatggcttggctctaattaactcctgattttccatggcttggctctaattaactcctgattttccatggtttggctctccaacctgccattgttctgctgctgctgctgctgctgttccatcatcatccgtttgatctgctcaatttgctgatttcgctgcatgatcgccgggtcttcgaccatcatcaagtcaatttgttgagcttcaacaacaatgccatgccttttcgcctcttcctccataaatgtttttctattgatgggggagacaaattatcaaattgttttaattacattatttagaaaaatatacaatcaggtattatcataattaactatttgactaataagccaaaaatacacccaaagactttattacttaataccctatggttttgactaattgaactttagcaatatcaatgaatcaattaaaattgcctcaagcatatttctctttttgcggtggtgtattattataattaaatgaagggaatcattaatataaaggaatggattttaaaaaatttatttgcccttgggcaattttaacagaacactcaatcaaaggg

SEQ ID NO: 40740 - DNA, 649 bp, Heterodera glycines
aaaaaaaaaaaatggtttttttaaaatgccctttggggttcccaaacaattaggggggcaaaaaaatccaacccaaaattaaaagtccaggctttggggaaagttttcccgaaggattcggtttcccccataaatttggggccatcggtttgggggggatgccccgaaaacaaaaataaatcgattttttcaaagtgttcgtttggggtacttcaaacaattatggggagcaaaaaattccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaactccaacgcagaattaaatttttggataaaaattatttaaatgaactgactagataatattaaaataggttattctcttccttt

SEQ ID NO: 40741 - DNA, 1058 bp, Heterodera glycines
  misc_feature (913)..(914): n is a, c, g, or t
  misc_feature (1023)..(1024): n is a, c, g, or t
ttttctctttctctgtaaagaaatagtacgccaaaataatagaaaagtatttttctctgcactatttatttattgacacatttctcgttttttgactcggtgtgtacaagtgcgattgagataaagcaaatctcacaaaaaagattaaataccgaaattttgaattgcacggggcctggtccgggacttggaacatgcaaagagagagcttattacaataaaatttgattaaaggatttttagcaatcttcggatggaataaatatgataagatggaaccaatcaattcataaaatgttcgtagaatttcaaattttcaaaatttcgagagatctatcagatttgcattcacaatattgttccaaaatatgttagagaatgttgacaaaaaattttttaaatttagcagactaatagagaaaaagctgggctttcgaatggtaccaagaatgtaaaaaattttattgcaattaagcaaaattatgccatttttgtcgaaaaattcgctaaaattgcggatcttacgaaaccacccagcacggtatcaacacgccgggatagtgacttatagggacttaaaggaactcgaaaaacagggaccgtgtcccggattttgaaccaagactggtactgtaagccgggaaatttcctacctaaaataatgaaattattattcatgtaaattaataaaaaataaaattatttgtgcttggaaatcattttgaatttttttaatatgtaggctcgccagaaatggtaagtccacatttgcgtctccagcattcgcgcctggaacatttgcgcttttaggttaacttttttttaaatttgaaaatttatctataattgttatgacaaaactatttttaccaagtctaaaacttttgcttaaattaaataattaagaattaanntatataaattactaataaaaataaaccaatgacttggtttatatttatatttgctaatttatatttgctaataataaaacatggcggcgatacattattttaatattannatatttctctgtagcatataattgtgtaattttt

SEQ ID NO: 40742 - DNA, 1683 bp, Heterodera glycines
gcaaaacagggatttgaatcctaaatcaaaaaatggcttctgatcaaaaaaaattttttaatttcttctaaattaatactctttaaccctatttagttttttttcttttaaaatgatttcatgccatatttaactatttttgagatttaaagcttaaattaatagatttgaagaaattttaacattaatttggaaaaatttatgcgcatattttgcgatttttgtatgccgctagtgcatataattacaagttaaaattagttttttcgagtaaaaatgaaaattatcgtgccatttaattatttttttttacaatttttggccttttaaacattttttgcaaaatttaatttccatttttaaaataattaatgaatttggccgaaatgtgcggtaaaatgagcagcagcgaacgttcgtttgccctgacatttttcatttggggtttaaagcaaattaaaaatttaattaatgggtggcgtacacttttttaattgctccatttcactgcccacaaatgcattcattcttttaatttgatctaattgttctcccattattttttttcaaacccatatcatcacattcatttgttgcgaaatcgacaattatttattaatattttgcttttttaaggataaatttaaaaataattttttaaaacatattttaataaatttaaaaatccctttaatattattttacattttttaaaggatatttattttaaaacgaaaatttcaaatttttcttttctataattatcttaataaaatttaaaaaaaatttattcgctttttaaggataattacacattaaagcgaaatttaaaaataactctttttaaattagtttaataaaatctaataaattctttttcaacattttttaaatatttttgattgactatttttaatttatccttttttatttattgtgaaattgtggcttcaaaaagattaatctgttgtgtaatgctattagccaaaaaaagcactttaattagtgcattcatttccgcttcttcttctgccgtataagtaaagccccgttaatgtttacattgacattcttttcattatacaacaaacattttttatgacacgaaaagccacatttttaatttgaaaacatagggtaagagcagaaaatttcattaaaaattacaattatttttggagaaacctaaaaattttcgtttttatttttcaggaaattaagaattcacgcagcgatccctttcaatgtcattggactaattattttattttattttccaattttttctcaaaaagtattataacatgacgactaggattttttcgattcccgatcccacttttaaaaaatgagaccctgtcccaatttttttaaaatgaaattttggccccaatttttccaaaaaaaaattctgacgagatcaaaaatttccggttttgagcagttataccccatcaaaaatgtttatatgtaccatttttactgaattatagggcccctgtattagaagcccccccccgcctccctgtaaataaattccccgttaagggagggggttgaaaaatttgaagtccgggccttaatttttaaaataaatatggtacaataaatacacggctctattgcagttttgaccatcttcagtttcatagaggccataactttttttaaaatttcctaaaa

SEQ ID NO: 40743 - DNA, 951 bp, Heterodera glycines
tattggaaattattttagaagaaaaaatcacgataacgttaaatttactaatttttagcaaaaaatcaacccgaaaagcgaaattttcgttttttttgcttattttgacatgaatttatcaatttttaagaaaattgaaatttatttaatattctcgtgaaaattttgttaaaaacgattttttttgaaattttccggtttttggggtccaaaaggccaatttagctgatgggggccgttctaattgaggtttttgggaaaaatcccaaaatatggacaaaaatgggaaaatatggaaaaatatggaaaatatggatatggaaagtcatcccagaagcttcaaaccaagctaaaaacatgtttttcgtgcgtttcagacctcacacagtccaggaaaaaaatatggatttccatataattcccagccctacttataagttttgattttctccattttttctttctctgttattctttttctacatttcgaattgttttttccacccatctcataattaattgttcccttattcaaaattcgtataaattttttaaattttcttcctttctttttcgagtattttcttcttgttatattcttttcgtttttgaaaatgagacgaatttttacataaatttgtcttcaaattaaattttctaaactttaattaattcattttgaaaattttcttaattgaaattattatttacgaatcttatttgaaattttggaagagcattttatagttgtttttttcgtttttatctgatttttaaatgccaaagaaattgattatctttatccaattttggtgaaaaatatttttattctatgcatttataaattaagatacaagtagtattttcgaaatataaactcattaaattgtcacgctaaattcatgtaggcaaacaattttccactttttgaatttgaaaatttatatgtgt

SEQ ID NO: 40744 - DNA, 1556 bp, Heterodera glycines
atctcccatccatttccaccatttcattattttaatatttataaaaaccaaaccattttattgtgtagtaaatacacaacaatatcgaagcgcatactcatatttattaaaaaattaataatttgcaaattttgatatgattaattgaatttgataaataattcagataattttttaaatattaaaatgataaaaaaataaaaagttacactattattattaataattacaaaaactctaagataagcatagcaaaaaggccttggttaagaaaaagctcattaccattaaaagaaaaagcaaaaaaattattaaacagaacgcggacgcacaagtgtaaaaacactaaaagcgagagagacaaacaacaccgattgttcaaagagaacaaaatgcatgaaaaaaaactttgtgtaaaaaactagaaataaaatagaaagaaataattacgaataaaaaaactaataatcaaaattcactatttaaaaaaaatgatagacaattttttttacataaaaccttagaaaaaattcaataaaaatagtgtgaagactttttgtctactattataatttatatttaaataattaaaaccagtttctaaacatcttttctttagttatttttcaaaaatctttagtgagcttcttattaaaatttgacaaacattgaattcttctttaaacacacttggtgcaatataatattatcagataaaacttttaatgttttaacgtaatatctcttgatctcagacaagattttgattattttttgaatttggatattttttaaaattatttatttttaattaacgctcatatttttatgaatttatataattttaattaagttttatctaattgctaacgtgttttattttcaattaatgtatattttaaaaacaataatagctatatttagtgccaaatatagggattcgttttctttcagaattatgtttttgaccgacatttaaaactattttctttcgtataaatatgaattgctttattattaaatttttaataaaataacgttattactttctacatatatcaaattaatacagcaacattatgattattaaaaagaattagcgagaaaaaaaaaattttttttatttcaataaaatataaaaaaattatgcactttttatttaataattaatgggttttaagttcgaactgcataaattaaaaaaataaacaattatattgcaaaaacttgtattaaatttacactaatcttataacctgaaagtgagtggtatttaatttttgagttcatcgatttgagtacaattaatagaaaatggataaaagtgtttaaaattgaaaatctaattaatctggtataaaaacaaattaggtttcgaaaagttgaaataaaaaaatttaaacaatttcttgatgatataataagattaagttaaatgctgatatgttagtaaaatagaaaatgtaacaggttttttttttaaatatgatctgaaacaaaaagcaattacctaagtaattcttttaagcatttaaaaagcaaattataaataaaac

SEQ ID NO: 40745 - DNA, 828 bp, Heterodera glycines
cccccataaaaaaaattttttttctcaacgccggattttacaacatttaaaaaaattacttttcacagctcgattttccaaaaaaaaaaattttttttgggaggaaacggggggaggtgccgataggcaattatgttttgttaacagattatgtccaaaaaggaccagtttttgcgttttgagccagatttttaagaaaaaatccaaaatttatgagtttttactaattcgggattacggattggtgggattccgtcccgcgccggtctcgactctgtaccgtaactcaacatttataccgtatctcgttacacagcatgctaactatgacgaggtgggctccgcacttggcgccaacggcattcgccttgaggagcccatcggtgacgccgagttgcgcgacaaacttcggcaagcgttggcacagtgccaaggccgccgccgccgaaattctgccgttgctgaagagaatgatggcaccggcggcaacaacggcaccaccgacgaaaatggggaccaatcgacggtgatcaacgcgctgatcggacggaccaattttcgcgagggcagcatcagtgtgtgatcactgatcagtcagcagaaacgagaagagaattgacgccgagtgaccattgattgattgttaatttgatcagccatatttaatgtttttgttaataatttcaaaagttgacaacagaaagcttcggaagtcattcattcattattcatttgtggacggaccgatgtgataaataaattttgtgtacggtaaatggattaaggcatttagaggtgggtcagttatgcattggataggcaattgcc

SEQ ID NO: 40746 - DNA, 986 bp, Heterodera glycines
tgatcagcatctgtgcggaactgataacgctgttggttctactcatcgcctccgcgcccgcgtggggatggctcgcggtgcgcgtgcgcgacacgcgtgtcgtgctcaaacacggctggtacgcaattttgaccgccatgctgatcagcaccgggggcggctacgtgctgcgccacgccatcgaccagttcgccggcattggactgttccagccggtgatcaacggagtaggcggaaatttggtcgccgtccaagcgtccaaactgagcaccagcctgcatcggtttggcaagctgggcattctgccggcacacacgctgctcacctacgtgaacccgttgcgcactttcgcgtgcagaggtagcgccaaaaagcctctttttagcaaaatgagaatgggggaacattaatttgatcagcgttagagaaagttagtgatcgacaattagtttttacgaagtgacaacgatcataaatctttaaatgttcaatgaattggtgaatcttcatttgatctggggtatctgatcaagtaggtggtcacaagttgatttaggataataacttccaattataatccaaaaagggagcctttatttgtcctagtaaatctgatcagtcagtcagtgatcgccacaatattttaagccaattattattctcatgaatctctaaatttataactgcaattacattcttgatttgcagtagtcctaacgaattaagacaattaattaattaattacccgccccctttgtgaagaaactgagtccaacaatgcgctcattttgctgctgatgagtgtgcccggccacttgctgttcattggtctgctgctgttgacaggcgaaatggatggccaagcattgaatttgccattcatggcaatttatttgtgtgccacaacccttcaggtcggtaggacaaatcttttttcattgacacatgggcataactaatgtatcgagatcaaaatactaatcat

SEQ ID NO: 40747 - DNA, 542 bp, Heterodera glycines
tccccctcgcaacgttgccccatgaagaaagtggaggaaaggagtgaccgatggtcttcctcccccccactgtccattccttttcgcattcactgcccattcctcccgtcacccatccgccgttttacattcatccatcgggaaatgtcctttctgccagcccgttaagcagcggaattcttgcgtagatagggcacagcgaatggccttcccctcgcccacccccttttttcctcccccctttccctctctcgcccatttggtggagcggccgtccgtccgtttgacggttggagcgggccggtccgccttttgcttatttccacccgctgccagccgaccgggttccctcccccccggggggggggggggagggaggtggactttaagagttaaatgataacggaaggaaagaaaagaatgcgtccacaaggcaatgagcgagaatgaatggatgggaatgtggtgttggacggtcagccaaaaggcagcttagagaggggagggggggggggggggaagaagcattgtcgaaaggggca

SEQ ID NO: 40748 - DNA, 1201 bp, Heterodera glycines
ctctagagtcattcaatttataattatgtatttattcatcgtcggcacttttcgtttttttttgtttgacccaacaaatgccttaactttgtttcatttttttaaatatgcaaatggtgccataggaaatcaaaaaaaaaatctcaatttaattagggggacggataaaaaatgtttgacagatctgaagactttcaggtctaaatgaaaatgaaaaatatcagtcaaatccaacacaaaaaaaaaataaaaaataaaattggcacaaatgccgggtttccacgcgcaaaatttcaaacccaaaaaatgccattaaaaagagtcaaaattaaaaaaaagttttaggccatttttatgcttttcaaaagccatcctccgcttcattcacgagcccattgaatagcaaaaacaacaaaagcaacatcatcaaccacagcatggtcatctcagggactgctgcttctgcttcgcttccgtcttccgccggcgccgtcggcggcggcggcggtgggcgtccgttgccgccaaattgggaaatttcgtacaccgaaaatggcgaaaaatattacattgagtaaaaaactcattaaattttaatttaaaaactaattacccaatttaaattggccagtcacaacacgggcaccaccacgtgggacgacccgcgcgacacgtacccgctgcacaaccagcagcagcaaatgcagcagcaacggttgccggacggatgggaacgcattgaggacacaatacacggcactttctatgtggagtgagtaggggaaggacaaatgggagaagttgtgggattgtcacggctgctggtgtgctggcaagccaagcacgaaatcccgggtgtgccatcaaaagtcattggattggagatttggcacttttcaagttgttggtctcgactagcaccgttcgaaacggaaattgccgagactcttgacccgcctctgggtacgagatcgagaccctcaaatgcctgatagagacttgtctagagtcgaaactcagaacagcagggagcagctcaccaccccccccccgcgccggcctttttccccgaatttttcaaaaatttttatttttttacaatttaaaaaatctttttttaattcaaaatcaaaatcccagtccatcggtctcctctagaaattcgtttattaactctcaagattgttgaaacaaatttatg

SEQ ID NO: 40749 - DNA, 1527 bp, Heterodera glycines
gacgcttatgcgtctatcgacggatcagtaagtgttccttaagcaacaacagccgaattggaagtgatttcaaacacgctatttagggttcaaatgcgttgctcatccgtctccgcgaactttacccaagtgttattgaaactcttgcatggactagccttcaaaaattctccgaacaatttccgtcaactcagcgtatggtgcaagcacttcgcgagttaattgaagcggtttgcctatttcttctttcgtcctttcaaaaaagaacctttttagacgggcctttattttggagctgttccccagtcgtcctcatcagaggtgtttttaatgggtattcttgttttatcgtaacaagaattgtttttaggaaagtccttatcattttgtcggtattttgagttttgtttctgggagacaaaagttatttaagaaaattgatgctgatgcccagtcaacttcctcatcaacggctcccattccgaaaccgctggacaaatcgatgaagccaccgccacaggtattgtttttagtcaaagattgtctttcatattataaaaattagttttaatgacattgatctttagcgtttgcctgccaaatgtctctctactgagcatttgtatgatgaagttccgccgagcatttatgaccatcctccgcaacagattaaggtttacgggcgctttttttgtttagaaacattctccatcttcaaccaaaattttcatttttgagacgacaattcctttcaataccaattggacagttaatttctgtttaagcaaaactgggtgaaaagtctgaattaagcaaaatcgccaaaaagaaaaaacccgtacatacaaaaaaaaataatttagcaacaaaacgttgtgccgtccattcttcagccgacttttcccgcttcagctgcagttccggtgccgccgcgaaaggttcgagtgccgattcgtcagtcgacttcgtccgcttcagctgcagtgccattgccgtcgcagaaggttcgattcacaatttaccaattgcatttatttattcgtttttactcaaatttattgcgtatttcaattaatggctatttaattcttagggtggtgctgttgttcagtctttggttcgccgtttgcctttgttgtccgcggtcgatcccccgtcgtcacagcttcaggttttgtggacatttttgtcttttaaataacttattcacttcaaaagtcgccattttcgttgatgctgatttttctcagccgtttaaatttctaaatttcccgtttcaaattgtaaatgcaatttttcagaaacgcgttttcggtcacgccggactttcgctgttttcccctccgtctgctgacaattcaccgccacagaaggttttgttgcaaatgatttaaataaaaaagtgcatttgaatcattttgacttttttaatagtgtctctattagacctgaaagacttatttagttttaggtgcatgtgatcaaaatttgcaattgtctggcggaaccactaaaaaatgactcaaa

SEQ ID NO: 40750 - DNA, 1299 bp, Heterodera glycines
ttttgcacctctaatttgggctgtttcagtgctcaaactttagccgaacgaaaacaacagtttcagaaattggcgctttttttgtgccgaatttaaaaacgacgcgtttaaatgcgaaagaatggcgccgttggggccgaaaattttcttctccatctcattatccgataagcatttgcacgtgtagagttccgcccgactctccgaagaagaagcaacaaattccatggcaatgaaggcaattgcgttgctgaacagtcgcactttgtccatgtccaatggcacaccgttcggctgattagtggagggccacggtattttttcctcagattttgacgacatggattttgtttgttgttttgaggtgccgccacggtgattatttgcttgatttgtctccctgctgaacttggcaaagttcgtttccaccagtcgattttgattatgcgtcattgggtctgatggttgggacatggaaccattagtgccattggcagcagacagttggccaatgatgaacgagttgaacaagtcatgcatgggatcacactgaaattggcattattttacgaccaggggtgacacggaattccgacttccaaaaaatttttggggcctcggaatgccatccctgtgctatatgtatcattcccacaaaaaatgttggcccatttaagtgcatttgtgctgattttttgttatctccaaaaggggatatgccaagccaaaacttttaaattaccgtatattctctaattaaggccctgtctccattaatcccgctgtctccaattatgtccccctttctgaggatgttgaaaaataatcctcccgtctctatttatccccccgggggataaatggaattattatttttttaaaatcttatttttaataaaaattaattttaattaattctaaattgaaattcatttaaatgtttaataaacatgaaaaaataatacagcaaaaatcacttactttactcaagtccgaacataggtaacccagcccggtgctatgtcgttattagagctcggtattttgaaaaaagcctggacctggacctggatttcctgtacaaaaatccaggaaaatacaggttcaggaaaaatccaggcctggatccaggtccaggccgagctctagtcgttataaaaaagccatcaaaaagggggcaatcattaataattggtgtcccgacgaaaaaaaatgttaaaagtttgtcggatatttttctaggcttaaaaaatgcgctagaagggaatctgagctcagattttgaaaatctttgatttc

SEQ ID NO: 40751 - DNA, 1416 bp, Heterodera glycines
  misc_feature (48)..(48): n is a, c, g, or t
  misc_feature (52)..(52): n is a, c, g, or t
aactaaattatacttttctttatgaataaacatttacaaaaataaaanaatntaataatttatcataaaattaaagtaaaaaatattaatacttatataagcccttttcttcaacaaataaagcagaaaaatggtgaaaattaatttggttatataaaatttgaaatattttccttgaaaaacaataatattaatttaaattaaattaagtgacaaaaatatttaaaatattaataataaataaagcagttacccagcacgaaaaaatgccgaaagcaaaaacaacaaaatatattttaaaaaagtaaatatgaaatgacgcatgaatgtagagaaaatttccatcatccgtacgaaaaaaaagcttcatcaataattgctattattatttatcaaaaataaaagtacaattaaataaaataatcagaaaaattaatgaatgcaaaaataccgatgttgaaggatggaaataattaaaaaaaaataaaattgggttaatttaatttgttcttttaaattgtaaaaaagatttaaaaaatgtaattattccttaatctcactataattttaaaaataatctttttttggcaatattcgcactggaaaatttctggctgcacaatcaatagattttgaaaaatataacaactaaaataagcattaaacaatttttttgcagctaaaccgataatattctatttaattaaaatattaattgttgcagattataactaatcaacaaaaacatttttaaatacaattcttatattattgtttactaattataatatgcccaaataaaaattaacaaaaattcaaccgaaaatcaataattttcaaaaattaaaaacaattcgtaatacattacatcagtcttattttaattaattttaatttataaaaaaatatatccttttattagttgtaatgaatatataaatggtcatctaaccaaaaagttatgatttataagaattaaaattcaagaaaattcaaattttggaaactatagaatataacttcttcggtgagaaggttagtcggttaacatttggttaatggtagcttctaaaacacgggagatgcttttgattggatagcaattttgaagaaattaactcacgaacaaaaaagttatcggccatttcccatttttaaattcgtacgaaacgtcattcggtacgaaccggcatcgacccaacttcttaaaaaattaagattttttccgataaatttttcggtttttctttcggtaatttggttaaaaatatttttaaaaaataacctaattaaatttttcgtggattaactcaagggaaaatcgaaactttccgggaggcgcctcatcggcgcaaccggaaaatttttcggaaagttaagttcaatttggtaacaaattccggcgagaaacggtca

SEQ ID NO: 40752 - DNA, 1123 bp, Heterodera glycines
  misc_feature (1065)..(1065): n is a, c, g, or t
ttataagaaataaacttctaaatgcggaaaattctgaaacatacgaaattgtcaaaaaattttttatgttcaaaattcttattgaaaataacttttattttgaaattttctcaatgagaagaaaattattttctttaattaattttgaggtacatatctaattaatattttcgttaattaaaaaaaatttcgcttttagtttcaaaaatttaatgaacaatttttgagaaatcttttgtccatattttgggattttttcatttgttttataatccatttttaaaatatttttcaatataaatccgagccttaaataaattataaaaaataatagaatagtgtttttaataatattttaagcatttttcatatgaaaaagggccgactgatcagccgccgccgccttgggcaaatttggcacgggaaatgcttggtcttttcaggccgttggagacaacgactgcaactcaaagcacaacgacaaaggaagcgtcaattttggacagggtaattaagaaaaaataaatttaattgaaaatattacgctttgactgatttggccaagtaattatgaaaaagtccattaattaatttaattttttgacaatttaatataaatttaattttaaattaacttttgattttgtgctatttcagtttatgccaaaaattccgaatattttcaattcgtttgtcggcggacggacgacgatggccacaacaaccgctaccactcctccgacacttttcccatttctctcatttttcaccgaaaaacctactacgacaaaagcgttttgtttttaaattattaatagggctgggatttttatgtgctaaaaatcctgaaatatgtaataaaatatgtgctaaaaaccaaaaaaaggtttaaatatgtgctaaaaattggaaaaaccaagtgtatttacgcaaaaaaaatcatatttaatatcagtctttatcaattttcgcccgacctccaatcaaaattttggcgatatcaatcaatttgtaaagtcccggattaatttttccatcagttgaataagttccttccgggaactntgaaatccagtgacgacgatttaacacagcgtttgatttggctgctttaggcatttaa

SEQ ID NO: 40753 - DNA, 1478 bp, Heterodera glycines
  misc_feature (1465)..(1465): n is a, c, g, or t
  misc_feature (1469)..(1469): n is a, c, g, or t
cgctttggcagcacattccagggtggtcgcggacccatttttgcatactttgaccatccgacacgaggatggaaacacttacgaagttaatttgttggaagaacaagcagctgatcctgaagccgcggcctacatttcgtttgtcagggatggggaatttccagctgatttggatgagaaagaaaaagaattatttgctgtaggcactgccaattacaaattaatttcgggaattcttaattttgaggacaagggttcccccccaagaatttatgtcccaatttcattacgtgggctcattttcgaatcgtttcactcctctctattgggaggcggtcatttaaattacagaaaaacaattgccaaatgtaaaaaatatttttggcctaaaatgtactctgacgttttaacttgggtcaaactatgtgtcacttgccaattgagacacaatccaacacccgcgtaccgggaagagatgctcatggtgccagccaacacactttttgccaaagttgggctggacttggccggcccctttccagtcactcaaaaagggaataaacacattttaaatatcgtttgttggttcaccaaatacgtgatttctgtcccggtccccgacacaaaagcacaaacaattgcccacacttttcttaccaattgttacttaaaatacggtggttgtgttgaattaatcaccgataatgcttctgcctttacttccgaatttttcagagaattttgctccatgctttacattgacaaaaagtatgcctgtccacattggagtcaaggcaatgcgtcaactgaacgcacttttcggacatttcacaacatcttggccaaatacatttcgaagactcagcccgacttcgatgaatttttggatgctgctaatttttgctacaacacgtcagtgcatgcttcaacgggtgagactccattttttctaatgtttgggcgtgacccaattttctgtgttgatcagatcattgatccgaaagttcgtgatccgatagccatttcggaccgtaatgaatttaaacagaagctggtcgttgccataagacacgcgtggcacgctgcagctgatgaatatgcaaaagctcagcgaaaaatgaaggaacaatatgacagaaaggcaaggccacaacaaatcacaattggtgatcgagtgctgatcagaaactacgacggacgggtaggcacatccaaaaaattccaattaccgtggcgaggaatttttcgggtcatcaaaattgagggcatttatgttactgtgatcagttgcacttcgccaaattcgaacccaaaaagacttcacttaaatcaaattaaaaaatgcttcgaaattttgggccccccgtgcactatgccaatacaaccaattgaagagcaaaagtgccttgaaaatacaccaagcgtggaggaagtcagttcggaacggtctgaaattaggaatganatgnaccccgagt

SEQ ID NO: 40754 - DNA, 915 bp, Heterodera glycines
  misc_feature (875)..(875): n is a, c, g, or t
  misc_feature (893)..(893): n is a, c, g, or t
gtccgatcacaattaacaaaaccccttaggttttattcgatcgaaatgataaatcacaaataaatatgaaagtctgagatctgatttttgtgatattttggaactcttaattgtgatcgacgactgctagtcccgttcggagttgattattgctcctccggtcactaaatatttattccattagtctcttctctgcaccttccaacatctcaactgatcacgacgaattgacagtgaaaattggcgacaaacaggtgaaacagcagaaagagagcacaatggagagtccaaaattttttaaaattctgataaacttggcaaatcgctgagtccggtattgtttagttctttaaaagagattaaatcattgagaattcttgatcagatcactgataattcttggacagatcactattaattaatccattctgatcagatcgctgtgtccgcccattggctgatgtccgtttccccggtgatcagtcgcatgctcagcgtggagatgaaggagaagcagcagcgaatgatcactttggacgaattgggcgtggacatggaccaattcatggagtttttggaggccatcacttatctgacaatgagcggaccttttctgcccaaccgtaattctatgctatcgtatttattctactatatcctctggaaaattaactctaccctttttatgggttgaaaatatgatttttaattttttaaaatgaattcccaattttaagccaaaaatgtactgatgcttctcaaattggccgactacttccaggtgggtgccttgacacttatcaacaaatcctcatttgatgtctaaattttctcgctttagcctgtaaaattttgtgaacaaaaatgtcgaattnttttagtttttgtaattntctaaattttacaggcttatag

SEQ ID NO: 40755 - DNA, 1492 bp, Heterodera glycines
tgccggctgaggcgtggacaaccaaactcatcattgtccacaacgatcggattcacaatcattgtggaccgaggattcttctatccaaaattcgcgagaaattttggattccacgaggcagacaaacggtccaaaatgccctttactcaagtcgaattggatgtttggaatgcaaaagggaaaaactgaaaccatacacttatcccgaggctcctaatctgccaaaggagcgagtcaacgagacacgaccctttaacaacaccggcattgactactttggtccactaaaagtgaagagaggactcgaaacggtgaaagtgtatgtcgcactttttacctgcctcgccatccgagcaatccacctggaagtggcagaagactattccgccgaagcctttctccgcgtgttccggagatttgccgcacgacgcggcgtaccgagagtcatcttgtccgaccaagggacaaatttcatcgctggagccaaggtcatcaaggaaaattggaccacagacttactcacactcgaagtgcaagaacagctggctcatcaaggaatcacatggaatttcaacacagcccatgcaccatggaaaggcggcacttgggaacgactgatcggcattactaaaaatgccttgaggaaaagcattggacgcagacttctcactttcgatgaattcggcacgctcgtcgttgaaatcgaagcaattgtgaaccatcgtccgttgacttttgagtcagaccgcgaaccagacccggtactcagaccggtcaattttctgatcccgtacggatcaacggaaaccaattttccgtcaatggcaacggatccggaagatccagaatatacgccgaatcccaacaagctgaaaacgatgcttcagaaggctgattcaagactgaacagcttttgggaaatttggagatccgactatctcctttcactgcgtgaacgtgcaaaccaacggttaaacaacgaacgacaaactcctaacgaaggagacattgtgcttgtggaagaagaagcaaatccgcgatcagtctggagcttggcccgggtccttaaagtccaaataggacgggataacaaatcccgttctgcattaatttcccacaagggaaaagaaaaatggagagctgtaaatcagctctacaatctggaaattcaacccgaatttccagaaatccactccaccgctttcgtcatgagcaacttggacaacgacatcgacagcgtctctctcgccggcagcgaagatgaaatgccgcagccgaaaaataaattccgcattccgaaacgcaaacgggcatttcttcgaccaatcccgcagcagcacagtcctcttcaaggaccgcgtcgcaaaagaagggagttacaagactccggattacgcaagctgttttgcgcaatatcagagccagaaggcgggagcaaggcaactactgaagctatcaacgaaagccgcgccatgaaaaagcgccgcaaccg

SEQ ID NO: 40756 - DNA, 1198 bp, Heterodera glycines
  misc_feature (1043)..(1043): n is a, c, g, or t
atctctttttttgataaattttatacacatacaaatgctctcgagcatgatagggagggcggtgcgcaatcgacctttttatttttgagggaatttttaaatttatactctatcccagaaaaatggctatctctttttttgataaattttatacacatacaaatgctctcgagcatgatagggagggcggtgcgcaatcgaccttttatttttgagggaatttttaaatttatactctatcccagaaaaatggctatctctttttttgataaattttatacacatacaaatgctctcgataataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaacatttggaaaattggctatctcattttctgctcaacagtaataggaattccaaccgcattctcagaataattacgcgatactaattgttctggaatttgtttctcggcgcgtttgtttgggaaaaatttggaaaattggctatctcattttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctncacagtaataggaattccaaccgcattctcagaataattacgccgatactaattgttctggaatttgtttctcggcgcgtttgtttgggaaaaatttggaaaattggctatctcatttttctgctcacagtaataggaattccaaccgcattctc

SEQ ID NO: 40757 - DNA, 961 bp, Heterodera glycines
  misc_feature (59)..(60): n is a, c, g, or t
  misc_feature (63)..(64): n is a, c, g, or t
  misc_feature (68)..(68): n is a, c, g, or t
attaacttatataaaggatgcgcagaataaatacggaccttctaggagggattataggnnggnngaantattttgtgaaaagtcgttagaaaagggtgtaaagattttccttttcctctcattgttaaaattatgatacattcgcctcctcccccgccggtttcattcattcattgttttcccattccttaaatgttccctttgtggctttaaggcaccccaaaataaaccgatgacgtttaaaatatcccatgaattttaagtgaatagaagaggaacgtaagacagaggcacaaccaaggggaggtgaagagagaaggggaagggaagtgaaagggaatggtgaaggggaagggaagggaagaggaggaaggggaagggaagggaagggaagggaagggatggcaccgtccaattcagtcccataaacgaaatgaccaacaggaagcgattttgccatcttttgttgatttatcatgtgaaaataataaaaatacgacgccattttggagtgaaattctttaaaaaattcgacaaaattaccatttattttttcgaacggtccattataaaaatttttttttaataaattgactcaaaaaaaaatgcaaaatacggtccttaaaaaacaatatttgttaaaaattgatttttatcagtgatttccatggcaaacaaaaaatttctttggtattttttggcatcatttccaaaatgcatgccatcatttgaaacacccttttgacatctgatttcgcttccctgaggcaaagccatcgaaaaaatgttttctcgagacgatactcgagaccaagtcttgctaaagcagtactcatccaaaagggttggcgcttgactcaaaatgggattaattttgaagtggttattcgagagttttttggcaattaatgggcctcaatggcacgcttaataactcgcgcatggaaagggtagaatttta

SEQ ID NO: 40758 - DNA, 1402 bp, Heterodera glycines
agcagcggacgcgtcaaaatgccatccagcgcccagccggtcagagttgcctgaactgcttccatttgtgcgaaaccgccaactttccgtcacttccattgtccgttcggctggggatggcacttcgccttcggcttcttcccttgtcggtctcagataataaaaatcactcattcatttggcacttcatggaactgtttgtggaattattgttgtaatttattaatcctcagctgtttgatattatcccttttaattaatgcccgcccatttgactctccgtgctaaaatttctcccaaaagaatgccctctaaaacaatttttgtccattttctaagtcacatgataaacattaattgtccatgtcaaattcatcatccatttaattggtacatattaatgtgttagcaatgtttaattaaatttattattgtaatttgaatattttctacaaaatatgctattttaattggcttgggaataattaccgcaatttttaaaatattttattcaaagagcactctttttaagccatcatgagaaagtaaaataattattgcttaactgttatgatccctaaaaatgtttcgccctcagcctgcggacccatcaccgacagaatttgccgagcggtgattattttggaacaaaacgaagagaatccgttaaatgccggagggcaaagttcggaaacacaaaaaaagtgagagaagtgaaaagtaattaattaattgaaatttaattctgccgattgttcagaagaaagacccattcactggagagggaacgccaagcactgaacgaattgcattttctgttcaacggttgggaggcgttcggccgagtgccacggcatttgctcacaaatgccgtgtcggcacttttccaggtgacttggaattccctcttttttcttaatcgagtcgaattgtgaagtgtttggaccatcgcgagcagtctttgcgattcgtcgccgaccaaacattggacgcactttttagagtaaaaattaccaaacgcaaaatgctaaaaacttagataattgcagaaatttttcttgaaattccaagcggaaaaagttgtggcatttctgctcagcgaattgaacaaaagaacgaattcggcacgggcaatttgcgcggcactgcaaaaactgagttggacaatcggaagtgcgaaggcacagcggacaaagtgaaattttaaagagaaattccactgaatacaaaaaaaaattccattttgggaatttcctctctctttccccttatttttgcctcccttttatccaatttaaatcaattaaatttctcttcctcaattttcttccattttctctctttctctcattttccctcatttccatcattttctccactttcttagtcgctttggcgacac

SEQ ID NO: 40759 - DNA, 858 bp, Heterodera glycines
gggctctaatatttaataaattcaaaattatttaccataggtgcaatccgaacaaaggatccacagaatcccggtaaatgggcatttccgggcttaaatgattgacagggattgggccactcgggttcaaattgcccattttaaattggtatatttagtttttgagaatttttaatataattttaaattttttcaaaatttcaaaaatgccgcaatcccgagcgggatcccgcaaattttaaatgctggatttgcggggttaataccgctggatccgttcccgcaaaaaatttgaattctaattacacagcgggatctgcaaatttgaaatttccagtctctaattacgaacatgctttcttccaattaattaattttccaaaatgacttcattcataataaactactaaaacaaaaggaaatgaatggtgagaaaactgtacaaatatttgtaaataatgaaatattggaaattgaacagctgacttttgcggtaattacgttaattagcgtcacttttaattgtcaattgggagcatataaaaaggcattaattaatcactgtcaagcatcaaattaattagcaaacatttaaaacaatttcatcaaaatgcttctaaaccctgttcaaagtgcacttttgcttgtgctaccgttcctttttgtgtcctccgatgctttttggatgtttccgttcggcggcggtggccaaaagccagcgcaatggcaaatgctaaaatggccatggtatttgccgaccgatgccaacaattcgtcaactagttcctcttctacgtcaacttcaacttcaacctcccctaaaagttttcctcctcgagttcgaccagttcgtcctcc

SEQ ID NO: 40760 - DNA, 787 bp, Heterodera glycines
  misc_feature (715)..(715): n is a, c, g, or t
  misc_feature (750)..(750): n is a, c, g, or t
  misc_feature (768)..(768): n is a, c, g, or t
tttgaccacaacttctttgaaactcaacgaaattttttgaaattttaaaggcaaataatggaacactttaggctatcaaatggtaccaagaatgtttaatttggatgcttcttgaaaaagttacggtgccttaaatttgtaaaattattatattgtcatgtcaatttttcgtggtcttgtaaactgaaatagagccaaatatattttttattattattagcttatcattcgcactttttgcacttcggctcaccacgttattacacaagtattaatctttgtttgaaagtaacagcttttccaccaaaatttattcttagaatcactgcgtctcaattaaaaattctttgaaaaataaggagaaaatgaaatttaatattgtaaaaacagacatttaacaaccattcgtcgtcgcttttctttgctttcgtcggtttgcatttgcggcaacaaaatgttcaaagtcaacgtcgattattttttgacgctcgcagaaaatgttgatgaatttcattcatattggaggattgaaattcgttgttttttctttaaattttatgttccccctaattttatgtctaatccgacttttacaattttgactttgacccataaaaaataaaaaaatgaataaatgagtgcgaagtatggccataaaatgtcaaaagtttaaaatgccccgggccgaaatgcgcggccaatttttttttaattntttatcgacccgttatttatttattcatttgctgntgcactctcccaatgtgnatttatttgggaaacttct

SEQ ID NO: 40761 - DNA, 1614 bp, Heterodera glycines
  misc_feature (71)..(71): n is a, c, g, or t
  misc_feature (135)..(135): n is a, c, g, or t
aaaaatgtgtttgatactttcaggtccagcttaaaaagatttgcgtagcattcttggctaattgcattttntggtaaaaaaaatacgacgatttgattaataatatttttatgtaaatatttacgtataaaactntaattggctgaaactaaatatttaatttacgtaatttggtaaccttagcatacaaaataatattaaatgcgaatgagtatgaattgaggggattatttggtgggggaggggaggggaaggatatgccgaggagcgatcgatcggacggagtctaaatgcaaaatcagacaaatcaatataagttttttctgatcacgccaaaatcgccatttttatgggcttttccccatcatcattcttgaattttgccctgacgcatcgtctcaatcatttttcgcaaactttccgcgtcgctgggcgtgtaagtgcggctcagcttcttcacgttcagacaacaggtgcgcaccaacgcatcggtcactgaaaggggccagaaattagaaggaattagctcttttcaatgtaaaaagagagggaattttcagccaaaatggtcaattaaaacacagaggaaattccagtcattttacgagattcttgaagtcaaagtgtgaccatcgtatcgccaaaaattagagtccggtaaaaaaaaaattccggtaacggggaacgggaaacgggaatcgataaagagcgggacgggaaacgggaacgggattcccggctttttcccgttcccgtaaaaatcccgtcaattttaacgggaatcccgccgggaaacgggaaaaaatttttttaatgaaaaattttgattttttaaaaattttttactttaattatttttcaagtgaaaatattataatttaaacggtttaaaaaatttctctgtgtaaatgattgagtattttttaaaattaaatggacaaaaataacaaaaaatttaataaaatagaattttcggaattgatttgttcaaaatccttcgttaattttccaccaatccaaagggtccaattcctttaacctcaataaacggaatcacaatatttattcacgaaatttcataaatagcagccacttgagaccaaaaattaaaaaaaaacatcaggtccttgaaagcgcttacgccataaaaattcttccacatacgaattcaataaacttctgtgtgttcaatatctttttttgtgttctgccttgaatttctgccaaagtcctccttcaactgtgttcatgtgctgacccgtttcgctattcacaaattccacactgtggttgactgtgtagtgtgtgtaacagggctggacgcaattgcggattacggaaattgcggggtttttggacccccgtaattgcggatttttgggatttatccgcaattttgatccgtaatttgactattggattatttttcgagacgatttcttgtaagattattttttataaaatgaatttttttttcttttttattaaaaggctacccatatttcgatttcatctgacttattcttggaaatttgtagtattattaacatacataaaagggggcgggaggctagcgaaggggaaaagatgaaatgcctaaaaaattggctattt

SEQ ID NO: 40762 - DNA, 1472 bp, Heterodera glycines
cgtgcctgcgacgcactttggacacggctttgtgccattgccatgccaattcgctgctcgccgttttcccttccgttgtcaatgtcttatgaaacgaacaccggtcaaatgcatccctaacaaacgaacaaagacccaaaagtgtgtggatgagccgtgccgtgtcgttttcgttgaccgatttttcgatggaatccaaaatgggctgaatgtgggcgccctcgtcgagcaaaaccatttgagcattctgaaaacaaccgcagcaaattgggagtccaaatggaaaataaaaagcaaattgtgccaacaatgactggcaaaagagtgccgacgacaaattcggtgcattgtgacctttgagcgtgtaacaattcaatgtaaaagttgcgattttcggcttcaatttgctgcaacggaaaaatgatttttttttttggaattaaaatcggaaatttttcgcgggtgtaaaaacggacgaaaatgtttataatggaagacattgactgaatgacctgtccgtttttgttgtgctttcctccgccggatgttttaaagcgtttgcaatttctctgatggcgtcgctccaaatcggaaatctgtaaaaaattgcactgttaattgcaaaaaaacaaaaccaaaaaagactcagcgtaaattaatggttgggggacgcggttttggcatttctcacgatttatgtaaaatttgcatttccccgaatttagctaaacgcattaaattatgagaaaattaataccaaggaaaaacaaatgtttaagaagagcgtcaatccaacttaaatggttgtctttgatcaatcctcaaaaaagtgaaaccattgaaatataataagaccaacattagggaaatgtcaaagcgatggcccacacttttgccatggtttgaatatttaatgccaatgaatcgcaccgtttggcgccactcgccgccccttcgtcccaaaccgtcggcacaatgcttttgcaatgtttcgccccatttgcgaatcgccgtttcgaccgcgcgttgtctgaggcaaaagcgcgtcaacgcggcaccgatgtcgcggctgacacctgcggaacagacgaaggagaagcacttttgaaacacgagaggaacttctagaacccatttcataaaatggttttatcacggccaaaaaggcgtgtgcccaaaaaactcggcattttctgataattccgtccctcattttgttgctaattaccattgacagtgttggcactgtcactgatcgtttgcagtgcgtccacaaaagcgccaaaagcggcggccatttggtgcaattgcgaggagagtttcgccgcgcgtccgccaaaagtgtcccaagcggaagttgaggcccaaatgggagaaaaaggcattcgttcgaagtattaaaaacgaatttagtcatccaaaccttaagctcactgaccaaacccgagggaagcatagaattaattgtccct

SEQ ID NO: 40763 - DNA, 973 bp, Heterodera glycines
  misc_feature (803)..(803): n is a, c, g, or t
  misc_feature (872)..(872): n is a, c, g, or t
  misc_feature (964)..(964): n is a, c, g, or t
ttcattttttataagccatgaatttttttaattgaataaacagcttaatggaaaaagaaactgagcccaaaaaggggtttcatgtcgtatttgcctgggttactaatttagtttttttttataatctcatttttccttgatttagttttctaaatttctgagattttttctgtttaataaatattaaattttttgaattcccttttttggaaaaagacattttcctatcgaaaaatctgttttgaaaaccttcgaagaaatttagaaataaagtcgaataatcgaatcccgaattcaggtgccactttctcctcgtcctgcggcaaccttaacccaaggtgccgataggtaaacttgaacaatttggtgaaacttgttttgcccacgaaataaataattttgaagctgatttgtgagttaaattattagtgtcaagaggaaaagctaaaaaaaaaaactcaatatattaataacaaaaataattctttttaatcactcgaaatattttttcaaaatgcaaaagataataattatttttaagaagtcagatttgctgaacatttaattcaatatttaatggattggaacactttttaagttttcacgattttttccctttctattgtcattgtgtacgatgtcggataaacgacgatcattaatttactgaaacaaaacgtaggacaatgtccaatttccatggttattcaacgaattcgtcgggacgatgaattgaaataggaatgtctaatcccgaaagtttaattgaaacatgaaaaatgacatgtaatgagagtacctanatcatattggagatacgacgcaaattgaaattggacccgccggaaaaacggagacgaaaattagcgtanatgggcaaaaagcgaaattggcacgggcagcatttgttgcttcatctccattgcagctgtaaccctctttcgtgatgattaagatgaagtgngcacatgcg

SEQ ID NO: 40764 - DNA, 890 bp, Heterodera glycines
  misc_feature (788)..(788): n is a, c, g, or t
ccaacactttaattttggtaggcttgatttttgaaaatttttttatatttaaaaaagaacttttttagctgagcttgatcagtcattcattgatttattggtggtggaactcgaaaattcgtgaactgtgcaaagaagttgttgaaactctgcacaaaaagctccttaaatcgcgctaaattaacttcgggaataaaaattgtcaaatcattctcgagagtgtcgataaaccttcattgatatttaagcgctaattcggaatttaatgataaaatcctatcttcattaaatactttttaatataaataaatattttaagcaacaaagaaatctttaaaatctatccatttagatgctaattaaaatcacatgtccatagatctcttattttaaattttggcattttattttgcctttaccaactttagtccatgtgcatgtgtgtgagattcacatgcttttccactggcatggtccgccgcccattccacgcaccattatattccctgcaaaaaaaaaaaaaaattaaaaatccccaacaagcataggagttaatatatttaactcgtgtaagcttacgttaatcacattgatttttgtttaaatcataagcacatttattgcataaaaatgaaaatatgaggaaaacatatttttattattaagcattattattattattacttattaaattaaacattacaaaagagcccgataaaaaaaaattgcgagagtcagaaattttggaagcgggaatcccgaaaaaaaatcgcgggaatctcgctccnaacgagctctaatttatatagaaaaaagaaaaaattaagataaacaaatgcttaataatttgacaacaccttttggcacttttatttaccatttatactttt

SEQ ID NO: 40765 - DNA, 1044 bp, Heterodera glycines
tgtttctaggcgcgtttgtttggaaaaaatttggataattggctatctctttctctgctcagcagtaataggaattccaaccgcattctcagaataattacgccgatactaattgttctggaatttgtttctctgcgcgtttgtttgtgaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgtgaaaaatttggaaaataggctatctcttttttgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgcttctcggcgcgtttgtttgggaaaaatttggaaaattggctatctctttttctgctcaacagtaataggaattccaaccgcattctcagaataattacgccgatactaattgttctggcatgtgtttctcggcgcgtttgttggggaaaaattcgaaaattggctat

SEQ ID NO: 40766 - DNA, 1041 bp, Heterodera glycines
gggtgtctcgggaccgattttgcatacgaaggtccatctttcttctctggtgtcgacctttatttatttttttttgtttgctattcaaagcaccttttttgcggcgcgtattttttcaaaaaaactgaggaagggggtggcggccggtccggtccgacggtgccgataggcgccgccgtgaaatttttaaaattttatataattttgctcgggaaattgtgcaaattttaaatacccccttcgttaacgaccccctccctctttacaaccgccccccttacgacgaacggggggggtggatttaaaataattctgtatatatgaacaatacacataacaccatgttccaattcagcaataaacttaaactaattgtaagtaaagacaacagaaaacaaacaaaacaaaaaccggctaaaatttcaagaaatgtgattttttggcatcaaaaatgatgggaaaaaatttaaatgaaactatatttattgctttaagacgtacctatttgattggttaatgaacttttttttgtgggaaaaaccgaaaattttgcaaaaatgcgatttgttatttattctcgtttccaccccctcactttctttgctctctttcaccaaccgtcaagtcaaaaatgatgaattttaagattttttgcaacccatcaaccccacgtaaccccttaaaattttaatgtattttaatccccaattctcccctctctacaaaatgtatgattttaggacgatgatgattatgagtagggaacatatgaacggtgcaacagtttcgctgatggtgtttgttggcatggtctgttgttgtccatcatcacctgttgggttagtagagactttggcaaaggctttggccaatggcatcggaggcgcctgtttttgtttttcggtcaaacgcggcacatttgtggttgtggtggtagcggaatggcatggatcgttgtggatgttgttgtaaggtggtagtgttgctggcctcactttttgtcgccgtcgcccacttctgtcgccactcaccgctaccgta

SEQ ID NO: 40767 - DNA, 478 bp, Heterodera glycines
ctctctctctcctctccccctctcctctctcataggttccgtcctttcgggacgcgaaccgtacggttccgtccttttaggacgagaactgtacggttccgtccttttaggacgtgaaccaattgacttgttttcccattcaattttgaaaaaagaattaaaaatttgtccatttttaaaattctctctctctctctcttctctcttttataggttccgtccttttgggggatgcgaaccgtacggttccgtccttttaggacgagaactgtacggttccgttttttttttaggatgtgaacttatggaacttttcctcgtccaattttgaaaaaaaaaaaattgtccatttctgaaattcactcttttttaaaaaattttttctcttacgtgggttccgtccttccaggacgtgaaccgtacggttccgtccttttaggacgagaactgtacggttccgtccttttaggacgagaac

SEQ ID NO: 40768 - DNA, 1513 bp, Heterodera glycines
  misc_feature (1392)..(1392): n is a, c, g, or t
ctaaacagcagcagtgacggcgccgaagggacgatggatcagctgaaccgcgtggttggcccggacggtctcagtccgttgatcgtcgcggcacggcacggacatgtcggactggttgacctgctgatcaaccgtggtgagaagatgccctgttcatcttttgctgtcaaatgcgaagcccgcaatggtcaggtgctcagttggatttatccgattcgcacgggcgaccggcggcgatgcatggcatcgaagctgggcattcctcgaccgtggcacttctgcttgagcgcggaagtgcgctttttgcacgcgactcgcacggaaacacgatgctgcacttattgggacgacatccgaacaaatgtctaatctatcgactgtcggaagacggactgtcgctggaggacaaaaacaaggaaggtcggtggaacaaggcaggggacgagggcacgccaaacaaatcttggcacgctcaatgagccgtgaaatggccaagaaaacaaaagtaaagcgtaaggcaagcagactaacaacccatatcaatggccagaaatcagcatgttcatgacaactcgaatatcttttcagaccttcgcccgatcgaagtggcaattcgtgctggccaactcgtcgcagtcgacacatttcttcgccgtggcgcccgtctccgctcgctgacttggcaaattgcgctgagttcccatccccctctggtgctggtactgctccggaaactgctcgacgacgcgcaaattctattgcggcgcaaacgaaccgcagaagcgcaacatcgactcagttacgcactgcaaaagtgcgacgaactgctcgaaaaggctgaagcagaagacaacgaagcattgagacggatggggccgcaactgcgacgcgtcaaagtgggagaaggaaacgaaatttttaaaaaacaaatggaaaagtggacgagagagagagagagaggggaggatgagggagaagagagagaggaacggaatgggacagggataggataaggaataggacatgggtaggatcaaaaagggggaaagggaaggaatagggataaacagcccatgctaatcaggtacaagcttttcactcaatggccactctgaaacggcgctgcaacgatttgtccgatgccattgcgttggccagcaatgcgttggaattgttggaccaccacaacgtcggcggtgttcccgcgggcaattcgcttcgtccgccttcgcgcggatccctcggcggcgaacgcgaagaaaaaacggacgcggagagacgcgcagaagacgaacagcgcttcgagttgcatttgctacgcgcgaagtgccactttgacgcacgcgacttggaacgcgcgcgggtggacgcgcaactcgcgacatgcatganaccggaagaggtggaggcgcagaatttgttggccgtactcagcgcgggcaattagccaattaattaattaattcattcataattagacagacgagaggaaaaggggtcgagaatgaatctc

SEQ ID NO: 40769 - DNA, 973 bp, Heterodera glycines
tttctcggggaatctcaaaaatgaaaaattattaaaaagtattttttcctgtgaccgaattcgacgttaaaatgacattttcaaatttttaacaaataattagattttcttggagactttgtttatataaaatatttatttgccattttttggagtgccccaaaatgccaattttatacgcttttaagaattagtttaaattttgcttctctttttttttttgtttgtttcttcgcttccctctcattgtcaggtcattgccattgcccttttgtacatgtccttcaaaatggagcgcatggaggagcagcaaatcggacggacattccattttgacgcgagcacagagtggtggaatttggtaagaatatttgttgaaaataatagaaatgcaactacgttccccccccccctcacatttttaaaattttcaaacaatttccaagaaaaaatcagaacctttttataagaaattttattaaaattactgaaaattttttgttttttttcaaaattttcccaaaaaaatcgctgagaaattttaaaaaatttcaattattacaaaaaaatgtctagcaataagtttttttagtgaattctaacaataaatattaaaatttaaaaaaaattcagggagcgggaaacgtgctgcttccaaagtaattaaccccaattttaaatacttttttcacagtatgtgcaaaatttgaccgtgcccatgatggacgacatttgtcacaaagtgttggattccatcgcaccagcgaacggagaggacgcgccaatggcaaacggaacaaaaaattgacagatttaaatttttgtttttttttgttttattttaaaaaatatttttttgacgttgccttctattataatttgcaaaaaaataatttcgaaaatcgtgcatacgttacaatgcaaaaggtgtctcaggttaagggtaatacgacggacgattgagacggggggg

SEQ ID NO: 40770 - DNA, 1634 bp, Heterodera glycines
tttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattattttttgcatttgatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattattttttgcatttgatcacccaacgttctagactgatcagaagctcaccaaattttgcagggaaactgctgagaacccttcaaatgcttataaattttcttagaattttttgcctggaggaacacagttcttcacacttaccacacaagcttaaaatttttggcctgtttaaaaaggaattaaaaatttttttaaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaattttaaaa

SEQ ID NO: 40771 - DNA, 658 bp, Heterodera glycines
cgttcgtaattctgaaaggcccctggctggacccaccaactgcacattttctgtcccataacttgagttgaatagacaaatgtcaaacagattcccaaacttcatgtcattattatcggtacttaattggcaaaatataattttaaaaacaatttttatttaattttatttaaaatttggaattatttaattttggatgcgatgtcgtgtataactttccaattttgtgtcgaatttccgcggatatcgcattgctgtctcgcatatcttttttcgggttttcagtctgttcccagttcaggaattttttataatttcatcccgttgacgatttttgaaaaaacagcaagaatcgggaaagattcaaatgcttgatagtccttccgcccttccgccgtcaagtgccattcactttcgttttgccattcattttcatttgcgttcccaattaatccctccaaaaactatgcccacccaatcgactgatgcaaattgacgtgctaaggaggagaaaagaggaataagctaaataaatctcagcgaagcgatcgataggagggataaaggggggggggaagcagagggagtgtggtggactgactggacacgacatgggatggacgacagaacgacacccacgggaaggaatttgtgttgt

SEQ ID NO: 40772 - DNA, 943 bp, Heterodera glycines
  misc_feature (875)..(875): n is a, c, g, or t
  misc_feature (924)..(925): n is a, c, g, or t
acacaaaaaatataaaagctgagaatttttttaccactttacacccctaaatttgaaacattttgccttttccatttttattgcctcttttgaggtttttttagggcctaaagcctacctacttatgcaatttttattgcctaaaaatattttcaatagatatgggaaaatataaatgcataatataaaaaaacatattctttttgaataaaaaactgaaaaacactaaaaatcctatttttgattatctcttattttttaaatttttcttaggatttttaaattttcattttttaaattttgctacgacatcatttttattgggtccgtctgacaattagcgtttaaaaggccaacataaaacaaacattgtttaaaactgaataggacaatgtttctcatcaaagataaattcaaaggcgaaacattttaatattctcagctaaacaatttccttcaatttgttcttttttccattttgcacgcgattttgtcatgtaattaatagaagaacttattattgttgcattttgtcttcattttcaaattcttagaaagaaacataaatcaatgacaaaattaaattaaaaatcagataagaaaataaatagacaaaatgtgacattcggccaaattatacaataaaaagtttatcatcataccatcagcagggcaggaggaccttcagcttttttctgggtttttcttggtttgaaatagggttactctggtcgggtattttggcaaaaccgagtctgggtattgccgggtccagaaaagccaggttctggttccggctaccggttccgggtcttaaaaagccgggtatccgggtctggacccggtcgggtacccgggcccatttaaccctaatntttaatatgtgaaaaggttttcttattacaaaaacttatttcacctatnnttggcttttgcccaaaca

SEQ ID NO: 40773 - DNA, 710 bp, Heterodera glycines
aaagtttttattaaaggttaaaaatcgaatgcattttaatttaaaaattttttaaaataatttacaacaaatcttaaaattaataaacattgaaaaaagtgaaaaaatgcagaaaaataatgtacaccgtccggatccgaacctgccccccccccacctcaaaatgatgcctcagaatccccaatcacacagggattctgaggtcttaacgatgtcaaaagtaaaatctgatcacgtattcgtgatcagcggcccaaataacccctaaagacatgtttttggaagatttttgtgaaaaaaatttctcaactcaaaaatcatgtgctccctctcccctttggtcccgaatcccaaaatcacttttatttttgtatctttttttaaaaatgtgataaaaataccaaataaaatttatataatagagcaaaaaattgttagccaaatttgggcgctatttgcaaagagtaaccttttgaattctatcaaaaaacaaaaggggggacccttttgttttgcaatttataatgatttttaggggtaatcctaggcgctgagcatgaatctgaccttatttttgctcaatttcgaaccccggacccggagttgttgaaaacaattaagcgtggttaaagtcgtaaacaaaagttatgaatcgggcggaaccattgaataagattgaacaataagaatagacggcagaaactggagca

SEQ ID NO: 40774 - DNA, 1202 bp, Heterodera glycines
gcttaaatctcaaggggaaattgatagccaatactttacataaaatttaaatgacaccaaactttgaataattggaccagtaaaaaaggcacttaacaatttgtaggttaattatgtcccaataaatattaataataactgtttaatttttaaataattttattattttatttcatacatatatgtatctttttttcttttttctgctctgaattaattttttcttttattgctttctctcgcactttttcttcatcattaaatcacatttttcagatgcttattcttgaataaatttaatgatttttataaataaaaaagcaaataaccaaaaatattttaatatttccacttcacgttaagattaattaaataaatttataaaattcatattttattttttaattgatgttggctgtttttaataaagacttggaaatatgagcatataactacaattttataaaatcacaaaattcttatttcaaatatttttaataattttttcaagatggcatttttcacaatttttctctccatcggaattatttttctcgcgaatattatctcacgagtaagccaatccggttattaattgtttatttatcataattcattatttttcaggcttttccatgcgataataaagtagtttatgtaccaggagaaagatgctgtcatggcacagataacttcaagtaatatttttaattttttaaaaattaaacaaggttaattaacatcgtaaatgtcccaaggcattgaccccgagagtggggatcgagcccggtgactttactaggtagagacgtggttggtcgcgattcctaaaaagtgcaaaaatgaatcatttgatctttgtgtgatttttaaacaattaactattaaattaagcaaaatttaacaaattttgaaaaaaaaaattctaattaatatattgttaatctatatttaaattgtcatttttataaattttattagcaatttaaatgcaagttttatatagtcttcaaatttgagctaaggtcctatttaattcatttcgcaaatcgaaaaacaaaattccaaaattaatcaaatgacaaaaaataaagcaataatttcgattaagggaaaataaaaatcaatttaataaaaagtgcaaaagtcacgaaaaattaattaagattaatgaattccattttgcacatttataaaaaacg

SEQ ID NO: 40775 - DNA, 1723 bp, Heterodera glycines
  misc_feature (33)..(33): n is a, c, g, or t
  misc_feature (1652)..(1652): n is a, c, g, or t
  misc_feature (1695)..(1695): n is a, c, g, or t
gaagtgcgtggatgtctgttccacctcgtccanaaattttcaccaagaaaatttctgaatttgggctgaaacaggttgaattcatgacaaaaaaaaaaaaatcgaattttcgaaaattttagcgctatcaaaatgacccgacattcgcagaaatggcacgatgtgtcacgtcgctcgcgtttctcccaattggagacttgacccctggaatcattgctctggacatggctcttcccgacgaacttactcccgtccttgactggtaaattgacaatctcacaaattgtttactatttactgttctttatttattaggttcatcatgaactacacgggtcgtcttaagaatgatggaagccgaacgcgcccgcgatttgacccaaacacttggagcgtttacactcgaacaatgcaaggcgatgaccggacgaataaccattcagaagccgcgaacagacgcctgcagtgctcatttgcctgttcacatccatcgatttggcgtttcattgaccttctgcgaaaggatcaaaagttgtcggatgatgacttcgcgaagtgttcaactggacaagaaccaccgcaaaaggcaaagaaatatcgcgaagcagaccgccgaattctcacgatggttcaaaattatttgccacttaacaacggagacaccaacattttcccaattcatcagcctttcaatcatcattttatcattacctttttgatcggaatttctcgaaattatgaaatgagaccgtgatttgaaacagataaaatgtttgttaattttcttgcttgttttaattaagtgtttatttatattcatagtttgatatgaaaatagcctaaatacgtgaatagggaactggccatagggaaacggtcatagggaaacggcccatagggaaacggtcatagggaaatggtcatagggaaacgaacccaacccactcccgattacaaaaaaaaagattaaatcccgaccgcaaccaacgagaataatgctgatgatcaagaggaaaaatagttataaagtataagcatttcttactaattcagagaccattttaaatgcatattcccttttaataagaaaactgatttaaggttaattttcgtactttatgtagctctattttataaattttgttttttgcgatggatttgccaccttccaaattatcaaatgccgcttcacgtttatggggcgaaagcactggacagtttcaaaagaaaacggatgtgaagattgatttgggccttcatcaaacaatttcaacgaatggaggaagcgatgagaaggcgtccacttcgtcgctttctgctgctggatttgtattcggctctcggatgtctgaacgggtcaccaacagggtttgttttttcatttaccatttatttttaacaatactaataactccaaaaatcgtcatttaataccgatttggaaagtcgataaaaatttagtcgaacaacttattcgcggacagtagcaaaggcagcgatggaaaaggaaaaccaaatgatgtatcttcaatatttaaacgtatggctgaaaaaactacgaccactgtcaacacagcaacaatggtttgggaaattaggccaaaattcattttgccatgacctttagtctgacatgagacattaatcttaangcatttcaaatttgtactttaaaaattcagtggaaagcaattncgtcaaacggaagcggagggattacgat

SEQ ID NO: 40776 - DNA, 992 bp, Heterodera glycines
aagagaagaagagatacagaaagtggaagagaaagtgaaagatgtacagaaagtggaagaggaacagaaagtggaagtggaacagaaagtggaagaggaacagagagtggaagaggaacagaaagcggaagagatagtggtagaggaacagaaagtggaagaggaacagaaagcggaagagaaagtggatgaggaacagaaagtggaagagaaagtggaagaggaacagaaagtggaagagaaacagaaagtggaagaggaacagaaagcgcaagagaagaagaggaacagaaagtggaagagaaacagaaagtggaagagaaagagtaagaggaacagaaagtggaagagaaagtgtaagaggaacagaaagtggaagagaaagtggaagtggaagaggaacagaaagaggaagagaaagtggaagaggaacagaaagtggaagagaaagtgaaagaggaacagaaagtggaagaggaacagaaagtggaagagaaagagaaagaggaacagaaagcggaagagaaatcggaagagaagaagaggaacagaaagtggaagagaaagtggaagacgaacagaaagtggaagaggaacagaaagtggaagacgaacagaaagtggaagaggaacagaaagtggaagaggaacagaaagcggaagagaaagtggaagaggaacagaaagtggaagaggaacagaaagcggaagagaaacagaagtggaagaggaacagaaagtgcaagagaagaagaggaacagaaagtggaagagaaacagaaagtggaagaggaacagaaagcgcaagagaagaagaggaacagaaagtggaagagaaacagaaagaggaagagaaagagtaagaggaacagaaagtggaagagaaagtgtaagaggaacagaaagtggaagagaaagtggaagacgaaccgaaagtggaagaggaacagaaatagaaggaggaacagaaagtgaagagaaagttaagagga

SEQ ID NO: 40777 - DNA, 1190 bp, Heterodera glycines
  misc_feature (33)..(33): n is a, c, g, or t
  misc_feature (54)..(54): n is a, c, g, or t
  misc_feature (62)..(62): n is a, c, g, or t
catattcatttgtcatttataaatattattatntaataaattttctgaaaactntcatggtnaacagaaacatttcgcaaattaaaatacggtaaaaatattaaatttaattatttttatttatttttcaagtttaaattaaaaaatgggaaaaatgaacatttattataaaatgaatttaatttttgaaaagactgcacaaaccgtaagggaaaaaagttgtaaatttttgattatttccttattagtaattataattttttaattttcgacacccgttgactattttcatttttaaataatattgttataaaaaaacaaaacttaaatataaataaaaaaaatcgaaaaattgtttaatgcacttgaaaagtactaattaacttaactatttctcatattcatttgtcatttataaatattattatttaataaattttctgaaaactttcatggtaaacagaaacaattcgcaaattaaaatacggtaaaaatattaaatttaattatttttatttatttttcaagtttaaattaaaaaatgggaaaaatgaacatttattataaaatgaatttaatttttgaaaagactgcacaaaccgtaagggaaaaaagttgtaaatttttgattatttccttattagtaattataattttttaattttcgacacccgttgactattttcatttttaaataatattgttataaaaaaaacaaaacttaaatataaataaaaaaaaatcgaaaaattgtttaatgcacttgaaaagtactaattaacttaactatttctcatattcatttgtcatttataatgttgtattttgataattaaattgactataattatttaaatatttcttggcttaatgtattttcttttattatggcgttatttttttcatttaagaatggttctttttattcttctcagtctttgctttttgattgacttcaaccaaatttgtttgtctttttctcttttaaattttgtgttgtgattaaagtgatttgaattgactccggtatccttattcggttttatccctgcctctcaacccaaaagacccggaaaaattacaatttggcgctcctgaggaacaggtacaaaagtggtggtgacaaataaagagtagggtgagatcggagaaatttgtttgaaagaggttttaacttttgtgcgtgaaaa

SEQ ID NO: 40778 - DNA, 1450 bp, Heterodera glycines
agttgctggtggtgtgccaccgccttggacacattgtcacgtgttcggtgccaaacaacacgtttttgtgccatcgtcggccgcaccgagccaagtgttgttgttgttgttgttattgttggcattgccatcgacgcattcatcttcctgaacgaaaattttatgagtgaaaaatcgaattatttttgtctcaaatccgacaaaaaaattcagtctcgattaagttcattggtcaatttaaacagtttgatcactcgagaagggattacaatagaggattttaaatcagtgatcagaaatcttggaacataatttcaatctcaagtaaaaacattgatcatctggattaaagtctcagaaagcggcactgatcagaaaaaaccggattttgatcagtgatgaaagggttcatttcgttgatcacttggttaaaacatgaggtttagcattcattctcgagtcaaaccactgatccatgtttcctccagctcggtaggcgagattgggtggtttttactaattgccaattatggatttaattgcctgacaaacgcccgaatcagcggacagtccggaggcacgggccaccgaatttcgggcaaagaattggctgatttgttgcggttggatgccaaattgacagttcaagcaggccatcatatttgttgaagagcaattattaatattattattattgttgctattattgttgttgttggaagtgatatgtttgcagtgatcggtcttaaatttataaaaaaaaaattttgaattttaattaaattaaaatattttgttttttatttaaactttatgactgttttttaaatggcaatataataagtttaatttaatgtattttatataatttattaatgaaatatttttagaaaatattttaaaaaaaaattgtttaatataaaatttaattaattatcacaaaattaatttatttaataacaatataattagtaaaaataatattaaattttaatatgttaaattttataatgagatatgtttcaacatataaattgcaatttaaaattatcaccagatggtgagaatggcattgtggaagaaattgccgagtcgtcgcgactgatcggtttcgacgaagacaaatcaaaatcggccgaatttcgaccaaatgaacaacgcaacacagcagtgtcggaagaactaataaaataattatgattatttttaaatattcgaaataattaattcttactcaaagcacctaatttgataattaagtatgagataatgaacccttaattagggcgtttggttgcccaataaaaacttataattatgaaaaaaacttaatttcatgctcctcaagaagtaccctaaaaagttttttaattttatttgaatacctattttattgtcgaaatcaagcctcaccctcgaaaaatcataaaaattcctacaaaaatctaat

SEQ ID NO: 40779 - DNA, 959 bp, Heterodera glycines
agtcagaaaatgggaaattcgtttggacagttagctgaggccttctgctgctgctatttgttgaggcaaactgcggaagaaaagctcatttgccaattttaaaaactttaaaatttcatttttttgcctcccccgcctttgactgaattttaaaataattaaatttattatttaaatattcattcacaccttttgctgctgttcattataattgttaatttactttggcatttccccaccttttggggtccttcccctgccaatgtctctgcggatgttcgtccgctgtccgccacctccgacccgtccccatcattagcgttcatcgcttccataagtccgcttcggatttcgttaagcgggtcctcaaccattttcctcattttactttggctaacattcgatttgagtgacgatgactcagacattgcgccttctctcatttcattggcatcgccgtcgttggcattggcgctgcaacaattaatttaaatatttaattcataatgtgtgtgctacatcatttctacctgcttctacgttttctcgtcacttcgttccccccatttttggcactttgaccgcccaattttccaaaaggctcctcaaattttcattttatttttttaatgaattaatttttgatttcgaccacttcctctggagtgagttcaataacggtttgttgctgttgttgttgattgtctgtggtgctcataattggtggtgctgttctcgtgtatcttacaaaattataaattatttttccaaataaattatttaaaaatggcactcattgctcgccaaatcgtccacggtcatttttttacagcacaacaacaggccggaaggacagtttcggttcagcattaaaagcctaatttgggcactttgtaaattatcgttaggtaatttgtttcccgacatttttgtctatttttgatgaaaattatcgaaag

SEQ ID NO: 40780 - DNA, 938 bp, Heterodera glycines
  misc_feature (825)..(825): n is a, c, g, or t
attttagcactatttttgaatacaaatatgccaatacccattttattaaaataaacttttttttattattattaaaaaaggttttgaggcaagaattagagcatcatttataaaatcatttgtatgaaaatatccatttatcatagtttatttgtcaaatattatatttttatcactataataattatgattaattaagtgcgttttgcgtgagtttttcaagactaagagaaggagttaagtttcatttttcaatttttgaaatcgaatattttcattggaatttcggaggcattactggaaaaagaattattgaaattttgcttctattttttagctcttacacaaattgccaattttgtgggtttagcctatttctgatcattttgggtactgcatttcaattgtcgccgccaattttagaattttgggtgagattgttaagagattaacgccaaaaaattgaaatattttagggttttaaaagtaattttgaatattcccaaatgaattaagtgttagccatgtgccgaggcgccttcatcttcctcccctctctctctcttcccctctcctcctccccccccccccttctccctcttccctcttccgatccctctctctctcttttcctctcttctccctccctctcctcctctctcgctcccgcctctctccctctcatcctcctctctcccctgcccctttcttcctctccccctccctcttcccctccctcacttcccattcatcttcctcccctctctctcttcccctctcctgctcttcccccctttctccctcttccctcttccgatcccctcntctcccttccgcctctctccctctcatcctcctctctcccctgcccctttcctcctctccccctccctcttcccctccctcacttcccattcatctttctcccctctctctct

SEQ ID NO: 40781 - DNA, 1029 bp, Heterodera glycines
tggatttgtatattattaactacgaaaattgccgcccaatttgaattttgaagtgcattgttttgagctacattaacaatgatgtgctgcaaattgggcacaattaacaataaaattttgaaatgagaatttttgtcggttgaaaatccccgcgtccgtaactaaataagtacataagtgtgagtgttgtgttgtgttagctaacgactgtttgcttgcggtgctgctgctgctttcgcttttgcgctttttgtttccggctcaaatcggcgccacaaatttaatggaacaaaaagcgctccctcccgcaattcgagaccgtttctcgaacatcccccccccaccacatgatcacgagcgagcgagcacaaagcggcactacccgctcctcaaacacacattttggcattctgtccgtcgtcgtccccctcccgctcccttcccttttcgccgttttcttttcgttttccgtttgatggatttccttgactgttgctgatccattttactattagcgcggtgcggattcagccccccccctttctcctctgtttttgctccccccccccgcgctcactcacagctcaccaaaataaaaccgtaaagggatgtgtcaagtgacatgtgggtgccgacggcacgtacacatgctaatgctgttcgagaccgaaaattttgcgagaccgacactcaaaacgaaaccgagacttgggcaacaagtctcgagacgctgaaactgatctcgtagctcgagatgcaaccaagactaaagcctgagcaaacttgagcttcttgcagatttagtgccaaaacaatttcggataatcagtgtggtcagccaaaaatggtacgaattttgaagcagtgaaagtggctgctgttgtttattcatgctcacctccacaaaatgctcacaaaaactagcttcgcctaccaaaagtgtcatatgttagcatattcgtacctccactccgatcagcagcggtttgttctgtttgttcctcttcatcctcccaatttccgagacct

SEQ ID NO: 40782 - DNA, 1070 bp, Heterodera glycines
  misc_feature (25)..(26): n is a, c, g, or t
  misc_feature (93)..(93): n is a, c, g, or t
  misc_feature (130)..(130): n is a, c, g, or t
  misc_feature (1059)..(1059): n is a, c, g, or t
gtatagaaaagggtgttcctatgcnnaaatggatacagtatctgatttatttcacacgcccacacgcccgttgaaaataaaaacacaagtgcnatgcgatggcaaaagttgtgaaattcaaacgcatttnacggccatgaattgccgggaagtgaggcgatcaaaattcataatgatagagaatgtgtggctttacctgttttgaagctaagtcgggcatctgacggctaatatgagaataaagtgcagttcgctctttaaacgaactgattttatggccactttctataaaggcgatggcggtcgctgtatgaccgtaaacccagttttttgtatagaaaagggttgtccaaattgcaaaaggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttaactgttttgaagctaagtcgggcatctgacggctaatatgagaataaagtgcagttctctctttaaacgaactgattttatggccactttctataaaggcgatggcggtcgctgtatgaccgtaaacccagtttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttaactgttttgaagctaagtcgggcatctgacggctaatatgagaataaagtgcagttctctctttaaacgaactgattttatggccactttctataaaggcgatggcggtcgctgtatgaccgtaaacccagttttttgtatagaaaagggttgtcctaattgcaaatggatacagtatctgatttatttcacaacgccnacacgccgttg

SEQ ID NO: 40783 - DNA, 1105 bp, Heterodera glycines
ccaagcgagaaataataaaataagatggtttagccacttgaccacttatgcatatgaacaaatgctttaaatgaaaataaataatttaattttttttttctcaaaaaatttctccttcttcaccattccctactcttttctcacccagacccccattcttaccagtgcaaatttttaccggcggtaccggcaccaaaaaaaccggtaattaccggtcggtaccggtaccggtaccggtaccggtaccgctcaaccctagtattatcacatattaaattttcaaaataaaattaattaattaattttgttatacagtatttaaataaaaattaatttaacttttttaaagtatactgtaaatacataattcaaaatgtcggacgttgacaaattgtcggatcggatgaagcgtttgctgtgcacgggtgttgatgcgggatgtgcactttttggttgggcaggacgacaaaaaagaggcgagttcggatactgaaaatgttataaatacataagaatgggatgaatttaggcaaaatgcctattttctcatcagctaactttgtataagagttgccgcgggtcggtaaaaaagtcggatcagattcctgtcgatagtcccgcaatttcaccaaacaattcggaattgcctttctgggtcccgcaaaatacggcccatgacctgctcccgcaccgattttaatctgaaaaactgagtcgggaagtcatgtcagaaatatcttgcctaaaaattcttgtctaaaaaatccacctttagttcaatttttttttgaaaaatcaatttttaagtaattttccaattaaacaattttaacccaataaaatatctattttttaaatttgattaattaattaaagcttctaccagcgcataaaccgattttgagagtttcgtccgatgttttcgacgcaatgtttcgatttgacgagcaaaaaagtggaaaaaataattttaattatttttcattttttcaatataattttttttaattgttagaaggaagtgaaggccctattgaaatcccggatgtagacattgaagcgtttaaaactatgttgagctttatttatacggacgatttgaacg

SEQ ID NO: 40784 - DNA, 1447 bp, Heterodera glycines
cgcgaagcgccacgtccgatctcaacaatttaaaaaacgggcgcgaagcgcccgtctggaggccgcgaagcggccgaaaaggcccaactaaatttaaaaacgggcgcgaagcgccccgtcaaaagcaaaacaaaatatgaaaaacgggggcaaagcgcccgttcgaggccgcgaagcggcctaaaaatcccagataatcttttaaaattccaaatatcttcataacccatagcttatctaggtagcgaagctcccaaagcgcgaagcgctttttcccagctaaatagccgacggttcacgcacccgctagtttatattaccatagagaaaagttgcatttcgtttcaaaaaacaaaatctcccggccgaaggccgggagcgccctgaatgtagtggaagggtcttacaactttttgaggcgcatctgggaaaaataagggttttccggtccggtggccaactgagtcccggcggctaatttctcacttttgcttgcgtttgaaggcccataactttttttctaaaactctgatcaaaaaatgcccgctgcgagggcaccccgccaaagggtcctctacatgctggtattttttatttttttaatagagccaccccctggcctgcagaaaatggcaactgaagcgtgctcaaaaagtacacttcagtaccaggctaataccgcgtcggcgtttgatctgagagaaaagtgcccagcagacttattgtagagttttggaagctcgattttctgaaatttaaaaatttcgaaaattttcaaaatttttcgagctaggcctaaaaaacggttttcgggtttttgaattttaagaatttttaacgaattttcccagataaacggagaccacttccaaaacatagtttttcgagctctatcgactggtatttttttcggaaaaatttcgattttttcccggaaatagaaaaaatttttggcctgagcgggacatttgagtcctgggcccataactcgtcaggggtcggttttagacaaaaaatgccttagagcaaaattgtagagctttttaagctctatctaatggtatactatatgaagggaaattttcaaaaattttcgagctaggccccctagaaattttcaaaaattttttttgggttgaaaaaaagggtgaaaaatatttttctggggtaaattagggtcctgagcacaaatatgatgtttattttaagtttcataatttttggaattttttaaaaattctttattttttggcaattttttggcccttggaaatttgggttaatattggaaaattcataacaaatcgaagggttgaccaattttgattaaataaagcattaaaaatggagaaaaatcaggagaattttatgggttttatttggcttttgtatcataaatatgaaaaaagttattccagaaattcttgaaaaattcggattttcagaa

SEQ ID NO: 40785 - DNA, 1302 bp, Heterodera glycines
  misc_feature (90)..(90): n is a, c, g, or t
  misc_feature (117)..(117): n is a, c, g, or t
aaaaataggctcttttaaatatgcctatttaaatacttcatgcttttccttgcttacgaccataccacgtgaaagcacgccatcccgtcngtctggcaagttaagcaacgttgggcntttcttagtacttggaacggagacgtcctgggaatcgaaggtgttgtaagcttttttcctttttcacttgtaaatttatttaaattttcaatttttttagctttttttcgaaaatttttttgtctttttttcggcaggcactgcctctgacaatgttttttatttatttagaaaaataattttttttttcttgttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctgtcctttcgcttacgaccatagcacgttgaaagcacgccatcccgtccgtctggcaagttaagcaaagttgggccttcttagtacttggaacggagacgtcctgggaatcgaaggtgttgtaagcttttttcttttaaatttatttaaattttcaatttttttagctttttttcgaaaaattttttgcaatgttttttatttatttagaaaaataaatttattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctttcctttcgcttacgaccataccacgttgaaagcacgccatcccgtccgatctggcaagttaagcaacgttgggccatcttagtacttggaacggagacgtcctgggaatcgaaggtgttgtaagcttttttcctttttcacttttaaatttatttaaattttcaatttttttagcttttttcgaaatattttttgtcttttttttcggcaggcactgcctctgacaatgttttttatttatttagaaaaataaatttttttttcttgttgatttattttaattatatttcatccttaaattttttaataaacattttcaaactttcaccttattaatttaaggcgaagtttgccttttttaataaattctcttgtgaaaaggcaatggagataggctcttttaaatatgcctatttaaattactttaa

SEQ ID NO: 40786 - DNA, 749 bp, Heterodera glycines
gcttagtactcgaagccgaagccgaaggcgaagcccaatttttattcgaagccgaagtccgaagctcgaagcccaaaaaacccgaagttttcgaagccgaagccgaagttttttcaaaatttttttttaattccaaaaaattttttcatcacaaaatttcggttaaatatcaaatagaccaaccaacaacccctttcgataaataaatataatgatttttttaacaatgtattttctgaatttttataattcttagaatactcacagtttttgagtcaatttaaaaaataatgggaattttggaactccggcggtgccgataggcgccgacgggaaaaatttgaaattttagtgacagatttagttcaaaaatgaaaagattttgcgattttaattgttaaatttatattaaatttccgtcgaaaaaagaataattttgaaaaattagaagaaaagaaagtacttggatgggaactgatcaaaagaaacataatgaaaagagcaaagagcactaccactcgaccatgcgtgcgaacaaaaaaataaaaacaaaaaattaataaatatatattaattcaagtttatcaaaagcccatcactaagggtgcattttcacattgaaaactcaatctttaggggtgtatttttcccgaaacttcgggtaaaatagccgaagccgaagcacgaagttcgaagctcaaaaaacccgaagttttcgaagccgaagccgaagtttcgcccacccctga

SEQ ID NO: 40787 - DNA, 855 bp, Heterodera glycines
  misc_feature (847)..(847): n is a, c, g, or t
ctttccatacaaaaatgggtgggtttaaatagaaaaataaaagcttttgtttcgggatcactttaatccaaataaatatgccacttgagatggaaaaagcggcctcaaaagttgccgaatgtttgggaagcattgaactgcgcgagccacgcgtgaatgtgtgagttgtactccttctgttttagatttcaatgtgtaaaaaaatagattgctattcttttcttttcggttttcctttaattttttttcttgcctaatcgttgcccctcacggtgttttcttttttagctactcaaatttcaccggcaaatgccacacacgtcgtttgacacaaatgcgcacggacattgctcggcaggtgaacaaccccgtcaagtgggagcagatcatgcagattctgttcaacaaaacaaagtgagttccccccccccccccccggattaacaatgaattttgtgactcttttcaggacgaagaattcccttcgtattttgaggttggccccggccgcgaattgggcacaattttgcaccaaattggcaaaaaagcttcaagaacatatgtgaactatcccgcctaatttgttatttttctgttgttacattggctatttgagaaaataaaaatgaaaattaaatttgtgaattaaaaatttgatgatcttcgttttgtttgtggaaaagcattggggcgctggcgatgtttccgccggcgatatttctttggcctttgaatgagtgactgtccttcccatcgtcctccaattttcatcacttccttattagtcatcggacgtaaatgttggccaaactgtgctaatgaaaggaaaagctgtaaaaacaacatnttgcgggg

SEQ ID NO: 40788 - DNA, 1428 bp, Heterodera glycines
gctgttccctattgggactcaacaatggaccaacgattggacgacccggtaattaaatgagatgtatgaatcggaattccaccctggggacttgttctaaactctcgtttttcagcaagcattggaagaaaacggaagggataatttctttaatattttattgcattaaattttacaaaaatcaacctttatatataacttagaaatttcttgtaaaaactgaaatgaaattttaaaatttaataacatatggaattttgaaaaaattttgtactcttttagacagttcgcctttattctaacaatttcctgtaacattccaagtcattctgacaactaagaactgaatgagaaaatcatctttttaagcttcgcgaacgagaaaaccctaaaaatattatccctagaaaactcgaatccgactttaaaccacgcaggttttatcccgttcaataattccgtttaatctgtcccgctcccgtcttttcgtccgatttaatcccggcccgactaatattctttttataagcaggctgattcgataatgtggacaaatttgttccttggctcaagtgacgacgatggttacgtcgttgacggttttttagcaaattggattacagtaaacttttgtatttatttatttattgcaaatatcagattacaatttaatttttcttaataaggccgaaatgttgaatttaacattttaaattgtttatcagtcaaatggagacagagttcagcgtaatctcggcattgatggagaattgctggcagaggacgagtttgttaattcatgaaccaaaaaataaaaaatatttatgctaaataaaattaattatttgattaaaacactcccaaattctgccaattcaaggaaaaaactattaataaaattcaaaattataaagtattatttaacgagtaattaggccgaaggggaaattttgaaaatggaggattttaatttatcaataaagtgagattaggaaaatgtaatatgcccatttataatttaatatttatttagaatcattcacataatcactaatcgtcgctatgaaaatgtttttggctttccttctcgtgtaagcttttggaaatattatttttatgatttatttcttcaatttcctttctaagaaggcaaaaaacactgaatgcactttgccaatgacgaaggcacaagatttgttggagttcaaccacaacaatgttcacacttggattggaggagacatggtagggtccaattccttctaaagttaattcgggttttttaaaacttatttttgttactgtatttttgagttttctgaatttaggaaaaattgccaacttcgccgcaggacccaatcttctttatgcaccacgccttcgtcgatttggtacggataaaacaaaacattgacttggattatcatt

SEQ ID NO: 40789 - DNA, 112 bp, Heterodera glycines
gattttaccacaattagtaaaacctatagaaagattaggtattacgacaaaagcatgcaaaaaattggcaaatttgaagcaatttcaatcaaaaatcggtgggattgggttg

SEQ ID NO: 40790 - DNA, 772 bp, Heterodera glycines
aataataaagtttgtttctaaaataaatatatttcatgaaaatattttttaattttcatgaaaaatttttaaagatttttgtttggatttttcatgacttggactcggtttaaaaactagaactctgacccggctttctgtacccggcaataccctgacccggtatttgcccaaatacccaggcccgtacccctaatttaatatacgattttgaagttttttaaattaaaaaataaggctacagaaaaaattgaaaaactctcgcctctcgccaactctcgtgtttttggggactctcgccaaactctcgctctcgtctttttggggactctcgccaaactctcgctctcgtctttttggggactctcgcctctcgccaaactctcgctctcgtcttttctgagacaagtcacacgcctggtacgtaccccgtgtggtgcgcagcaggggtggcacggaattccgatttccgaaaatttttggggcctcggaatgccatccctggtgcgcagcctgtaaccctaccttttacttacactcaaatttttataggagggaaaaagaagaaatcaatcagtaaccgatggcacgacgacatttcgcctactaacccgaaattgaatatttaaaacatatcatttttgtacattatcaaagaacaaaatgttggatggattcttgacgaagccgactttgaatcggataaacgattgactaacgccttgcatctgttatctgttcggtttcgtgatcaagattttgtggagggaat

SEQ ID NO: 40791 - DNA, 954 bp, Heterodera glycines
  misc_feature (15)..(15): n is a, c, g, or t
ttcttggattttttntgtgataaatatgatacaaacctagagaaatagcggcataccatgataaaggataatatttttaggcaaaagcctatttttttcctgagcttccctggtttttgagcctatttcttcatagcatataggcagaaaaaatatcgtacttttatcattaaattaccgtattgctggcttttgagtttattattagttttaacatttctaacttcataacttggatataaattaaaagtcattaatttatgcttacaaattagcgggaaggaaaatagttttagcaactcttgttcgttttacttacagataatttattcgcaaatcgattaatttttgagacaaataaattcaaaattaaatataattttggatataatttcaaaaaattaaatcattttttgatttaattttattttacttatataattctctcaaaagaaacatgcatagtattatttatgcatatgacaacttttctgatatatattaaattaatatttgtcataaaagtttctgaattcggaccttattttcagttagctatagatcaaccatattaattttttttgctatttttgactgtgattttcaaataatttatgtatctatttttttaatttcatggtccctaccggctttttccataattggtatatagtggataatccgtagttattttttaaaatttcgttgaaataatttcaattttcaaccttttaattccaccaacaattttgattctcttcattgatgctgtaaaataagcgaaaatatattttttaagattgtttaatatattttattaaatttatgaaacatattcaatctgctttgaattttaattaccttttcgattgatgatttatattcaataaaaattgtttaaactaaaaaatatagaggaaatataaattgggttcaaaagaccttagcagtcat

SEQ ID NO: 40792 - DNA, 819 bp, Heterodera glycines
ctacaaatcaaaaactgatgagcaaaaatttgaaattgtttagaaattgtgctgaaataacaaatgaatttaagcaaaaaggttgaaaatattcaagaaaagaatggcaacaaaattatgccgaaatttgtgagaaaattggagttagccattcagcaattagaaaatggagaaaacaatttggaatgagtaaatctttaacggagaaagaaaaaatggagaaaatgaaaatttattggcaaataaaaggagaaatgccgaaaatgagtgacaaggaaattggaaaaatgatgaaaattactagtagaacaattgcatattggaagaagcaatttggagaaggaatagtggatgaataaaaaacggaagaatctaagaaaatggaaaaatttgccgtaaaattttttccgaattgtaaaacctgagtattcattatttgttttttattgcgtaattttttttttttttatcaattcgtgatttaaattttcaaatctgtcataaaataaatgtgtgtcatgaagcccaaaaaaatttcagcaacacaaaatcaataattttttatttaaaaaaatgtaaaaatataacaaattgtgtgtcaaaaatggcatttttcacgttcaaagcatatttattgaaactttaaaatttcagtttttacggcatttttttcaaaaataaaaacggatccctttggtccaaaaagattgtaaggacgaaactttttgaggaagtttttttttgttaataaattaaatataaatatacaaaaacaattcgttttaatgctcacttttcattcctcagctttcggagctc

SEQ ID NO: 40793 - DNA, 1640 bp, Heterodera glycines
  misc_feature (1526)..(1526): n is a, c, g, or t
  misc_feature (1555)..(1555): n is a, c, g, or t
  misc_feature (1562)..(1562): n is a, c, g, or t
  misc_feature (1571)..(1571): n is a, c, g, or t
ttaaaatattaaaaactggtttaagatttttgaattatatccatggaaatgagaaattccaatatttcaacccctcccccactatcctaaaaattttggaaaattagaaatatcaaatttatcccttccctcatcctaaaaattcttcatattttttctgaaaaatattacagaaataaattgagaaagcggaaactttacggaaaattgaaaagaaattaaattaattaattaatatttaaaaatttatgtgcaaattagctttattttcggcaaatcttttaataaaccagaagaccaattaggatcggtcgggtctcttccataattattttaaattaaaaatttaggcaataaaacaaataaatatatttttaaataaattaatattatataaaaccataactaattaaagtaccaccaaatttacctgcatgacgtggtcattgatcatcatatttttctcaaatttgtcgatggtcggaatatggatgctgatctgaaacgggaggaaacataaatttttaaaattttttttgttcaaagatttttcgtaaaaataaatgatcaaaagaaaccaattaaaatttggacaaataattcagttggtggactttatttccaattatttttattaatgtaatgaaatttctcaaaacaataaaattttgattgaaatttttgaattaagagcgaaaatgccgaaaataagtgcccaaaaactcgaaaaacagtcacaggaaaataaagaaaagagtaaaaatttataatttcaggaaattaattaaagaattgctaaaaatatattagggatttgatccctaaaaagggtacaatttatttttgaaatatttatgtttcagagaaaaacaaatatttgtataattatcaaaaaaatgcactttttttggttctcctccggcgcagctgtgcatgatttccatgtgcacattctcgtatttgtatctaaatgaaaaaaaacaaacaaacatgtcatttaaaaataatattaattgcagaaataattgaaattgccccctaattaacttgcaaaacttaaaatattgcattaaattaaaaaaaaattaatgagttgagcagtaaattttattaataaattaaattattttttaaaaacaaatgaaataaaaatttaactaagttcgttaattgccatttatattattgtcaccaataatttttttttgccaattttgtaaaaatgtacagaattttataaatataaaggcttcgagaaaatttattggctattgaatatcttttgccaaaatattaaaaacacaaaatcgttttaaaccccacactaattatgctcaaataattttataagaaatattgaaggatttgaattttcaataaaacttactcaagtggctgcatgatcaggttgcttttgtttgcagctactcccattttgttgaccattggacagagactgaaaaatggagaccaaattttaagaataaaaattgacaaatatttgaaataaatgtgattcaattaangtaatattctttttggcattttcaattanatttcanatttaccgntccccatcacaaacatgggcccccaagctgcctttaccatcactcatttaaacgtcatttggctataaa

SEQ ID NO: 40794 - DNA, 937 bp, Heterodera glycines
agaagcatacagtaccacagaagcggacaacgccaccgaagcggtcaatgccaccgaagcggacaatttcaccgaagctgacacagtttccactgaagcacacgtaaccggaaaggtaaataaaaaacacaaaaaatccttaaatttcgcataggaaataaaaatcgaaatttctcattctcaaaaatcccctttgacttcttcagaaagcacaaagtgaggataaatcctgaaatatcagtatatctttctctgtactctaatcttttaacattttgaatattttgttaatgaatgagaaatttcttttattaaaaaatgcaatacaaacctaaaatgcaccaaaaaatgagctttatttaaattttaaaaattataaatctataaattatttattttttctgaattattattaattcaactttagatttttcatttgattaggggtgtacccgcattccgacagacaacggattttgtattcaatccaaacttgtgtataaaaatgttctcaaaaataataaataaatcttttttcgatcagagctgtcattaatttactgctaattataagttcaaaaacctccccagcggcgccgacccctagctcaaaaaagtggaaaaataatgctgggaaattttgatgtttaaaaaaaaatatttttaaattatttatatgattgcaaaattaagaatactaaacggatggataaattgcagaaagcacagcaggaatatctggacaaactgaacaaaacgcaaaattattttacagttcgtcattattattttaaatcaaaattagccatccaaaatttgttttaaaaattatttatttgtttaaggccgtcgtccatgaaaattttgcatttatggacagaaaccacttcaaaaaatggcgaaagggctcattaagaaacaaaaacagcagattaaa

SEQ ID NO: 40795 - DNA, 951 bp, Heterodera glycines
  misc_feature (919)..(919): n is a, c, g, or t
agaaaatcctaatgttttgtaacaataaatcataactttttggtgagatgattaatcgcttagcttctgctcaatgatagcttctaaacacgtagagcttttgaatgataccaattttgaagaaattaactgaccaacaaaaaagttatggccattcccatttgaaattgtacgaaacgccattgtacgaactgccttgacccctacaaagctgtctgtcctcttaccgtaaaggcgtgcgatttccgtccgactccattggtcgtcgtcctcttccgttccgtcggcttcgcttgtgcccgccattgtccccccgccctcttcagtcccattttgatttgtgccgttccgtcttcctcccttcccaatgtccatttcttctccttcgctcttccctcccattaatttcgcgtgccgtcgtcggcagtcgtaacggacgcggagcatctcgttgccgatgaattcccacttgggcccgtgctgtttgtacagctccaacagttgcacatcttcagcggagctccaatttctgctggaaatgaaaaagggacacattgctgtccatgtcccaagggtccattccatgcgaaattggcaaaacccttggtaagacctcatttcggcctgattgtccaggctagaaacgcggtagatatggtaacaccgtcggaacacttggcccgcggtacggtcgagcagccgagaacctggggacatttgcaaattatcatggccaaaattcagtcggcttacacatccatggcctgaaaagcgtcgagcgaatgaatcggatccgttctctgtgcgcctctcgcgtttcagtcgccgtcgccgcgctcaccattctgtccataaataaatggatgaaaagcaaatcggatgaaagacaccgtggcgcctcgtcctcctccactgatgngcttccgcgaaggacagccaattctcccctca

SEQ ID NO: 40796 - DNA, 1056 bp, Heterodera glycines
tttttgggcaagaattttttcgttagcatttcacatatcgtgtgagtgtgtggtagagacagactagagaaggcaaatgttggtaccaagtttgcggtcaaatccccaggagagaaaagagatagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttatctgcaagaatttttttcgttagcatttcatatatcgtgtgagtgtttggtagagccagactagagaaggagtatgttggtaccaagtttgcggtcaatccccaggagaaaaagagataccattttctcggcaagattttttt

SEQ ID NO: 40797 - DNA, 867 bp, Heterodera glycines
  misc_feature (839)..(839): n is a, c, g, or t
attatgaactcataatttttcttttatcgtagtattattatgcgtaagaagcacaaggagaatttatcaacataatttattcaaatattaattctattattgagaattattttttctaattatacatatttaaatatgcatcaaagttaaaaattatattgtgagttttttaattattcacctctaagcttttaatgaatatggctcgctattaatgctttttcgcttaataatttaaataaaatttaaacttcttaatattttttatttgagagataataattatttatttcatctcatgtttcgttttttagttaacaatgcttttatcgaccttaaatatattaagatttatgaatatcttgaaataataattaaaataacaattaattgtgcgatttttaataactatatattttaattttattccttgaagaattgcttccgagcataattttgttaaatggcctaatgaaattatgttttatcataaaaattgaaaaaataaatttattatcacagatatatttcttgttaaaataatttaatttttgagaaatttcatttaaaataaaaaataatgtaagcaaaacaaaacattcattccttaatttttataattgttttttcttattcaactgcatattttaatccaatatttattatataatggttattgaaaaaaaaaattaagttttcattatgatattgtatattgtttttttattaacagatttaatattccacattaaaaattttgcaagatattctcttttcgacaagaaaaatcataaaattttaaactttttgatataatttttcatataaattcgattgtncaattgactttttgtatattctttattt

SEQ ID NO: 40798 - DNA, 1054 bp, Heterodera glycines
tgctttggttgttgttcagcagtgtcggagttggaattcgcctaattatttttgttgaaatatgtactttttacggaaccggcccgggacggaactgcgggacggatgatccgttttgctgatcagaatcacgaacccgatatccatttcgacccatttctaaccccggacctgaattcgaataaaaagtcgaattcatttttcaccaaaattcacatttattaccccaaaatcgattgaaatgcatgaaagattttcaacttttatcgaattcggagtttagaaatgggtcgaaatgaatgtcggattcgtaatcagcgacccctaaaacctataggtatggtatattttttgtttggaaaaatgttaaaaaaagatgtggtgcataaacggaagaagagccgagaaagtaacaaatagaaaagaagaagaaatgaccagtggaggatgggaacacgcctttaaatagacaatgtgagggagataaacggaggagaaaatgggcacatgtaaatacggtccatgtcagtttggccctcacgtttgggccccaaataaaaatttttcaaattgccaaaaaaattctttataaaaactaacaaattttccacaaatacctaataagccccaaaaaggccaaaataggtgttaaaaattgaaaaaatccagtgtttttatgtacaaaagtgactaattttttatcaatttcgcccgcacaattgcaactggtcaagaaaataaataaataaattttggagacgaatttttgagaaaatttttcatttcttaggtgaatattttctgaaatttttgggtcgattcttaggggtgtattttgtatttttcgtttttattgcatttttactatgaaatttctgggaaaatcccaaaataggcggaccgggtcagtttagtacggggcgttttagtacgagcgcacatttttccactataacttttttatttgttatccaaatccaactttcttgatatcattcgagagcccttcagatgctctattagcctgcaaaattccaaaaaatttagtcaattt

SEQ ID NO: 40799 - DNA, 971 bp, Heterodera glycines
atatcacaaaagtgatcatgaaaattgtaaattgggagattattggggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattgacgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgacccactttttgattctgacattttcagctcattacgctctaaatataacagcatc

SEQ ID NO: 40800 - DNA, 1203 bp, Heterodera glycines
  misc_feature (1086)..(1086): n is a, c, g, or t
  misc_feature (1112)..(1112): n is a, c, g, or t
  misc_feature (1166)..(1166): n is a, c, g, or t
ttttgcatttaacagacccattttaaaatttctaattagtatagtagtccaaaccttttattatttttttttgactagtcttctggatggggttatccccagtttttagtatccttttttgaaaaacaaaaaattttaataactgattcggttagccaacataccattgccccaatgttcccttcggtttgccaacgggagctaacaatggatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatntttattttttttctatctcttctctngaaggagttataacaatttttcacaacagttttgcatttaacagacacattctnaaatttctaattagtatagtagtccaagctattatta

SEQ ID NO: 40801 - DNA, 749 bp, Heterodera glycines
  misc_feature (27)..(27): n is a, c, g, or t
caatgtcaaaagtcaattggtgaagtncaatgagcgatttcttttggaaatcttcaaaaattggaaactgttgcttttccgattgacaattacacggatgggcgcagtgacgggaattttttagaggatatgacgcaacgcgtaaatgaacttaaactagaggaaggacaagcaacggttgggcatggaagaggcgaatgggcaaagcaattggtggaggagaggaagacaaaagcggaacaaatgcaacaacggaatggtgagaaagaggaaagagtcgggacaggggatacatgcaatctgctgattgggggtcacaatacgctcgaggtacggcccaacccaaacaatatgctaggcgagatagcattggttacaatatgattatgattcaaatatgcaatagtaggggggggggagagatcgacccgcttccatcgaacgaagtccaagggggggggggtaatggttgctttcaataaaaatttgacaaaattcagagtacggaaacagcgaaggtagtgggctcaattgcacatcggcgaatgccatgcgaattcccttgtcatcggttttcgagggtatttcaacggaaggtcaaaaaattgacaacgaagaaaaggaacgaacaaatgaagaggaaacaaagaaacggaaaaaaggacaagaaattgttgaggaaagaaaaggcgaaaaacagcaacataatgtggaaaaggaaagtaacactttctgggacaacgtcaaaa

SEQ ID NO: 40802 - DNA, 808 bp, Heterodera glycines
cttttgtgcttcttctgtgccagaaaataaatgttctctcccagttatttatttttcggtttcggtgggctttagccttctaagcccccgccccccttcgctacgcccttgcggagatccgaatttgaacagcattttggagaaatacgaggggataactttttggagcgcagtgggacatttgcggacggacatttgcggacggacacttgcggacggacacttgcggacggacatttgcggacggacatttgcggacggacacatgcggacggacatttgcggacggacatttgcggacggacacttgcggacggacacttgcggacggacatttgcggacaatttcgtgaaaaataaaaaaaatatcgtaacaaaatttaaaaaattttctgaaaatatggaatggagactgcaaaaataaataaaactttgtttttgggttttaaggcctaatatttaatttcactggtcaaaaagtgcaatgctggtcttttaagtgattaaagtagagttggtcccaagatcggggaagtgtgaatgtcgcctgttgcactcaaattcgggtgagagtgctgtttttatctttagaaaaaacccaaatatttttgaaaatttaatcgaaaacaaaatttgcttgcaatttcaaaatgaacaggctatttaaaaaaaatgctgaacaccagctggctgcaaaaaaatccgattcccgacatttttgggcattagatttccgatttccttttctaaaaatttttggggccctgaaatgctttcctgcttatgaacagtagagcaagaattatct

SEQ ID NO: 40803 - DNA, 828 bp, Heterodera glycines
ttccatgagttttttgttcctgactctaaaaatgactgtcttgtgagtgagaaaaacccggtctcaattaaatcctggttgacggggattcgaatttttattattggacttcgaacgaagaaaaaaaaaatcaaattaccgtatttcctaaaaatagaggccctcggaggctttattttccaacccccctcagcagaagggggaggctctaatttagggggggggggggagggtttattttaaaaaaatacgataatatcgaaatttctaactcttttcctgaaaaattcggaattccgtgggcacaaaatttttttggaaatcgggatttttctccttatacatatatctagagtgccacgggaccgggacctggtagcggacaactgagtaccaaggtcccggttttgaccgggaccgggactagtcccggttttttcccggttttcccagccaaaaattcccggtttttcaacccgaaaaggtcccgttcccgggtttgcccaaaattcccggtcccgtggcactctacataatagatttttgtatctaattgccttcattttttttttgcacatttgctgcgagctcaaactgctcggccaactgccgttcaatttggacgtggactcggagctggtcagtgccgacgagttgttggccaggaatgaaggcggcggcgcaacaacagcagcacaaatgttggccaccaaactgtgtgttgaggaaatgccgtcgtcgcaaatgacggcaaagagtgccgccgacgacgacggcacggaaataatcggcggcggcagcgctgggatgacaacgacagcaacaacg

SEQ ID NO: 40804 - DNA, 1181 bp, Heterodera glycines
gagccaattcagcggaaaccgaagctggaggtgcgcccttggctggcgcagttgtctttgcatgcgactttagctgagctggaggagccgaaattgtcggcttaacagatgggctctttacctcagttgttgtctttacagttggcggaggggctgttgttgcctttacagttggcggaggagctgttgttgcctttacagttggcggaggggctgttgttgtctttacagttggcggaggggcggttgttgacttaacaggggtggcggtagtaggctttgctgttggttttggcgattggggtgcctgttttgttactgtagactgcgttgctggttttgcagttgcggaaggtgctgcagctggagcagcgggcgttttgactgttgttgttggcttaacggggcttgtgacaggcggtggtggtgccgccgaaatttttgtttcttcaaaaggaggcggtgactcctcaagtcgttcgtcttcatttatattatacaaaggaggagagtcctggaggcgttttccactcgcgtcaaacactggcggtgatgacacatctcttttctctcttttcagtggtggtggagaatcaagaagctttgttcggttcctgttcgcttccacctcacggggtgttggcaacagttttgctccgctgcgatttcgcaatgttaccgccaaaaagtctctgagctgttcaaccctgctatgcgatgccttaggtaccggtactcggatcacccgctgtctgtcctcatcggtcgctctgcggtcggtgaagtgaatgtcaatccactgcgcatccaatgtgccaatggttgaccatgagtaggggtaactgatactgtgcagtccgcacacccacgagccgttaaaatgcaaaggctttgggagccggacacgaaatttgttgggctgattgtccggataatccgacacattgctgggcaaaaacacaaagaaactgttcgacatgattgtttatttttgaacaaaatgaaaaatgcatatgctttttatacaagctgagactcagcaatccactcacgattgagatatcctataaatttgacaagcatctcggtggtcccgtccgatcgctatctcttcgtgtaaaccttctcgatgcggtagcttgtctctgcattctttcttacgcgcgccaactcctgctcat

SEQ ID NO: 40805 - DNA, 1388 bp, Heterodera glycines
  misc_feature (15)..(15): n is a, c, g, or t
  misc_feature (65)..(65): n is a, c, g, or t
  misc_feature (1282)..(1282): n is a, c, g, or t
  misc_feature (1307)..(1307): n is a, c, g, or t
gagaaattttatacntcacaaaagcgcttgcgtatgagacggagggctgtgcacaatcgccattntattcacagaggattttatatttagaggttatccagaaaagatgctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatttaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaatttatacacatancaatgctctcgagcatgataggganggcggtgcgcaatagaacctttatttttgagggaatttttaaattatactctatcccagaaaatggctatctctttttttg

SEQ ID NO: 40806 - DNA, 1516 bp, Heterodera glycines
  misc_feature (91)..(91): n is a, c, g, or t
  misc_feature (1412)..(1412): n is a, c, g, or t
  misc_feature (1438)..(1439): n is a, c, g, or t
  misc_feature (1476)..(1476): n is a, c, g, or t
aaagtttattttatttttaaataaagaatattattgcgcgatttgcattaaatatattggttacaagaaagagggcaatttaatttttcanatactttcaagcaattcgtcgtccatcaaaaaaatgccgaaaagcgcaatttttatttatttatttttaattgcttttttatgataaaagataaggcggaagaaagggaacgacagaatatttggctggagaagcgacatcaaaaagaaaaaacggcgctaattgttttatgttttatgtgaattgcccacaaatagtcaacgataaaattgtgtaaacattggaacgcaattttatgtaaaagaagagaaaaagtcgtaaaaataaaaatagaataaaaataaaaatgcaaaaaagcgatttattaaataaaacatttaaattacaaaatttaatcggataattaattaaaaaagaagtgatttattaaaacaaaatttgttaaaaattacaaaattactcgttaattaattaattatgccttaattaatattcagaaatgcttttagacagacaaaaatcccaaaaaattgaatgtggtggtgacggttttccgcttaaagctgctcttgctgattcctcactcattgatcggattttgaacattcgaaaaaaaatgtttggagaaatttaattattttttgcaattttcacaattttggcaacttggacattgttcaccactttttatcgttttgtcagattaattaagaaaatacaaatattgggttatacaaattaattaattattcaaaaatcatgctcacttacgtatctaagctctaattttggataaattgtcggtacaggttccgatctcttctaattggatggacaatttaacaactgcaaatttttgtgatgatttgtccgaatgttttttgatttttaatttgtacaatgaatgtgacaaattgtcaaaataagtgatgaattgtccaaataggtgatggattgtcgaaattagtgcgataaattgtccgaatatttttgagataatcttcttctttttttcaaaatccgttcttatgctccttaaaattgcaccattttttactttaactatgctgctaatcattgcttctcatcttcggtttcttctccttctgtttcttcagcaattcattcggtttgtgccaaattggcgattctctctcaccgaaggccggcgaccgccgagttgggcataaatgctaattgaattttttattaaaatttataatttataaattgaatttggttttagcttatgtcattaattaattaaaaaaataaatcttctattaaatatagtttaaaattgattcagattaaaaaaacaacaaataaatttggaatgactaataatttagatgggcaattataaaaaaataatgtctgnaaaacatctaataataatccccatannatattcaaattatatttttttaacttaatgaacatanataaaaattttatattatttttaataaaattttatataat

SEQ ID NO: 40807 - DNA, 719 bp, Heterodera glycines
gcagtgaaaccgttctgagatatgtttaatagggtatacggtaatgccggaattattgaacttatatactgtaaccggaaaattgggtacaaaaaaataaatttgaaaaatagtatttcaaaaccaaaaagcattaatttcacgaaaaatccaacggaatacagtaatcccaaagctattataccgtagtttttgccccgccccgccccccatccaattgctctcactttatccgcaatatgcgtgttcgacccaaggtcggctaaagtgtcataaatggcattttgttggggtgccgcgtaatgtgccgccgtacggcccaacttaaaaaaaatttggcaatttgaaagtcaatgttggcataatgtcttcttctttttttacatggtcagcaatgttgatgaagtcagcaaacgtttggccaatatattcgaccatttggtgccgttcctgaagcaattaggtaattaattaattgtgacaaggctcgacattttgtattctggtcctggtatttctctggatctccctctattacaactccggtcgcgcaaaaaattctgggatggtcctgggcggtgagcaccgctatcctgttttcgctaagtgttgcgcagcgcccggcggcgcacagctagcggctgggcgccgcttggcgaaatgcgtgccatgccgtggggagcattttaaaaaaaaatttggcccgatccgacaacttg

SEQ ID NO: 40808 - DNA, 867 bp, Heterodera glycines
atttttattcttcacccttattcataatataaacctacctaggaccttgttaacatgtaaaaaaaaattggtgcgtttcagaacactttctgaaaaaattaatatgaattaattttgcaaaaataaaaatagaagactcagcattttgaaatttttataacaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaatatttattcatctccttttttgataatataagagtcagagtgccttattcaacttgtaaataaattttggatcgcgttcagagcagtttctgaaaaaaaatttatgaattaattttgcaaaaatcaataaaaatgaaccctcctccttaataattttcctgcgcccatggtactcactcggccgcttcgcggcctcgaggggggccttcgcccccctcatttcctggacccaatagcctcaatttagggctgtctttctctctcaaaaattccatatggggtagacacttaacagaatatgcctaggtcgagtagccagtgaggagtgcctgccacaaagaatggcagacttctaccaaagggccaaagggatatccgaagactcacacgtaaggtcgtattgagactaggtttacacgggcccgggtatttgggcaaaaaccgggcccgggtattaccgggtattgaaaagccgggaaccgggtcgggtacaattttaaaccgggcccgtgccgggtacccggtaaaaccgggcattgaaaatttctatttttatt

SEQ ID NO: 40809 - DNA, 1114 bp, Heterodera glycines
ccccccccccccccccccctcactccgtcatcaaaatgagcaaaaagctttgattgcctctcccccccccccccccccttcctcaaaaaatgaaagatgggaaaatggggaggaggcaaagtgcgaatttaaaaccgaaaaagtcttagatttataacacgaatttgcaaacaaaataaactgtgattttccaccaaatttatatatttcttccaaatgtattgaatttaatttggcgtttctttgttcactttttaattaccatttccatttatttaacttttccatttaaattttaattttgctttttaatttcatccattattattttttttaatttttacttttttctgctttaaggttttcccttctcactgaccatttatttcaccacaataagaaacagtgaatttcttacgccaattttttctatgcccctcaaaattcgccggcaaaaacgacaccaaaattcgaactgagcgacgaaagaaagagcagcgaaaaagggagtgacacaacaaaaacaaaacaaccaattggagaggagcaaaaagtttgtggccaaaacggaaatgtccagcaaagaaaatgggcccaagaatggttcggctgagcaacaacagccggggccatcgacggcggacgagcagcagacgaagggcacaacggtgacggcgagggtttgattttggcatttaaaataggaaaaaatggaaatttgagaggggtggaaaattgaaaaactatgacaaatttagttgtaaattttgcacttccaaatccaaaagaatttgccgtaaaaatgtgtaattgtgagtgtgtttctgctgacaaactttgcctttttcttcgatctgtcactttttttgagtcacttaaaatttcctttcccaaaaatattttcccgtttttccccaattccgtcaacattttattgacatttattccattcactctttgctcttttgtcgtcgtttaattgggacgggtgttgtgtttttctgttttttttgggtgtgagaattataaataatggcatgggaaaatgcttttgcattggtgggaaaatccctccctcgccgtccttttgctgatggacgacgacaccccccgg

SEQ ID NO: 40810 - DNA, 732 bp, Heterodera glycines
tgaggccgcgaagcggccgaattaaaccttaaatataaaaaatgcgcggagcgcccgtcctgaggccgcgaagcggccgaatatcccccatgaaatttaaaaacgggcgcgaagcgcccgtcctgaggccgcgaagcggccgaatgtcccccacaaaattaaaaaacgggcgcgaagcgcccgtcctgaggccgcgaagcggccgaacgtctcccaaaaaattaaaaaacgggcgcgaagcgcccgtcctgaggccgcgaagcggccggatccctcccacaaaattaaaaaacgggcgcgaagcgcccgtcctgaggccgcgaagcggccgaattaaaccttagaatacaaaagggcgcggagcgcctttgaggccgcgaagcggccgaattaaaccttaaatataaaaaatgcgcggagcgccctttgaaggccgcaaacgggccaatagcccccctcaaaattaaaaacgagcgcgaagcgcccgtcctgatgccgcgaagcggccgaatatccaccacgaaatttaaaaacgggcgcgaagcgcccgtcctgaggccgcgaagcggccgaatgtcccccacaaaatttaaaaaacgggcgcgaagcgcccgtcctgaggccgcgaagcggccgaattaaaccttaaatattaaaagggcgcggagcaccctttgaggtcgcgacgcgaacgggagtcctccacacaattatgaaatgcctcctcgcgat

SEQ ID NO: 40811 - DNA, 825 bp, Heterodera glycines
  misc_feature (5)..(5): n is a, c, g, or t
ttttncatcaaatttttgtttcaaattaaaattctattctttttaggaaaattattatttttaaaaataattttcgaaaaatttaataatttatcataaaagtttatagacgtttttttgaaatttgcaaaatagagatttttttgaaaaatgctaattgtatgtatgaaaaaaaaatttttttttgggccgagtagggagggaaagagattttcccgtttcaattcattgtcaatcaatcaatcacttctttgccgttaatgtcgtccaattcgaagcgggacgcttcaaatttgggcttggcccatgccaactccgactgatcggacggtttatctagcccggcctcgttcacagcgaccacccgataatagtagcagtgcccaggctttacgcgttcgtcagtgtacgcgcagtcgtataccggatgtgtgttcacctagaaaacacccaaatttgaaaaaaatggaaaaataaaaatggtattaaaagtaaacatttagttaataataaatttaaagaaaatttctttttttataaaaagaaaataatttccttgcaaatagagtgaagctagaccgggaattttgggcaaaaccgggactgggacttaccgggacctgagaagccggggccggacctcgatttttgttcgggacagggaaccgggaccaaccgggaaatttaaaaaattcaaaaaaattcaaaaaaaataaaaaataaaattttttaattcatttcaattgaaaataacacaaaattaaatttttattttgtttttatttaataaatccaaaagttaaaagctaaattaaattaataaaa

SEQ ID NO: 40812 - DNA, 1312 bp, Heterodera glycines
  misc_feature (54)..(54): n is a, c, g, or t
  misc_feature (66)..(68): n is a, c, g, or t
  misc_feature (105)..(105): n is a, c, g, or t
  misc_feature (115)..(115): n is a, c, g, or t
agcagtgacagactaaaaatcttataaaaataatttacaattattacttaattnttattggtgtannncaataggtgtcagcaggaaatatgaggctggcagttntattacaatntaaatggtataaaggaagtgctattattagagagggccaattagatagaactcatcaaatcatgcaccattgttttattcgtgatgcgacatttgcgccgcagacacttgcgccgcgacatttgcgccgcccagccaaatcgacacttgcgccgcagacacttgcgccgcgacatttgcgccgcccagccaaatcgacacttgcgccgcagacacttgcgccgcgttttttgcgccgcagacacttgcgccgcccagccaaatcgacacttgcgccgcagacacttgcgccgcgttttttgcgccgcagacacttgcgccgcccagcaaaatcgacatttgcgccgcttttaaaaaattttaatttcaacaagatatttaatcaaattaaattgattaaattagtttcattcttcaaatcacttcattcctaggcagtattgaagggcatgaatgtgtctgatcaaatcatcattgtttttgttctccttggcatcataggcaatgataagccaccttattgcctgatcattttcgacatattttttgacgagggcgatctgcaaggccacgagtcacatcaatttcaaatgatcgcagtcagtctgttttgctgatattcttcttcatttttaatctataggtgtccgaattacggttttgcataagaatgtaggctgctggtatagaaacatgcccgattaaggcatttactgtatacaattgcaaaaaatttggcggacacactaaatacacttttttcagagtaaaaatcatacttttgcaaccttgaaatgttccatctcccgaccaatttttgtattttttaagtcttgccaatccattgtctgtggcaaatataaaaaaggtggccaattcagggtccgttgtacgagaatcaaataacaagaatctgttgccagctttgtccaatataaattctccctttaattttttaaagtttgtgatgtatgcactggtcaaagaaaggaaattagatgtttatctctgtgattaatgcttttctttagttaggcgtttttttgaaattttagtcaataaaattgttgaaattaaaatttattaaagcaaaatgtcgattttgctgggcggcgcaagtgtctgcggcgcaaaaatcgcggcgcaaaaaacgctaaagaagtgtctgcggcgcaagtgtcgatttggctgggcggcg

SEQ ID NO: 40813 - DNA, 1100 bp, Heterodera glycines
tctttaattcttcaaaataaaccaataaacactaaaggtgggtcttaagttttagaaaaatactataaaatttttcaacagttgttttttattgaaatttttgtgtggccatttgtgaagggtggtttaatttcataaataaagtttgaaattaagcttcacacgaggatctggaagtttcaaattttcttatccctcagcgggggattggtactttaattttgcggtacagactctcgtgggaccaatcacgcgaaatcccgcaatttccaataataggggatttagtttgaatcccgcaatttccaaaaataggggattatagactggaatcccgcaaaatccccacgcaggatcccgttctgcgccgggctctacttcacactatcatacctggttgttgttgatggaacagataatcgcaatgatattactctaaaacaaaatttcaaaaattaattttctttttttacctaccgtattcatttccctaattgctgcagacagcttttccgcttcaatggtggcatcaaaatttttcttggccacaattgtaggcaaattttcggccaaacattggccaatcacgacgaacaaaaggcccagcagaagcagcatggtgttgttataattcagcttttcttgtgtcatttttcatcagcaaaaaaaagaaaattgataaatatagtgaattttcgcaaaacggaaatgcttaaattgccaaaatttttatgtgtgaatgtctcattaataacgccataatacggctgaacatcatctaataatcaatacccataaaaaaatactttgaacacgtaaaagaaatgccatatatttacgccaacacattttttggcatcgtaaatgccacccacgcttccggaaattgcgtcaattaaaaattacttcgaatgaaagtgtcagcaattatgggagagaatgattttcagctgattatcatcaacacccactcttttcaaattgttaattttttaaaataatattttcaatatttatttattcatggaaaacccctcaaaaaagtggttacgtttaaaacacacaatttgtctgatcattttaaaatattgatcagattt

SEQ ID NO: 40814 - DNA, 799 bp, Heterodera glycines
  misc_feature (786)..(786): n is a, c, g, or t
tctcgctctctctctctctctcctctctctctctctctcgctctctctcgctctctctctctctctctctctcctctctctctctctctctctccatttccatctcctctccaatccccaattagttccgttacttttgtttttttttctcccacccttttccatgtgttccacttgaacttttcccccgcttttatcaaatttattaccccataattaccatcattagttcaccattcaataatttgttttaatgcactttaatgcttagacctactgctgctggtggagttcattttctcaaaaaaaaagaatttatatttcaaatttattttgtgtaattatttattccgtttaataaattcccataaaattccgatcgaaaatcaatcgatcaattaatagaatcatgatcaattctttgatccctatccgagtataatcttgaaaaaagaatcaacggactcgggatttattctaatcacccaattcccctccaattctcggcttttaaaaattcctttttttgttttttggcattttctcgccaatgtttcggattaataatactatctcttagaaatataggaataatagcccatattgagaaatttttcgaataactttattatttttcttatttttttcaaaaaattttaaataaaagagataaatttttttttcaaaaaaaaacagaagattttaaagaaaaattacaaattttacataaaagaagtcaaattcttttttattctcgttttgtaaatacataaatttttttttctnatatgttcgacct

SEQ ID NO: 40815 - DNA, 1289 bp, Heterodera glycines
  misc_feature (961)..(961): n is a, c, g, or t
  misc_feature (969)..(969): n is a, c, g, or t
  misc_feature (978)..(978): n is a, c, g, or t
  misc_feature (981)..(981): n is a, c, g, or t
  misc_feature (985)..(985): n is a, c, g, or t
  misc_feature (996)..(996): n is a, c, g, or t
  misc_feature (1017)..(1017): n is a, c, g, or t
  misc_feature (1024)..(1024): n is a, c, g, or t
  misc_feature (1028)..(1028): n is a, c, g, or t
  misc_feature (1030)..(1030): n is a, c, g, or t
  misc_feature (1050)..(1050): n is a, c, g, or t
  misc_feature (1065)..(1065): n is a, c, g, or t
  misc_feature (1087)..(1087): n is a, c, g, or t
  misc_feature (1099)..(1100): n is a, c, g, or t
  misc_feature (1103)..(1104): n is a, c, g, or t
  misc_feature (1107)..(1107): n is a, c, g, or t
  misc_feature (1111)..(1113): n is a, c, g, or t
  misc_feature (1123)..(1123): n is a, c, g, or t
  misc_feature (1128)..(1128): n is a, c, g, or t
  misc_feature (1145)..(1145): n is a, c, g, or t
  misc_feature (1148)..(1150): n is a, c, g, or t
  misc_feature (1152)..(1154): n is a, c, g, or t
  misc_feature (1156)..(1157): n is a, c, g, or t
  misc_feature (1169)..(1170): n is a, c, g, or t
  misc_feature (1172)..(1173): n is a, c, g, or t
  misc_feature (1184)..(1184): n is a, c, g, or t
  misc_feature (1189)..(1189): n is a, c, g, or t
  misc_feature (1192)..(1192): n is a, c, g, or t
  misc_feature (1196)..(1197): n is a, c, g, or t
  misc_feature (1231)..(1232): n is a, c, g, or t
  misc_feature (1234)..(1234): n is a, c, g, or t
  misc_feature (1237)..(1237): n is a, c, g, or t
gtctgggaatggcaccaacattttttgccgatttcccactttgttttttgcacattgtttcgacttgaacgataaatgtaatccgccatttttgacagggataaatttttcattagaattaaatgcacataatgaaatgacaattaacaaaaatgggagataatctccacgtaaaggctcagaattgacgtgaatatatcaaaaaagaaatgctgtggcatatttttgttgggtgggggcaaaaggcaaatgaaaaataaatttggggagggacaaatgaaattttggaatggacatttacaatggaggcattacttaattgaatttccaattttataaagaataattaaattcattttgaaatcaattaaatatttacccacgcctaattagcactaattgagtgtccgtttctctgcttcagaatctcgacattcccatcgcaattctgcagtccgaagcgcttaagccgcgcgcctcttcactgttcttttggtttgctttgctcgcctttgcgatggtttcgattgcgtcggccgccgctggcacagtgttcgcaagcggtcgcattcgcagccgacaacggcgatacgcaaaaacgtggaagccggaattcccagcacaagagtcgaaaagtgatccataattttgaattacaaaatttaatttcttatatattttaaaatggaattttcccatttttagtcgccaaaaattcgctggcaactttgtgcggtggggtcggccctggccactatcagccgccgctgattgacggcaacacacaacagcatctgttcaacgcgtacacgcaacacaaccaccaccagcaaaatgcctaccaattccatcagccgcagcagcacagcaaatatttgatgttcaatgccggcagcatcagcacggacagttgcgcgtcgtctaccgccgcgtcggccattccgctgattcgcctcgcggnccgtctgntctgtttgncgngccntgtgcccgccntctttgccttcggccgcgtcntctgccngcgncngcgggggcctgggtgcggcngtgggtttttttggnttcgttgcctttgtttttggtnttgtttgttttnnttnnttntttnnnctctcccttntttgngggctttcctcttgggnttnnntnnngnntttttgtttttnntnnttttctgtctntttcntcngctnnctgtccggtagaaacagccttttgggcccgcccnntntcnttctttcgtctttaagagcaaacagcagacaattcactcaaattcgtaataa

SEQ ID NO: 40816 - DNA, 955 bp, Heterodera glycines
gattagcatcggggttacgagatagaaaattgtcttaaaaagagatagccatttttctgagaataattcacattttccgcagctctggcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaaatcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagcccatttttctgagaatta

SEQ ID NO: 40817 - DNA, 1192 bp, Heterodera glycines
  misc_feature (736)..(736): n is a, c, g, or t
ttacctttttttaatcttaattatcttaagaaaaatcaaaaatatgtaaggctatacaatatagggattaaaaaacaaatatgaagacaaggccttggattaggagcgaagcaaaaagttgagtgaatgcaaatcatgacaagatcctgttctaccgggctctaatagaaatctattttttaaaataatttttaagataaataaaaattataaaaattcgcgaaataaatttttttcctaaaaatgtaaaaagaaaataaatgttatttatcgtgaaaaaaagaataaatgaaaagaaattttatctcctcaatgttttttaatcctcatttaattcttcttcaaattgtttcctccatttgaaaatggtccgttgattaattttcaatatttttgaaattttctcgtcactcatttttgggttttctcttttcattttccaatacattttcattttgtccattttttctttctccgtcattccttcacccattccaaattgtttcttccatttttgaattgttacataacttactccaattttcttcccaatttcggcataatttctcttccattcttttgtcgaatattttcttccattttgtttatattcatttttcattgcattaaatttttgcacaatttcaattttttgtacatccgtttttgatttgttgtgccatttgtatattcctaattctttgatccatttataaattttatgtcgttttgtgcncaatttttttgcgattttcaattcaattttattccattcttttgatgaatattttcttcctttttgtttgatcctttctttaatttgatagtatttttgaataatttctctttttttctgttcattttctttttcttcccatttttctccaaatatttcttcaaatgttttttgttccgctttttccttttctgctccaatttcaattttaataattaaaaatacaattgaaaagaataataagcaaagtttcattgctgacaattttttgataaaaattattattagtagtagggccgcaacttttattgacgaaaaatctcgaaatagttaactaaaatagtgagtaaaaatgccaaaatagtgacgaatagtgcataattttcagccaaaaattgagcaaaaataatttttattattcactatttgcagttgcaaatgagtaggactgggatt

SEQ ID NO: 40818 - DNA, 1009 bp, Heterodera glycines
  misc_feature (47)..(47): n is a, c, g, or t
  misc_feature (895)..(899): n is a, c, g, or t
agcattttaaaatttgattgaccaatccttggaatgctactggtagngcttttagcttttttaggctaagtaacttcctttaaacaaattatagagtctttaatcaaactctttaacaatctcatttatccccccccccctcctcaaattggtcaatcttccgatcgtttttcctccactgaaaaagcaccatattattttctctccctccccccccccccggggggattcgtttttgtccatcgattgattggtccgttggtcgggcgaaactctctaaatttccccgtactatctcttcattctctgctatacagcctctctcatcttacgtttactctctctctctcctctttttttattatgttaataattctgtagataattatcaaatcagtgcctaattagttgaaagaaatgtttaaaaaagtgacgaaaaaagataataaaaaatattgttctttttctattttggataataattcatttaattttatttttattcattttcccctaattactttttgatcaataaattaaaaaacatttatatagattatttgcctctgttttttttgttttgtttattccttttttaatcttttcccttttttctcccccccccccctttttttgcactttttgcccattggaagtgtctgctgctgctgttttcctttttcctgtgaaggacgtctcgaaaatcgcttcgtccgccggtggctggctccgccggtcaccccgcggggaatgcaatgggcggggaggggcgggggacagagttttttgggctacggtcatagggcagcggcggaggaggcacaaaaacatttctttgagttgggctatgctgtggtgttttgttgtgggttttgttggttgaatgctgaccccnnnnnccatcataaatatattacacttttatcattttatttattcaagtttcaagtttttcaaattaattttaaaatttttttcaactgtttaaattattacccattttattttt

SEQ ID NO: 40819 - DNA, 950 bp, Heterodera glycines
ctttccccttccctctctgtttccctttagcccaattgtttccttcgtcctgctgaatcagtctcggcttttctctcttcatactatgtctggcttcggcttcgtccgtctgcttcgtctccctccctccgatcgcctcccttcctccgcttcctccgtttcctccgttgctgctgattctgatcggagtttcgcactctccgtgctcgtctcgtccccttccctttcttccgcttccgtcctcctcactttattcgtccatttttcttccccgttctcttccgcttctcttctcctctctccgcccgtccaatttgtccgaatttctgagaacaaatcacttttttgggaagtgaaagtgaatgccgatcaaacggaagagggacaaattggggacggaggcggcggaacaattcgctacaaaatcgtggaggaatactgtgaagaagagagaaaaatggaggaaaaggaggggaacagagaggaggaagacgagagagcagcagacgatgaggaagtagcaaaagggacaacgcaacagcaccaaatgcaattcgagattgatccgatcgacggaattgtgcggtcccggactgaactgtccgcgaaaaagtcagttgaatggcaaaagcaaagcaaaagcataggctgatcattcatggcacaattgatcggttgaaggtgttcactgtggacagttcgagtcggtgcttttcatgtgatcgacgaatggaatctcaatggggcgaagggaaacgatgcgctcatccgaatacgcgtatcgtcgcccgcttcatcctcacccgcttcatcctctgcttcatcttcctccccttcatccgcttcacttcttccggccgcccatttcggatgcatctttgtcttccccttcgccaattcgtcctcctccactgcgtccgttctcccttcgccttttgccattattcgaa

SEQ ID NO: 40820 - DNA, 1236 bp, Heterodera glycines
  misc_feature (1065)..(1065): n is a, c, g, or t
  misc_feature (1094)..(1094): n is a, c, g, or t
  misc_feature (1155)..(1155): n is a, c, g, or t
  misc_feature (1167)..(1168): n is a, c, g, or t
ctgtgcccttttggtcatgccacaactttcctctccgaatttttggttcgattggcacgtcctcgcgtcttctttgtcctgcaattgcgcaatgttttcgtctccaatttgccgttctcgacactctcgaccgcctcaattagcccttcggcgatgaaaacaccacgattattttggcatatttttgaggaaatccgagaaaattggtccatctccaaagagcctcaataatgatgctcaaattaaactaattaggttgcgctgcttttccatcgcccccattcatccggccaatttgccccaattaccgtaaccgacggccgaagcgccgcccctccgggcactgatgggctgctgaggcgaagaaatggcgaacggcacacgcataattaattatttgagtgaatgggcggaggcgccactccaccacaaataatccctgcagatttactggcggacatgccgtatttcttcacttgcatttcccctggggcatattaattgcccaattagcaccgatcgcattgaaatgattgcttagagttcgcgcaacttttgccaactcaaagcagtacgaatgaaacgcctttcatttgcttcccataaatgttgagcatgtccaatccaataggccatttggcagtgattgacgtgtcccacggcaggcgaaagggtggcagagcactaattagcatattttgccccgtaattttgtcgtaataatcccatttagcggtttctcacccaaaatggactttttgcttggcttttgcggctcctccgtttcctcctcttcctcctccgcatttactcatcatagcgaagggcagcaggaagtgaagcatcgaaaacagcagcacaatttggagcagtacgaagaagaaagcattcagaaaaatgaaaggcgaaacggcggagaaattgcggagagggaaaaaagcgaatcggcagaggagaagaagccattttcaatcgttcgactgcttctgaccaatggcaccagacaaagtggaaaatggcaaaaggaaacgacgacggaggacgacgggccgaagatggacacgnaaacggagacgcggagaaacgaaggccanaggcacaccctccgcccaatgggcgccactttcgctgtgtcgtcctcctcccctcaccttnacgcttcctgcnngctctccgtcgcccgccctcgctgcttctccccgcgctctctgatgctccgtctccgctgaatttgca

SEQ ID NO: 40821 - DNA, 830 bp, Heterodera glycines
ccaattggccccgtcattgctcagcgaatgtccatcacttcactgtgtctctttcaatgatggcattctcacttttccacccgatgacagtgccaatgcgtcggatggctaagcggtggccaaatggttgttcacgccttgtttgtatggtgtgccgaaggtgatcagatgctttgtgaattcaccgctggatcaatggtcgtcaacgatagaacagattaaagcggtgattatccttatttaattaagctttctatgattttttgtcccatttttaggcattttccaatgcttctttggttactttttgcattcactttctaatttcttctccgctgtgctatttgatcggatcaacgaagtgacttgggagcaattgacacttcaattgttgcctcttccgttgtctaattgcacgggatggaagaaattggaaaatgtgtgggaagaaagaaatgattgatcgacagaacccaattgacattttgataagcgatggcgaatacggcgacgtaattgttgattattttggtttgtaactttctttaaatgttagaattctcttgttttctcgtattattacattattcagactttgcgctttcgaatgataccaaaaagatagggtttgttcgaacatggaaaaagttattgtataaaaacccgggattgtcaattgattggactcataaaggtcgattggatagatagttacctcttgccaacacttctgacaatgacatcattcattttgctgcaacaccaattgactccagttgaattggtcaatgaacgaatctacgaaaaactgactctgcgataagctctga

SEQ ID NO: 40822 - DNA, 904 bp, Heterodera glycines
  misc_feature (842)..(842): n is a, c, g, or t
ggggagagaaagagggggagggaaagaaagagcagagggaaaagaaaaaaagatggaaaagagaggaaaagcggagaaaaaatggagggaatgggtgagaggacaaagaaaaaaaggagaaaaacagtgaaaagggatgggggggggagagattgaaattgcggccacagaagacccgtggagattttgcaggtgcgaaccgaaggtcagcagaattggtgaccgatgaaagaatggtacggatgggccaaaagaatgtaacatttgaaaaataaactatcttttctgcaacaatattatacattttgttgtaattggcgacgccgtgccgaactctgtatataatatatatatatatatatatatatatatatatatatatatatatatatatatatatatatatatatatatatatatatatatatatgtaaagattctttttaagagtttgacaaagtgttagccccgagagagtctccccatgacctctggggagacgattgttttcacccaaaaagtgcaccagactgagatattggagcacattagccatctcccttaaattgtaagataattttacggctttttaattacagccaaagcttcttccttatactttgctcaaaagatttttttttacattcttgttatgatgagggatggcacttggcagaagcgaagaacagaaacggcacttgacgatggggcgggcactgtcccgcagctgctgatcggcttttcctgttcaaatccctcaaatgccaaataaaaatgaaaattaaccaatttaacaaagtctgtttaacattctcaagctgtgacatgactctaattgcatnaaaagaccaaaacagttcataattatactctccttcttttttgataaattcataatttttac

SEQ ID NO: 40823 - DNA, 1473 bp, Heterodera glycines
  misc_feature (1454)..(1454): n is a, c, g, or t
taaaagtgatttacaaacacagaaaagagtataaaagagtgtgagactgagaagagtcaaattcggaagactgcgaaattacaataaatgggaattgtggagtgtgagcttatattcccgcgtcagacgccatactcgcgaagattgaatttggaagggccagcaaattttgaggtgtgtcgaattcctggattcgccctctgtgcaaaacgatcacgcggtcgtagtccataatggtcgcgagacggtgagcaattgtaaaaatggtgcagttgttgaacttctgccgtattgtgtcctggataagagctgaaacagagggaagaaatgttcaaaatagcaaatgccgaacgacgaatgaatgtttttaccgtccgtagccatgtccactgaagcagttgcctcgtccaacaccaaaatgcgactcggatgcagcaaagcccgtgccaaacacagcaattggcgttggccgatgctaagggaaagattaaaaattaataaaaaatgaagcaaatgtcatatttgtcaaagtttacctaatgttctctccgccctcacttatcgaatacattaattttgcaggcaaattgctgacaaattcacttaagtgcgaattttcaagcgcttcccaaacttcggcatccgtgtgatggttgaaagggtccaaattaaaacggagggtaccggagaagaggccgggatcctaaaataaacagagggcgaataatcactaattgtgagtcaacgaatgcctgcggaattatggtcagacgcgagcggaggtcatgcagccccaactgagtaatgtcgacgccatcaatgaaaatacgaccacccgtaggctcaaccattcgaaacagtgccaaagtcagcgaacttttgcctaaatttgtcaaattaaaaacgaaaagaacaccgacaaaggacctgccccagtacgtccaacgatgccgacacgttctgctggtcggatggtagcgtgaatgtcgtacagcaccaaatccaacccagaacggtaccgagtcgagtagtgatcctgcaaaactgtcaaatcaaacattttacagtaaaaattcattacgaagtgaatttcgccatggtttggccacccaacgggcggttctcggcctgggattttccatttggcttcggggatgacatccgcgtattctttaactcgctccacagaaacaatgctcgtttcaagtttgctaatctgccgaacggcgaaattaagcgcaaaagtgatctgaaaaatggaaatgaaccatcgaattggaaaaatgtcacaatacatttagcgaataagagacggagagtccgaggatgccggcacttgtcgacccacgagtgatggcagcaaaaagcgcagcgaacaaaacgatacagtttccgatgaactccaatctgacgcttagccatctgttggctacgcaaccgaggtaacgacactngaaacaatacaagagctaa

SEQ ID NO: 40824 - DNA, 1017 bp, Heterodera glycines
atagggaaagctattcccggaaggatttcggtctcccccataaatctggggcgcatcggttcgggggggactgcccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatgaggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaagga

SEQ ID NO: 40825 - DNA, 1001 bp, Heterodera glycines
gcttaacttttttttcagaaactgatcagaagcgcaccaaactttgcagggatactgaaaggaagagaaataacatattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttatgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataatttgttgagtacccaaacggacacttgaaaaatcgatttttttgttttcggggcagtccccccgaaccgatgcgcccagatttatgg

SEQ ID NO: 40826 - DNA, 786 bp, Heterodera glycines
ttcgcaaacacgaaaaagaaagtgtttttcctaaaattagagaatggtccaggaaaaaatatgtatttacataaaattgccagccctactaataatatttcaattaaactaattattttgcttttaattaaaaaaattacttttaatttgatcacttgcattgtacttcgaccagattgttggaaaattttttgctcgatttttatccgtttagactgaaccctattgcttgtcctcaatttctattcaaaaatattttaagtttgacaaatttggaaatttcttatgggaaatctatgaggttcaatctcgagcggagtccttgaaaagccacctccatctcgcattagaatctttctcgagcttctcgtttgttagcattttcaattttgctttgacacctccaccccatcacccaacttaacaaatccacaaatccagttccttttatacgttgagagcagaacatttggaaatgattgattggtccgcacaaatcccaccgaatttcccccattttcaagttccattggcagtccctcaatatttgcagcgtcagcggagatcactcgccaaatgaccacaaagagacaaatcattcgggtcaccccaaggcgcacattttcgctgtcaaatttgggtgaatttttaaaagcaaataagtgaaaagaaaaaccaaaatcccataaaagagagttatggcatttcagatgaacttttatgctttttgttcactcccttttttatataatgtgcgaaatttgtttttaaaagttaagctgaatt

SEQ ID NO: 40827 - DNA, 739 bp, Heterodera glycines
tttgctttttgtgatcccctgaaattttcattggcatattcacttttaaaagcatttttgcgcttaggcggtgccatttgttagtactagtgcaggtgctaaattaaaaacaaaagagaaaaacaataaagcaataaataacaaaataattagccaaaattaacagcaaaaaaagaaatataatgctaaaattaaaaaatatttgcttaaacattacgccaatccaaatttataaagaaatttgacagatttttcggagaatcaacaaatcaggacaaaatttggtcgctacctcaaaatcaggacaaatctgacaaatcaggacattttaattttatcagatttggacccttcaaatcaggacaaatctgataaatcaggacagatccgaaccctgcattaaaagttaatgaaaattaaatggcgcccccacaaaaaatctcagcggcacctaacggatccctttaaagatgattaggcagctggtccctcctccatacattcaatatctaaataatattatttggccacattttttctcttctcccctctcttaatttcgataaaaattaatttttgtcatttttgtgtgtatttttttatgttttttgggtaatattttttctatttattcatttctgcaggcacggattatgtgatgtatgtgctaattgttgcggaaagccaactattgcagaagagattgcaaaaatttatcgaatggcactacaaaagctga

SEQ ID NO: 40828 - DNA, 975 bp, Heterodera glycines
  misc_feature (40)..(40): n is a, c, g, or t
  misc_feature (45)..(45): n is a, c, g, or t
  misc_feature (62)..(62): n is a, c, g, or t
atgttagaaatattaaatcaggaccttgtgtttgagtttntaaanagttaggttaaaaaatntaaagaattaattaacaattgtttcatttttgtaatttgattttatttatttttatacattattttgaaaaaactaaattatataatattttttattttgatattttgttgaacagtttaaagtttataaaccgaaattgaatttaattttttgttattattcagcatttttaaattacatcgcaaattttatttaggcttttcatagtctgatattatattttcaaagctttgttgtagattttttgtttctgttttgtagaatattttctctctttttaaaaatttgatttactatataaaaattttattttcgctaagttattaattataaactgtaatattaatgcttacatgttatttttaattttttatttattttgcttgttcttataaaactttaaaaattttaaaaagttaaatgaattactttttttaattaatctatctgaatgatcataaaattttaattatcattattaaaattgattggatgaaagaaaggataagaaagaattcaagagttaataaatagtttatcataaaacagcatgaaattaaagaaaataattaaaaatttattttaactatatatttcttataaaaataaagagaatttgaaaagctttaagtaaaaaatatttatataaatcatgaaagaaaaatctaaaatttattaatatattaaaaaatatttttaaagacacaaatttgaaggacagttctttttaatataaaatgtgataaaaaaaatttttaacattaaaaagagttatttttgaatatattattggtttgttattttaattaataggttttatgtgtctattttcgtcatttgaaatttttctgtttcatattataaattataattttgttacattatcgaaaaactaatttatatatatttttt

SEQ ID NO: 40829 - DNA, 971 bp, Heterodera glycines
tgcaggtcaacttggttggtaccatagtttgcggtaaaaaaatgagaaaaaggagagccattttttggtcaagaattttttttgtttgcgtttcaaatatcgtaagattgtttgataaggccagacaagagaaggcaactgttggtaccaagtttgcagtaaaaaaatgacaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagaaaaggcaactgttggtaccaagttcgcggtaaaaatatgagaaaaaagagatagccattttttggtcaagaattttttttgtttgcgtttcaaatatcgtaagattgtttgataaggccagacaagagaaggcaactgttggtaccatgtttgcagtaaaaaaatgacaaaaaagagatagccatttttttgatcagaattttttttgtttgcgtttcaaaatcgaaagaatttttgatagggcccaaaaaaaaaagcatttgttggtacaagtttggcggtaaaaaattaaaaaaaaaaaaaactcttttttgggaaaaaaattttttttgtt

SEQ ID NO: 40830 - DNA, 1283 bp, Heterodera glycines
  misc_feature (88)..(88): n is a, c, g, or t
  misc_feature (92)..(92): n is a, c, g, or t
  misc_feature (1217)..(1217): n is a, c, g, or t
  misc_feature (1224)..(1224): n is a, c, g, or t
tagttttttcccaggggattttttttaaactgaatatttgtttggataccatgtaggggtaaattgtcaataaatcaaaaaggtgggncccngggataaggggttattccctcgttttgtcaaataaagttttgttctagggaacataaatcataatgtggtggacagaatttctggaaggttacggtattcccaagggattcttggtcatgtcatagtttagatcttatctttaaatgggacgttatagttttaggcaaaataaaattttgttctaggaaatataaatcataatgtggttgacagaatttctggaaggttacggtattcccaagggtattcttggtcatgtcatagtttagatcttatctttaaaaatgggacgttatagttttaggcaaaataaaattttgttctaggaaatataaatcataatgtggttgacagaatttctggaaggttacggtattcccaaggggattcttggtcatgtcatagtttagatcttatctttaaatgggacgttatagttttaggcaaaataaaattttgttctaggaaatataaatcataatgtggttgacagaatttctggaaggttacggtattcccaaggggattcttggtcatgtcatagtttagatcttatctttaaaaatgggcgggattttcatgtgtagtaaatatttccgctttaccaaaaatgtcaacaaccaaaacaacgaccaaaatcttgatgacttactactcaattaatacaaaaagaattttaaaaattaaataaaagctaaatataaaatgaaaaaaacagaaacctaattgaaaaagaatgaaaatttctaaaaattattaaaaataaattgaaaataaaagtgcccagtgagcgaatgacacgatagcagtagtaaagaacaagatacacgagagaatattattaaaataacattacatttaatcaaaatataaatttaaaataccaaatttaaacaaatattttttattattatctaaataatttaaaagtcaaagctcataaaaaaatttagattataataacaagaagctcgttttgatgggacaaattttggcaaatgtttatataaattcttaacaaaaattttgaaaatctgtttaaaagtcggaagatttactagaagcttttgaattttacttgatatttttgtacatttttgaaaagtaaaatcctattaccactngaattanaggtcaaagaatgtttgagagcaaatatataggaaaatattaagcaaacataataatac

SEQ ID NO: 40831 - DNA, 204 bp, Heterodera glycines
caaagcaaaaaagaatggagcagattattccctctccgccggccgaatttttttttaaattttattaaaaaattatttttaattgacattttctttcctccgtccaaaattcaccttgaattgcggcgatcagcggctggcccgcccgggggctgaccaggttgtacttgaggcccatcagcagcgacgcctccgccttggcct

SEQ ID NO: 40832 - DNA, 931 bp, Heterodera glycines
aggaattccaaccgcattctcagaataattacgccgatactaattgttctggaatttgtttctcggcgcgtttgtttgggaaaaatttggaaaattggctatctcattttctgctcaacagtaataggaattccaaccgcattctcagaataattacgccgatactaattgttctggaatttgtttctctgcgcgtttgtttggaaaaatttggaaaattggctatctctttttctgctcaacagtaataggaattccaaccgcattctcagaataattacgccgatactaattgttctggaatttgtttctcggcgcgtttgttttggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctcattttctgctcaacagtgataggaattccaaccgcattctcagaataattacaccgatactaattgttctggaatttgtttctctgcgcgtttgtttgggaaaattttggaaaattggctatctcattttctgctcaacagtaataggaattccaaccgcattctcagaataattacgccgatactaattgttctggaatttgtttctctgcgcgtttgtttggaaaaatttggaaaattggctatctctttttctgctcaacagtaataagaattccaaccgcattctcagaataattacgccgatactaattggtctggaatttgtttctcggcgcgtttgtttgggaaaaatttggaaaattggctatctcattttctgctcaacagtaatagggattccaaccgcattctcagaataattacgccgatactaattgttctggaatttg

SEQ ID NO: 40833 - DNA, 1539 bp, Heterodera glycines
ttcaccattcaaattggggcgcaaaacggcacacgccaatggcactgtttgtgggggaagtgcgccgttcgacttcctccacatttttgctcacccatcgcgttctttgttccatatattcgtccaatgtcaccgacttcaactgacaattggaggaattgatgcgcattttagcaaaagtaattaaattattaaattgagtaaataattagagaaaaatttgcggtcaaatttttgtgttttttttttctttcaaaaaaagcaaaagcaaaccagcagaaggagttccaaattatcgtaattgtcattgaattagttaatgaaatataagtggagagaagaggcgactgattgatttgtcttcggtcgctggcaccgccgggggggggccacccaaagggaaaaataaacaaaaaatgggagggggggggggaagaagcccaatttagacgaggaagagaaggaaaaacaaacaaattttaaaaaagacacagccaaaatgcttttggctaaaaactgctcctctacgaaaacatttgtgttaatggggggggggggagagcataagattggttgaaataaatgtcagattcatgatcagcgacctcgaaaagccccaggaataagtttttacgcctttttatgcaaaaaaattttgctaaccaaatttgagttagaaaatttctcttgagggatagaaaagataaaaagatgtgtgacgagagagttgctgcggatgggtatctgcagataaaaaaatcttcagctgcagatagttagcgctagcattgtgcatagggattttatttgcagatttttttatctgcagctaccctatccacatatcgctagctacagataaatatccttagcattgtgcataccagcaagaagagagaggtgcggtaaattgaatacaaattgaaattggacagataattgaacagaaattggatatttgcgcgaaatcgattgagcataagcaccagggtctttttatgataaaaattgaactgaaatatttattaatttgcaagaagtatagccacttcttccaataacggctcatatgaaaaggggataatcaattaatgaatggattgaccaaggctttttgaagggaccgagggttgaagaggtcagcggtcaaatttgttaatggacagggttaccctttgtccttatttgtaagatttgttcttattttgagggtccaaatcttacaaatgtgaaatgtccttatttgtaagatttgtccttattttcatcttattttttggattcagggagaaatttagatttttaatgataatttttgaaagaaatgttttttgaagcgaattaatatgcaaaatcttgacaagattcagttaaatattcaaatttttctctcggcggtttcttattctcttaaaaaaattagctcaaaatcgtaattttgtcatttttgaacaaaatcgttaagaaatcgcataaaaaattacaaaaatttttccggcggcgcctattagagcaggggtgatctgttcttatttctaa

SEQ ID NO: 40834 - DNA, 1273 bp, Heterodera glycines
  misc_feature (59)..(59): n is a, c, g, or t
  misc_feature (112)..(112): n is a, c, g, or t
  misc_feature (132)..(132): n is a, c, g, or t
gtccaaaaataaattcaaaaagtggtaacatttcactaaatagttgaaaattccctttnaatattttatttatgtgagatttgaaattgcaaacgcaaattctgaaatttcncagggctttctatcaaaatntaaaaaaaaagaagtctggtgattaagctggcctgacagcttagacggtaaacactgatttggatggaaagccgatcgcagaagcaggcgctaatggttcgagtccttccactaaataggctaacccaaaaataacaaaagtgaaatgatgcagataattcaaattttaataactagtaaaagccatgattgattaaccccagcccgcgggcgggaaacaacgaaaattataacttaaacaaatatttcttttatttaatttttttaagccaaaataaaatttttacaaaaatttcatttgtacattatgtaacacatttttttttatctgcaattaaaaaaaaaattaatcattcattaatttgttgttctctccgccttctttggtaggttgacgaatgtacgaacatttggctccaaataatgaaaaggagagcgcgccgcggttgtggttgaaataaaacaactttacggcttaaaaaaaaacataaaattggacctgaacaaatcccttcaaaattggtaaagtggcacgacacatcaacacggcactaacaaaggctcgaaaagttggccgcgtccctacaaaaagcattaaatttacaacaaaatggataaaatcataaaaaaaactaaaaacgatttaaaatacatctctaaaagtaagaatctatttcaaaaaatgctttattcaaaattcattttctttaatattgtttttttcttatacatctaacactggtttgggtcaattttgttgttttgagctattttttttttgctttacactactaaaggctgaaatagttgttgccattcttttttttattgtttttttctctcgagattttttttcttcttgttatttctttgcctcccgactaattaaaaaaaataaaaaccttcataactagaggacttccttcgttccctgcatcattatgcacacagggcgacacttccacacacaatgttgcaaaacgaatattggtagaacaattaacacccgcaaacagcatttgtggtttattgccaattttaattatctgaaatgagaataaaaaataataataatataaataataagtgaaaagctcaaacaatagcggatttggcaaaactaaattttatttatttattt

SEQ ID NO: 40835 - DNA, 1127 bp, Heterodera glycines
ttaagcatttcaacatatatagaaatccgaattataatatttgttctcgaaattttataaatagatgcaacttgagaccaaaagtgataagaaacatcgtggccttggaatcgctttcgctacaaaaattcttccacatacgaattcaataagcttctgtgtgttccatatctttttttgtgttcttaattccatgcttaagaaatcaatgtaaaacgaatacatttataggcatttaaaaatgtatgttaaaagtatcaggtaaactagaaaagtaccgaaatttttgcggaaattatttcttttatgactccaaaataagtgtattaatattgaacgctcttaaaatgttcgaaatcccttgaactttttctatcggttcatgcattttttgcttaaggaattcgattttcgcttgctccttttaggtatttgtatagaatggtcaatttttttaattacctctcttttgggttcgttttttacaatttttctttttgtatattatcgtatcaaaattacagtgcaattcgtgtgctgctggaaaagtcgcccagcttgctgcatgaacgggacccgacaaacggaaacacggtaaaaacgaaatcgcaaaaaaaaaaaaatttcaggttgccttaaaaattttgatttttttttcggtcccattttggcattcttcatttaaaccaatttattcttcaactgtgtgcttttttgaccaaaattatttgatttagttgacataacttaaaaatctcgtttttatggcaaaaaaaaaaaaaatttttttttccccagtcgtcaattacaatttccgattgccaaactgtttaagacttacggaattccgatgccggaaaaatgcatcttccatccgttcttaattttttcaaaaaatttccaccccaaaacagtgtttgcatgcagccaaccagaaggcctcgttgatgagcttgcttcagctgaagcacaatgagttggacctgaacgcccggaacaaggccggcttcaccccgttgcatcagttcgtgatgcgtggagacctaggtaaaagagcggacggaaataatgagggcaaattggcatcccaattttttgttttttccaaattttgaccgtccctgccc

SEQ ID NO: 40836 - DNA, 1349 bp, Heterodera glycines
gttttttgaatttttttaagtgcaaaagtggtggtgtctgcaaaaaattttcacccgggtttaaaaaatctaggaaaaattagtaagcatttgtagtgttccgatacgtattcctgcataatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgagccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttggggttttcggggcagtccccctgaaccgatgcgcccagatttatggggagaccgaatccttcgggaatagcttcccgatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacccttgaaaaaatcgatttttttgttttcggggcagaaggcccgctccgatgcgcccagatttatggggagacctttgacgaccgcaatacttccctatagcctatactttaattct

SEQ ID NO: 40837 - DNA, 1279 bp, Heterodera glycines
  misc_feature (124)..(124): n is a, c, g, or t
  misc_feature (150)..(151): n is a, c, g, or t
  misc_feature (162)..(162): n is a, c, g, or t
  misc_feature (179)..(179): n is a, c, g, or t
  misc_feature (191)..(191): n is a, c, g, or t
  misc_feature (1150)..(1150): n is a, c, g, or t
  misc_feature (1212)..(1212): n is a, c, g, or t
agtggcagggacggggtgtatgacaacactgccaccctggatgactcatccactttttctgcgatgtcgacattcttcctttcctggatgtgttcaagaagatgacgatgtggagttccacttnttcgtattctgcgtggagcacctcannccattcctganccactcccagagcaaanatgcttctcacncaatttctttgaagaccttcacttgggactccggctcccagaccttggccaactcattcacttctttcttcgatctcgaacccaagacaatcagacaatcagcaccatcgaacttccgagcccttccttcaaagcgtgcttcaatcatcatgtcaacctctcgctccatctcaatctggagagctgctccaacaacatgctccatcgccacaacatgatgtttagtaagctccgcggagcatggataaaccttgggcgtcatgtttgcattcagatttggccactccaacagatgaggacgaatgcacgcaactgcaccgaaaaattcaggtgtttcggctcttctttccgttcccagtttgaacggagaagaatcaggcagaatgtatcccattgatacaagtgagtcctgtggaatgttggcaacaaccaccgtcacaagtgagcccagcttgaggtcttccggattgatgccatcaagatgacgccgatttatgcgtgccgaaaccgctagaccacagcacgcgatgtttgcgtgaacgatttggaatgaaatttcgtaaatcctaaatttcatgatacatttaaattttgagagggctgggtaaattttcgctaaagcgcataaatcagcggcctaacaaaaatttcataaattcaatttgttcaacaaaaatcctctgaaaacaacccctttttcgaagggaaaatttcggagaaaaatcccagattttttcaggttataaggcctgcttcaaacgttcccaaattttcaaaattccaagacccctcaaaacaaaacaaacttgccggattttgccgtgccgtaggccgacccagcagcggtgaaaatcatcgccgcagtaacgccaagcgagccaaaaaaagggccatacgccgcttgctccgctgcaataagtgccgaattgtcaccggacatcttcaaatgttggcacgantttgtaaaatgctaaaattagaaattagtcgtctggcaaaatcaaaaattttttaaatattnaaaacagaattcaggaattcggattgtacccttatttttcatacattattatttttatgaaaaacga

SEQ ID NO: 40838 - DNA, 1191 bp, Heterodera glycines
tagagaccaatatttgagaagtgagttagaaatgataatcttcacgattcctttacaagttcgatgctctaattaaccgcgataaaaacatcctaatcaattaaatagcttctgagataataaggtttatcataaaatttcttttaaaaataaaccctcaattattggaatgaacgctactttccaaacatgcacgcgttttgcgctcgagctatttatcatcgggcttgtcaatccaaagcgaaacaacaaagatggtgttttgaacgaataaagggcataggttattttgaagaagagtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataatcttcacgattcaaaccaattttcgttgctctaattaaccgcgataaaaacatccgaatcaattaaatagcttctgagatattaaggtttatcataaaatttcatttaaaaataaaccctcaattattggtatgaacgctactttccaaacatgcacgcgttttgcgctcgagctatttatcatcgggcttgtcaatccaaagcgaaacaacaaagatgctgttttgaacgaataaagggcatactttattttgaagaagtgtccaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaatccaaagcgaaacaacaaagatggtgttttgaacgaataaagggcataggttattttgaaaaagtgcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataatcttcgcgattcaaaccaattttcgttgctctaattaacctcgatagaaacattcgaatcaattaaatagcttctgagataa

SEQ ID NO: 40839 - DNA, 1002 bp, Heterodera glycines
agcaggtgtggaaggaagggaggaagaagccaaattttgcacgttcattcgactaacgaggaacaaaaaaaaaagttttttttctaaggccgaaatctctgtggtgaccagtggcagtagcaccagaaaagaaaacgcggaggaggtggaaaaggaggacaatgatttgcgaattttgcatcaaaaaagcaaggagaaagcacttgtgacggaaggaacggaaaacaatgttcgacaattttctacccaattaaaatttaaaaaaaaaattgccccaaaggcgtctcctgtcgtcgtggtcagctctcccgcttcaacgccgcaatcgcccatcaacaacaacaacaacaatgtactcactcattaacttaaattgttttacaaattgttcctcacattcaggcatcatcgcatgccatcgccggcatgccaattccaactattccatcatcgccatcaacagcagtcattaaaaaaccgctcatacagaatcatcagcaacatacgtcaccgcccccgcttatggccattactgtgccgccgccttcgcttcatgtgcctccaccgtcgttggcgttgactgcggtgccaccgcctccgctcatcatgccgtcgcagttggcgatggccgccaccaccacaaatgcctccgttgctggcggtgctgctgccatccaaaaacatggcggcccacaacagcaacaaatgcacacgcattcaccaacggcggcggcggttgatcggccaattggtagcggaattctacacagaattcaatgtgaaccaagtagtgtgtgtgatcgtcgatcacttcgtattaattagattttctgatcagttttgatcgggtgcacttcattttccactcccgcgtcgtttccccgcctcgaaaatttaaaaaaagggaggcgggaaacgatctgcaccggtcctgatcatctcattttgatcacttagcactactaacactaacacacggtcatggagggtaaaatatatccg

SEQ ID NO: 40840 - DNA, 175 bp, Heterodera glycines
cgaatttggcattgaaaagaatgccaaattcatttgcggtggacgaaaggaccttgtctgctgaagcaagtgaatgcccgtgtttctgtccagcaaaagttttagtggagcgaatgcgacatggacagtcaaaggcatagaatgggcatcgaattcgtccttggcaatctgtgga

SEQ ID NO: 40841 - DNA, 1001 bp, Heterodera glycines
tcctaaaaagagatagccatttttctgagaattaattcactatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcgggaatggaaaaaattttgaagaggctctgcggaacggattagcatcggggttacgagaaaaaaaaattgccctaaaaaaaaaaagccttttttctgagaattaattcacaatttccgcagctcttgcggtaatggaaaaaattttgaagaggctctggcggacggattagcatcggggtt

SEQ ID NO: 40842 - DNA, 1257 bp, Heterodera glycines
ccccccccccgcccttcagagcacgacaaatatttcaacaaaaatttttaaaaattgactagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaatttttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaagaattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaagaattcggtctccccataaatctgggcgcatcggttcggggggactgccccgaaaac

SEQ ID NO: 40843 - DNA, 1880 bp, Heterodera glycines
  misc_feature (939)..(939): n is a, c, g, or t
  misc_feature (1720)..(1720): n is a, c, g, or t
  misc_feature (1740)..(1740): n is a, c, g, or t
  misc_feature (1777)..(1777): n is a, c, g, or t
cgtccaatccaacgtcacttcccccacgccgtccagcacggtccaacaggaccttcacgcactcgccctccatggcacttcgccctccccaacggcactcccaccgacgaacggaggcacgagcagtacaaaagcagaagaaaggcggcaacagcagacgaactccccgtgggtaagcaatattgagattggataagttaaacagtgccacttcggctaatgcaactaatattcacaattgcttttggtgttggtcgcgcccactccgctccacccagccaattctctgctgttcactacgagtgccaatgctatccatcacaaaattggcaaatgaatgtggaaacgatgggcgaaccaacggccaataacgacaaaggaaataaggatttttggaagatctttagctggccattaaactcagcaaaaatccgtacttttagtttttaaaggggctcagtatgggataaatctgataataaggccagctacagtgtaaccacgtgaaagatgccaaacaaacaaagccaatgccaggaaaaattatttattgtcatgccgatttaatcaaatgtataattaattattaagacactaagagattaatttcctgataaatgcacaagcactttcattcgttaccggataattcctaattaatgtccaaaagctcagcaaatctcagctaattcgcttccttctcattctctccgctggcttttaagttgcttcttggacgtaagaagcacgatgctttgccaaaatgcgcaggagaggacggaatttcagccaccattgtttgaggggcaaacgatgctcaaaatcggtctcagcggcgagctcttccagcggagagaagacgacttcacgaccgatcagaccgaaaatgaggaaaagaaagctcacaatcagttaaccgactgaaggacatccaatttncggaacaaaaaggaaaaggacagaaaaccacgacactattcattagaaactaaccgagcaaagtggcagtatcgggtttgtccgcgttgcatctttccgtagttttgtcgaagttagcgttgatctgtgtgataagatggttcaacgcacgggcgcctaactttgtgcccatcgttgcggtcgaatggagttggcttgcctccctgttgagggtggccaagaatgttgatccgagtgctgaactaaaaggcaaggcaaggttgggagaggataacagaacactgattttctcaccaactccttcctatcctatttttttacatacaaacgcaatagaagtcgaaaacacccaacgaacgactgtgtgatttattaaaagatttgccaaaaatggcaattttatgggttaaggaaattctggtacatttcttaattatattttcggctttcgaggggggggacaccaccgactgtagcctccgttggaaaggccctggttgccctcaaaaaacaaaattacattaatagcacttgcctctcccttgccctcttcgctgaataacttttgtacaaaagtggtgtcgtaattatggctggcgccctccgactgcactatcaaataacgttgcacccccttttgcattttctgactgatcactttgacgtcctctttaatgtctgtaaaatacaaaattgaccaaaaagaattcacggattacccaccgtccaccgtgaatttctcctcgaaaatgtacgcattgtccgcccccgtggcgatggncgacaccgtggccaaatagncgcagtgccctcccatcgtctcgatgagaaaacacgncgtttggacccattggcgattggtttatggtgtccaccatttgcagatggcattgatagccgtgtccgatcctaaatgacgaaaataaatatttatttatttt

SEQ ID NO: 40844 - DNA, 1783 bp, Heterodera glycines
  misc_feature (6)..(6): n is a, c, g, or t
  misc_feature (22)..(22): n is a, c, g, or t
  misc_feature (1743)..(1743): n is a, c, g, or t
acaaanatgcaatgcatcacanaatttacatctaacattcataagaccaagtccatgttcatgagcattcacataagaccctgctgcataaacattaatttcaccttgtctaatcactctctgtctaattctttgctgttctagacgtaactgtctctcatatgcattctcttccgatctttgactattatttctatttctcatctgttctaaacgcaaacgacgttcatttgcattttcttccgttcgttgactattatttctatctcgcatctgttctaaacgcaaaactctctggttttgtgattcgttttctcttctcattctctcacgttctctctttcttttcaaatactcagttcttctcctttcttcaaattgactatcactcatacgtgacggtccagcaataccaatatctgaattcagagatacctggctttcgccaccaacaacatccattcttgaccgtttactataattatgctcttccaatatatcataactgctctcaactacttcataatcattatcaaaaacatatgcatattccaaattctgttcattatcattacttctatcattcacaaatactcggtctaaattcattataacaaaggaggcagtagaaagtttaaacctgaaagaacattacataacaaaatcatttacaaaataacaaatatataaatgtgaaccaaacaacatattcaagcaagtgtgaatatttaataaaatgattaaaaataaaaatgagtgggtcaaaaataatgcaaggtcaaattatctctcattaaaaagagaaaaaatcaaactgacctgttatcccgttaatttttaaaattttcaaaaacatcacattttgtagattggcttcgatatcgtaaaacatccatttgtaaaaaaattgcaacttgaatcagcacaacatgatacatatcaaacaacaaaactttcatttactaacaattcgttttcaattaatcataacataaacaaaaatttctgctgataaccaaacaattaaattcatatttaaaaaaattaaatgtgacttttttcacaaacaattcattagcatttacaaacacaatcaaatttaaattccaattctaggtcttaaattcattacaaaaatcagcggtagatattttaaaccttgaaacaaactttgaaaataaaagaatgtacacaaaaacaaaaaaaagaagcatttcaactttttcttttttcgctcaaaaaaagcagtaattaagttaatagtttgcagatgggggagagggtttttttttaaaaacatataaaagagaatcgttattgcacccacccccaaattcaaaacaaaaactgacctgtaaacgttaatttaaaatattccacataaatttcattcagcaagcggtcattcagcaagcggcacgtaatatatcccaactgcatataattatccacccgaacaggaaaatttgagatgtagatttacattgctttctttcaatccattaaaggcttgttcattctctttttactatacaaaacatttttttcattcaaacaaatatcaaaaatcaaatcagattttttttcgtatgtattataatcaaaaaagtaccaatagctttttaagaaacaaacaattttcatatcaaaccaaatctaattcagttttctaatcaaacaattctccaaaatcatttacataatcaaaacataaccattcatatcaaaaaataaatcaattanacataaataaataagaaataaaaatttgacagcacaaaaa

SEQ ID NO: 40845 - DNA, 782 bp, Heterodera glycines
  misc_feature (777)..(777): n is a, c, g, or t
agggaggggagtggaaggtaagaaggagaggaggagaaaagaggagagggaagggaggggggagaaagggaagcgggagaggaggggagaggagaggagaagaggagaaaagggtgaggaaaggggaggaggtgagtaagaggaggtaggggtggggcggggaagagaagagggagggggaggggtaagagctaagaggtggaggttatgctaatgagtgactgtgtcgttggtctgtcttttcttgctttggggttttcttttctaattttcttttctgccaaattttctcgcatttgtcaaagtttaagctatcaatgcttttcgtttggtgcttcaatgttttctttgttttggttttgttttgttctgcttacgtttatgactcatccccccccccctccccttttacgcatttatcgtccctttccctcccccctttttcccttttcccctcactttcttccctatttatgattcattgaattaatgcaacaaaaaagaatatcctaaaattttatcagcagaagagaataaatttgaaagtgctttgatcagcaaatggacaattaaaaaaacatttttatttaaatttacgtgatttatctttggcatttttcttttttttgattttttttcatccgccgattaatttccatgtgtaaattttgtcaagcaaagagaagcgacaatttggcagcagatcaaatttctcattgtgtacttaagagagcactcacattcaaatgtttcttttgctgacaaattctttccccntaaaa

SEQ ID NO: 40846 - DNA, 1074 bp, Heterodera glycines
ttatcttgggcacaataaggagtttttggggcgagcggtgccgataagcgcggccgaggaaatattttcagaatttttaacgaattttgttaaaaaatagccaatttttttggcatttcctcttttactcttcgcaagcccccccccttttatatgttaataataatacagattaacaagaataagtcagatgaaatcgaaatatgggtagccttttaataaaaatagaaaaaaaaaattcatttttaaaaaataatcttacaagaaatcgtctggaaaaataatccaaaagtcccagttacggatcaaaattacggaataatcctaaaaatccgtaacccgtaatccgtaatgatatttttgaggttcggctcagcacgggcataagccaaggattctttggctaaatgctccactacctgaatcggtgccaccatttgcaaagtcgggctttttgtaacggattgttgtaaatttggtacaaaattctattttcgacaaagtatttggccattgtgatcagcagacggacactcagctgtgcttttgccaccttgaccatctcttggcaattgtcaggctgatcagcgcattggttactcacacagtcaacgaccatttgttgtaattcataaattcttgaattgattgaccgaaatatttcaattgtcccgagtcggacaccgatgtaaatcattttgttgcctaaaaagccagcgcggaaaatgctttaaccaatcagtggtattatgcctcaacattaaataaaaaactatggtcaaaaactcgagattgattgaaccgaaacctcaactagtgatgcttgagactgaaggttcccgcaccaagcgactgagaccaaaaaaaactagagactttacacgagtcgagactggagacagactttcgagcatcactaccctcaaacttcggtacggcgatcggcttctctgaaaccaaaccactcttacaatcttagctaccagcccattccattaatccttccattttatggctctttatgcctccgctttaaagcgttttaaccatccgccgccgggggccgtagtaaaa

SEQ ID NO: 40847 - DNA, 764 bp, Heterodera glycines
ttcgctcgcgcacctcgcgctagccgagctttgaaaaaatttattatcttttctctctctctcacctcttttctttctctctctctcacctctctttctttctccctctcctctttttctctctctctctctcttcctcctcttttctatctctctcctcttctctccctcctctttctttctctctctctctcctcttttctatctctctcctcttctctccctcctcttttctctcccttctctcctctctttctttctccctcttctctttttctctcttcctttctctcctcttctctctctatctcctctttctatctctctccttttttctttctctctctctctcctcttctctcctcctcttttctctctctctctctccttttttctttctctctctctctcctctgttctatctctctctctctctctcctcttttctatctctctcccccctctctctcgcttctcttatttttatctctctctctcttatttgtctctgtctcattcactcccatactttctctctcttttttcctgtttctctaatcatttctctctcctttactctccgctctttgttcctaactgtcttcatctctctctcttcttcactctttcttacaatacaacctatctctattatctctgttttttcacttcatttcttccatccaaataaaaacaatcgcgtcaaaactttatttaaattttttgtttactttgtgacacacacggcaaaattaatatataga

SEQ ID NO: 40848 - DNA, 996 bp, Heterodera glycines
  misc_feature (43)..(44): n is a, c, g, or t
  misc_feature (69)..(69): n is a, c, g, or t
gatcattttagcgctcataatgggatgtataaagcgatgtagnnaagaatgggaagcgttaaaattgtntgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaatggaagcgctaaaattgtttgagaagctttttgagcgtaattacgatttttacttacaccatttttttctaggcttagatcacatgcgattttcggcactctgataattttagcgctcataatgggatgtataaaggcgattgtagaaggaattggaagcgctaaaattgtttgagaagctttttgagagtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttgctaggcttagatcacatgcgattttcggcactctgataattttagcgttcataatgggatgtataaaggcgattgtagaaggaattggaagcgctaaaattgttgagaagctttt

SEQ ID NO: 40849 - DNA, 885 bp, Heterodera glycines
aaaaaaaattttttttttttttttgccataaaactcaccccgctagttatgtcaactaaatcaaataattttggcccctaaagcacacagttgaagaataaattggtttaaatgaagaatgccaaaatgggatcgaaaaaaaaaatcagaatttttaaggcaaccagaaatttttttttttttttgcgatttcgtttttaccgtgtttccgtttgtcgggtcccgttcatgcagcaagctgggcgacttttccagcagcacacgaattgcactgtaattttgaattttgatacgataatatacaaaaaggaaaattgtaaaaaacgaacccaaaagagaggtaattaaaaaaattgaccattctatacaatatacctaaaaggagcaagcgaaaatcgaattacttaagcaaaaaatgcatgaaacgatagaaatagttcaagggatttcgaacattttaagagcgttcaatattaatagacttattttggagtcataaaagaaataatttccgcaaaaatttcggtacttttcaagtttacctgatacttttaacatacatttttaaatgcctataaatgtattcgttttacattgatttcttaagcatggaattaagaacacaaaaaaagatatggaacacacagaagcttattgaattcgtatgtggaagaatttttgtggcgaaagcgattccaaggccacgatgttttttatcacttttggtctcaagttgcatctatttataaaatttcgtgaacaaatattataattctgtttttaattatgttgaaatgcttaaaaatcaatgtaaaatgaatacatttataggcatttaaaaaggtatgttaaaagtatcaggtaaactagaaaagaacaaaattt

SEQ ID NO: 40850 - DNA, 1395 bp, Heterodera glycines
gcagcggtgaattgtataatccacattctgtttttgagcgatgcggaaaaaaatggcgagtgttattcccagtcttggggctcaaaaacaaaaaggaaagcaatcttcgttaatcccaattttttgcttaaaagcaacgagaaaaatcggatactgaactcgaatgccttcaaaatttttccaattttatactgcgcacgaattgagggacacaactattcaaaatcaaacaaattcaaacaaactagtttatttttaagtcagaggagaattaatatcaattaaatttagaagagcacagtttaagatgggaaagaaaacatatctatatagaatattatctttgcttttcgtatcacaaattaaacaattgggaactttttattgattgttcttagagggaatgggtaaatataaaataaatcaaatcccttactatatattaagtgaggcgaagctccgcccactttttgcccttttgaatttgcgcctaaattggtgttttgttatgaaggggaaagagaaaaataaaatgaaaaagattatttggatggagagcgtttttggttattagaaaggaaaagaaacacatgttgtttttcttaatggtgtgttatgatgattgtttcgtcatatcgatcccaaatattcccacttctttttgtttcatcattttccatacctattttgttttttgtttttattcataatatatgtttaatgtaaagccttatttttttattccattcaatttcattttttcgtgatatctattctgtatattttttcttttttttctttttcgttaaattacaaaaaaacccattttcaaaagttaaatttgtttattggtcttcaaaaaaatcacaaaatcattctaaagccgtacatctttaaattccgattatagtacttttatcaataaagcttaaaaaaggtcgaaaccttccatttgcgttttttgattgtagcatatattaacataattaaattatatttattttaattaatttaaatattatttattttaatccattttttgtgttttttttattttttagctttttaataaaatcacaaaaagacaaattttcaaatttaagttagtaattagccttctaaaaaatcataaaatcaagctaaagccttacccctttaaattccgataattattaattatatcaattaaaaaataaaaaaaggcttaaactttccatttgcgattttttgattatagcatatgttaacatcataattaaatcggattttcttttaattgttgtttattttttagattcataatggttcgaactaagcaatcctttcctcctgcggaacaatgttcctcatcttcgttacaaaatattaatctatctacttctggaaatccgacgg

SEQ ID NO: 40851 - DNA, 675 bp, Heterodera glycines
cgctacgaaataattttgactcttttggccttttattcgatagaaatgcctttgggggaattacggagattatcccctcctcgcctcgcattaaaatgccctcaagggattattatcttcagcggcacgaaaccttaacggaaaatcatccgaacgaagagaaaaaatgggtcgttacgtttgactcggggatttcctcataatccctcaaaattacaccttttgtacatataatgatgagctttttgagggaaatggcgtaaaggacgaaaaaaacgatttgggatttgttgataaaaacaaaaataaaaaaaagactaatgagtaatttgtgaagcaaaagcttaatggggtgaaaaagtcacacacaaaaaaagggacggaagagaatggaaatgaacggtggcggagggggggggaagagggggaagggggagagagacaagggaagggggaggggaggggacgagagggaatggctgtgttaaaagggacaaatggaagtgaaatgtgagaagaaggcaaaggggaggggatgtggtcttgttcacagcatttcactttattggacagagcaattggagactttaggaaagcaacaaaaaagaaaaagcgaatttcggtaggggcgacagtaaatgttggcaaatggacacacgaaaatggacggggtac

SEQ ID NO: 40852 - DNA, 903 bp, Heterodera glycines
agaaaaacgaaatgaactcaaaaaaagagaaataattgggaaaatattataaaataaaagagaaaattaagcaaaaaggaagaaaatactcaacaaaagaatggaataaaattgaaagaaaaatagcgaagaaattggggacaaatcgaacgaaaatttataaatggatcaaagaattaggacttcaacaacaaatacagaaaagttacaattcaaaaagtgatgaagaaaaaatagaaattgtgcaaaaatttattgaactgacaaaagaatataagcaaaaaagaaaatattcgccaaaagaatggaaacaaaattatgccgaaatttgtaaggaaattggagttagccatttcataattaacaaatggaagaaacaatttggcattcgatatatgagaataacggagaaagaaaaaatggaaaaaatgaaaatttattcgcaaataaaaagagaaaatccaaaaatgagtgataatgcaattgcgaaaactgtgaacacttctcatcagaatatttttaattggaagaagcaatttggagaagaaatgtttcagagaacaacagaagaagaagcgtgaagtgccttgtgcttgcttttcaatttgaaaatatttttttggatatctttttcaattttagtttcagtatttactgaattagtaaccccctagcttctaattcagtaaaaacggtatttgggctgggattttttatgccataaaaatgaccttttttggcattttatattttctttaccattattttaattgaatttaattaataaaaaatattttaatttaaaattattattttttttcatttttaatagcctaaaaacccataaattaaccaaatatttggtcattttttgacaaattctgttaacaaatctcgctcaaa

SEQ ID NO: 40853 - DNA, 1206 bp, Heterodera glycines
tttcaatatcgtaagattgttcgatagggccagacaacatctggcaactcgttggtaccaattttgccgtaaaaaaatgagaaaaaagatgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgaaaaaaaagagatagccattttttggtcaagaattttttttgtttgcgtttcaaatatcgtaagattgtttgatagggccagacaagagaaggcaactgttggtaccaagtttgcagtaaaaaaatgacaaaaaagagatagccattttttggtcaagaattttttttgtttgcgtttcaaatatcgtaagattgtttgatagggccagacaagaaaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgttcgatagggccagacaagagaaggcaactgttggtaccaattttgccgtaaaaaaatgagaaaaaagatgtttgatatttttagacaagagaaggcaactgttggtaccaagtttgcggtaaaaaaatgagaaagagatagctattttttggtcaagaattttttttgtttgcgtttcaaatatcgtaagattgtttgatagggccagacaagagaaggcaactgttggtaccaagtttgcggaaaaaaatgagaaaaaagagatagccattttttggtcaagaattttttttgtttgcgtttccaatatcgaaagattgtttgatagggccagaacagagaaggtactgttggtaccaattttgcggaaaaaaatgaaaaagagaaaagccattttttggtcaagaattttttttgtttgcgttcaaatatcgaaagattgtttgaaagggcccgaaaaaaaaagcaactgttggtac

SEQ ID NO: 40854 - DNA, 322 bp, Heterodera glycines
ataaaatcaaactaggaaagtgaaaatttttttaccttcttttgttactatgtaccaaaggtgaaaggccaaaaacttttctctgttttttaccgcaaattcgtaattatcataattttttttgttttaatttagttgcttctgttcgcattgtgaaggtgttcggcataattgtggctttttgtctttgcaatgccatcgattcggaagaggcgaccaattgacaaacaagaacaaaaacagaaaaagtatctgtgctcattcattttatgttgccttattgacattagttcgttctttgctttttgtctaaatttttaca

SEQ ID NO: 40855 - DNA, 848 bp, Heterodera glycines
  misc_feature (33)..(33): n is a, c, g, or t
  misc_feature (45)..(45): n is a, c, g, or t
  misc_feature (57)..(57): n is a, c, g, or t
  misc_feature (62)..(62): n is a, c, g, or t
ctgtaaataattgagcattaaaatttatttttntaaattaaattnttgtcaaatttntcatntgaattgtggcacataaagcacagccaagcagatttgaaccccagaccctcgcctcatttggactacactaagggatcaataattaaatttcaaaaactatccacggattgagtcagttcaaaaaaaggaaatatatgtaggcaatgatgagaacaagaacggcacgataaacggatcacctaatccgattttatgcatacgggtacaacagatatgcaatggaatacaacagtttgtaaagaaatatttaatccaattatcatatatccatccatccataacatcattccatcgcattcacgggatattttttgaacagcgaatttttgaagaaaatctcgaagacggacgaacatgcaatgacaatgcttagcactagggttgagcggtaccggtaccggtactggccggtaattaccggtttttttggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcat

SEQ ID NO: 40856 - DNA, 1200 bp, Heterodera glycines
  misc_feature (1117)..(1117): n is a, c, g, or t
  misc_feature (1139)..(1139): n is a, c, g, or t
  misc_feature (1175)..(1175): n is a, c, g, or t
  misc_feature (1181)..(1181): n is a, c, g, or t
tcgctaatcacgaatatgaccttagttttggcaaattccgaatcccgaactcggacaaaagtcgaagattcaaaattgatttttatgtgtgagaattttgaatttcgacttttgttctagttcgggtccgggattcgaaattagtcaaaattaatgtcagatttgtgattagcacccaggaaaacccaacataaatatgttttaaagacttttagaaaagaaaacatttaatttatttttcaccgggacaccaattattcagtatcaccaaaatatggatgaaatccattttttttaagtcgtgaatttcatgtcagttttatcattagccatttttatcaacgattattcacaatgaattaattaaatgtacatacacataaaatacaatggaaatggacgaatttacggtaagcaagcaaaggtcaactacaatacaaataaattagctaactaactatacacaatacaatattgttggaatggcatagtgccagcaaccatcatttgggccacataaaacgcatcaatcaaccatcaattaattaattaattcatttctgctgcttcattgttgctgaccacttgacccgggagtagcggtgtcgagaagactgaaaaataaagatttaaattgtattttaagctcattcaatttttatggttccaatggcattttatgagtccaaccaattaacaatccttgatttttagtgccacacaatcctgtcaatttcaaagatgctgggacattagacaaaaaaccattaaaaattttgttaacttccaaaaaaggttaatggcctgagaatcccaaaaaaccatgcttttcgagcatttttgatcataacttttttgctcctgtaaaaaagcattgatcattttaattaaattgttgttcacccctcgtcaaatccgccgtctctgatccaaatgtccatccgtttcggtcgagcagcacacaattctttccactcattttcccaattttcccaaacccatccaattggacaacggaggagctcaattcatctgtgtcatattgttccagtgccaattgttcgccagtcgcttcgttgatcagttcaaatggcaaaaacgagccaaccaaagtggnacgaagcgtcaagataatgacngaagtcactcgtgaagaagcatttgaaaatgcctanaaatgngacaaaaaatcatttaaaa

SEQ ID NO: 40857 - DNA, 845 bp, Heterodera glycines
aaattttttcatttcctaggggtttattttttcaaaaaattttagagagatttttaagggagtatttttcttttttattgcatttttgttaacaaaaaattttgggcaaaacgccaaaataggcaattaggttttttcaaaatttttttaggcttttaggctctaaaaatacaagcctagaaaataggcactaataactaacaactatcatgtttttcgtgtgttttaggccactgggagctcaggaaaaaaataggctaaacctaaaaattgcatctctatttataacttatattttggcaggtaaaaacccaacgcgtttttggccaactcgttctttacgtgttatatgtatatgaactgtctaacttcgcgctgtctgcactcctacataaatatatagacaaaaaacgagttgggccaaaaaggagttgcgtgtcgccctttttgcatagtccgtatttatgccatttttggtgttttttagtccatttattttataaccctgattattaggtattattttttgtatattatgcatgcatataacgtattcacagtaaagcaactttatctttaaaagcatacaataggaaaagtggaatacattaaaaaagatagaattcgaaataagaacataataagaacaacaaaaatcccagcccaaaaggtcactctgcacaaatgatcggtcggccaccatatgacgacgattacgatcttttacaagcaatcagacaaaagaaaattgcaaggagcagcacaacaaacgaaacgattgcaatcacgataacatcatagagacgcttatgcgaatagtaatgaccaccataacgatcataaac

SEQ ID NO: 40858 - DNA, 951 bp, Heterodera glycines
gaaccgttttgagtagattagactataaaaaattgaaaattttgaaatcatgtttcccactcctttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaacgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcacgaggggtattattttgtaaagtctttttttcaaaataaaaagacaaaccccatttttcgcaccgtgaaatgttatttttatt

SEQ ID NO: 40859 - DNA, 1000 bp, Heterodera glycines
  misc_feature (106)..(106): n is a, c, g, or t
ccctaattcgggatttcaaaaaaccaaaatagacacataaaaatcggctgaaaaaaggaaaatacaccgtctaaaaatcgaatttttgacttcagccccccccccnccccccgaagccaatggtctggctacgcccttggatcggacattttgacagtgaaaatttttaaaatttgtttggttaataattggcaaaatatttgcaatttcgaaaatattaacaaaatatgtatattgtaaatttttatcaactctctttaatttcagcagaatacgcgggtggcacgctttgaaactgatttggcctgtgctgggccagtcgatcaggtgctcagatttatgattgattaactaataaatcaggctgattaggccaaatttgtagcactttcaaaaatacaaaataaagttaaattgacttatttttggctcatataaaattatattttattgatttctagagaaatcccccaaaagcatttttttaatttttcagactttatgtattaaaagagacacccggcggcttttatttggaaggccgttctaatactgaatttttcgaaaaatgcccatcatgcacttctcataatttcaaaagaaatttagggggagagtaaaaattatttatggaaagtggcattttctggaaattctttttttcaacatttcgctttttgcagtttcttgacactgaacaatcagcaacttaatggactacaatttgtcacctcaaccacagtgttgcgtgactgtgccaacctgcgcggcatcgaatttcacagattgccttatctcggcgaaatcatggatgaatttgacagcgacattgagatgatggacggtgaaggaggtggtggtgaacacatttatgtcattgaagacaataatgacgaccaattggcggaggaaattgatcagcaattcattggcattatggccaattttggcgggaacaatgccgggcggggcaattggtgccgcaaagtggattaatgga

SEQ ID NO: 40860 - DNA, 926 bp, Heterodera glycines
  misc_feature (42)..(42): n is a, c, g, or t
ttgtacctcttctaatcactgttcttctgtttgcatcactgntgggcctcttctcatcacttttgtatttcttctaatcactgttgtacctcttctattcacagttgtacctcttctaatcactattgtacctcttttaatcatttttgtacctcttctaatcactgttcttcctcttttaatcactgttgtgcctcttctcatcacttttgtacctcttctaatcactgttgtatgttctgatcactgtcgtacctcttccatttacttttgtacctcttttaatcaccgttgtacctcttctaatcaccgttgtacctcttccatttacttttgtacctcttttaatcaccgttgtacctcttctaatcaccgttgtacctcttttgaccaatgttgtacctcttctaatcacttttgtatctgttctaaaatttaaaaaacggccgcgaagcggccgaaaagaacaacaaaaattagaaacgggcgtgaagcgcccgtctgagtcgatcaaaatttaataacggccgcgaagcggccgtcaaagcccaacaaagtttaaaaacgggcgcgaagcgtccgtccaaggccaacaaaatttgaaaaacgggcgcgaagcgcccgtccaaggccaacaaaaattgaaaaacgggcgcgaagcgcctaacaagctaaaaaacgggcgctaagcgcccgtataagttcaacagatttaaaaaacgggcgcgaagcgcccgtccaaggccaacaaaaattgaaaaacgggcgcgaagcgcctaacaagctaaaaaacgggcgctaagcgcccgtgtaagttcaacagatttaaaaaacgggcgcgaagcgcccgtcttgagcctcgatgtggactaaaagcctctaataattttttaaaaattcaaaaaaatctctccaaccaattcgat

SEQ ID NO: 40861 - DNA, 1005 bp, Heterodera glycines
  misc_feature (70)..(70): n is a, c, g, or t
accccgatgctaatccgttccgcagagcttcttcaaaatttttccattaccgcaagatttgcggaaatgntgaataattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagatttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccacagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaatttttccattaccgcaagagttgcggaaattgtgaattaattctcagaaaaatggctatctctttttaggacaattttct

SEQ ID NO: 40862 - DNA, 950 bp, Heterodera glycines
  misc_feature (48)..(48): n is a, c, g, or t
tgacataaaaattattagaaaaaaaaattcaggggggtgctaaaaccncggaagtaccaaaattttaacgttgaaatgctatttttgagcccctttcttcatagcatatgcgcagaaaaatatgttaatccacataatttataaccctacttattacattaggagtctaaaattgactcgctgtatttaggagtcaaaaacagaacattttgcaaaattatgttatttacaatttattcaatcaaagtgttatcaatagggactcaatttttaggcaaatgcctaaaatttttgcgcacttaatacgcacagataagcacaaaaaacgcattttccacttggtttgcggtgcggtgtctacgatgacttttataatgctatttttgcctatttcggggtttttgtgcctaatgtgcctattttagactttttgaaaaaatccttaacaaaaatgcaataaaaacggaaaacacaccccctaagaaatgacccgaaaaatttttcaaaaaatacacctctaagaattgaaaaattttcacaaaaattgatccacaaaaatttaatatttttttcttaataaaaatttttggtttaaaattttgttctttttgataaaaactttaaaatatttaataatttcatttataattgaaaatttttatattttttgctacctaataagcgttaataaaaaattttatttgcctatttgaggatttttgtgcctattttatgcctattttgctattttttctaaatttttaggtgcctatttcgcgattttttgggcctaaaaaacgaatccctagttatcaaatattatattcttccggtaggggagggttcattgccgctgtttcattttgccagcggtttcattgccagtatgtttaagcaggtatctaatttgttttttgtcaacttttatggctactgaatcctaacaaagc

SEQ ID NO: 40863 - DNA, 1055 bp, Heterodera glycines
  misc_feature (41)..(41): n is a, c, g, or t
  misc_feature (71)..(72): n is a, c, g, or t
  misc_feature (100)..(100): n is a, c, g, or t
acaaattatgtatatttatatatacaataggcatggatttntgatgcaaaaaaataaaaaataaataattnntaaacagcaaaatatttttatatattgncgcatagttactgtttttccacgcccaagtacaaatgaacgtttcaatttaaatatgcgattgttttcaaattttgttataaaatgccgtacctatcaatatgagaggcccgacatgaaatatggtctaccatctcctcaatataaacacgtatgcatatactacagtatgattagtaaatagcctttttaatgagatccctaaaatggccggtatgaactttatagctttttttgacaaatcccagccataattaatcatttttaaaataccaatcctctaatacaatagtcaaaattccggccctgatgaagtgattttcaaaaaaaacacaaagaaatttattcaactttaatccatcaccatgctaggtgatcgtgaccggtgcagaggaacacggactgcccaccaactacattcagtggttgcgcgaaaattttgaggacaatggctatgacgggcctgtggaagtgaatctgaaggcacttgagacaatgccgaggccgactaagaaaagaaagctaagccacaaaaaagaaggggaagctgaaagctcgaacatggcgctgaacaactgatggatgagtgagtgagtagccgtggagttggctttgtgttgatcagcaaagaaatacagaaaattagcaaccaaattaatcagcagaatgacaaaatattttttatttttttgcaattattagataaattttcaatttttagcaataattctaaaaagcaatatattttttttgtgtgttaatttctaatcccgctaaaggattgggattcaaattttagcggaacgggattttgtgtgattaatcacaaaaaatgagggattgcggactggggatcgagcgaaacccgcttttaaaatatattttctaatctttcatttagttttttatattaatctatcatgaactataataaaaaaagaaatatttattataac

SEQ ID NO: 40864 - DNA, 925 bp, Heterodera glycines
cattcttaccagtgcttgtttttcccggttcccggttgccctaccgggaccggaacctgagcttttcaaaatccgggaccgggaaccgggacctcggatgaccgggaattcccggtcccggtcccgtggcactctagtcaatactcaaatcatttaaaaaaaattaggtactattttgcgttttgtttttttttgaatttctgaaagatacgttgcttcgattatatttacacgggccctatacccggttgaaccgggcctgccgctagacccagtcgggcaccctggcccatgaaccctaatatatggactaaggacgactgcatttgcttttagagattgttttatgcgattttatattttttgttctaggttctggatcattattaatgggtatattctatttattcttggtttcgtttttcgcattgatttgcagcgacatcatttgcactggttagttaattattctcccccgtttatttgaacgacaccaaactcgttttgggtaaactcgtttttgcccaactcgttttttactttttttttttgtttgtgaattggtcatgtgttttatttgttactaaaattttagaaaatcctcatattactcagaatccctgccataaatgacgataaggtcagaataccgaaaaaggatttaatccagaaatgaaatcctaaattgagttcaaaatacggtcccgaaatcaccgatacctttttttactaacagattttgtaaatggacatgaattttgcttaaaactcaaaccgacttaagttgatgcaaatcgtgtccttttgcgagacgtcacttcgctgacacttcagcgtggccaatacacttccgggccgccgttcgtcgcccgttgcgcagttggaatgtgtcgaaggacagcctatgggaagtgagtgaagcgaa

SEQ ID NO: 40865 - DNA, 842 bp, Heterodera glycines
tatgctccgaacaattaaaaaccaaagaaattcataattttgaccaaaaaaaatttttcgacattttgtcaaacctgtcggcactttgtcccacccaccccgaacattgttagacctctccaaacattgtccaaacaaaacaaaaaccccattttccctgctccccgcactcatttccccacaaagcccgcacaccctgaaaaattctatcttttttaaaaagttttccggacaaaaggtctactcaaccttgggctagggacccaattttttttttaaaataaccgccttaaaattctctacaactctgtctccgatgtccctatttgccaaagcaaaacaaaaaccactaatagcaaaaaagtgaaaaatggacaaaaatttaaaattttgacattttgtccgattcgtaactctgcgaatccggaaccaaaccggccaaatttttttttaaaatgtccgcaattaaattccctacaacagtttgtctgatgtcccgaattttcccggcaaaccggaagccgctatgggcgaaaaaccgggcgccagcccaaaaaaaaccgatttttcgaccaattttccggacaaatgaccaacttaccctgaggctagggagccaaatttttttttaaattgttcctctcgccgagctctatccaatggcgcattagcgccggacttcccgattcgttaaccccatgcttcctccggcgctaactttctgagaccccgacccaccccaggggctaaagggggtccgccccttcaacttagtgctggcgcgccaattttttttttaaaagatgcgccatcgttaggagcatcttttattgctcttcacc

SEQ ID NO: 40866 - DNA, 1688 bp, Heterodera glycines
  misc_feature (1633)..(1633): n is a, c, g, or t
  misc_feature (1636)..(1636): n is a, c, g, or t
  misc_feature (1654)..(1654): n is a, c, g, or t
  misc_feature (1674)..(1674): n is a, c, g, or t
taatcggggttaagattattggactggagtcccggcttttggctccgttcgcgctccatcgtcaattcccgaaaattctggcctctctctcttctttacacccattttttgcctcattttcttgagaaatcgtaaagggaggaaccgacaatgccgacatgcaccacataatgggaaattaaaaagttttcttcaatttcttacaatgactcgaaaccgatcgaatttttgcctcatttttcttttttttttgtttacaaaaatcagaattatttttattttcggtaatttatgtaaatgattttttccatttatttttttattcgttttcattgcatttttttttgcttattcaacaaaaactgctaaatttgcgttcgtttttcccatttcttttcattgatcggcaaaataatttttttataactttaaattaatctttttattctttgaagagtacggctctgctggtctctttctatggcaatttaatctcttttttcgtacttttaaatttgtcctatggtaaattgtcgcattgcctaccgtaagaaattcttttaatttttttgttttttttaaatttttccttaaattttaaaagtttttatctgacgaatatcattgacggagtgcaagagataaaaatttgcgcatctgaacagtgcccaacgggacggataaagccaagaaaaaggcctatgattggatttcggcttccacaaaacggcggaaattgtgacggagggtgggaattttcaaaacaaaacataaaattgttaaattaaaacatttttgaatacctgttgagacttaaactttattcatattaatatatctgtctaattaattaattatatcaattaattcaatgaattaaatccaatccgattacaagcgaatgcgcagtataaaagaccaatgatgatcatagaaatagctcaactcattggtgtggcataaactgcgcacagtgcaaatgccaacaaacaacagcacagtttttggcaccattatgctggtgccatcaattgttccgcttcattagcttaggataaaattaatttattaaaataattgtcataaattaaataattattgcctatcgaattattggggaaaatcaacgtcaattttcaattgtctttgatggaaaaataattggcgtgcgttttagctattttgactaaatatgatggaactattaaattaacaaaattattatttaaattttcagaaagttttttttgcttcctgtttatgagagcgccatgcaaagagcctttttatgtcatcttcgtcaaaatggggatatatttttaaaagattatgccgaactttggctgctcgagtttgacatggtgcggataatgaaacagcagggggagataaagctgttagtcagtcgcagctgcaactgcaccatggaagaattggtaatgcaatctttgactaattggacgtgctttggcatgactaatggcaattttccaaacaaaatgatatttgtttgtttttatgtatttaaagctgcatgtatttaaagctgcattctgtaaggaagaagagctagctgctgctggacggtcggttaaatcgcggaaagcgcggggtatccaaaagctagaagctntanataagattggactttcanaaaatttgtccaattcttanaaacagacaaatct

SEQ ID NO: 40867 - DNA, 962 bp, Heterodera glycines
  misc_feature (26)..(26): n is a, c, g, or t
tatgagcgctaaattatcagagtgcngaaaatcgcatgtgatctaagcctagaaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccatttatgagcgcagaaaattatcagagtgccgaaaatcgcatgtgatctaa

SEQ ID NO: 40868 - DNA, 681 bp, Heterodera glycines
  misc_feature (30)..(30): n is a, c, g, or t
ttctcaaaataagagatagtcatttttctnggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctatcatgctcgagagcttttgtaacgtataaaatttctcaaaataagagatagtcatttttcttggatataagataaatttaaaaat

SEQ ID NO: 40869 - DNA, 1223 bp, Heterodera glycines
ctttttccataaactttttgggaaccgcgggggtccggtggcgccggtaggcgccgccgggaaaatttttgaaaatttcaatgcaatttgttaacagattttcaccaaaattaccaattttttagtttttgagccaattttttatgaaaaaataagttttgggggcccgacggtgcagataaatagaaattttgaccatttttaacagatcttcactgaaattttggggcattttacactcacgaaatgaattaaaatgtaatttttacgcttcaataacaaatgatatgtataattcaaaaattttttttgtttgcctaattgtaattttacaactgttaacatgtgttttttgtcaaaattgtaaaagtgtctgaattaatttttaatacactcctaaaaatggaaaaatttacaaaaatttatttagtaaaattaatatttcttgactaccaatttcactttcagtttgtcatctttctcatttttgaaaaaaaaaaatcataaaaactcatgtaaaaacattttttctggcgttttcagggtcgtagaacagaatacggcattcatccgattcaattccgtaccactggacccgaattcgaacaatgagttaaaaatttattttttctaaattcatactaattgttttgggagaattaaattttgagcatttgtttattgtttattgtcaataaagaaaaagtccacaaaagggaaaaatccgcttacattgaggacaaaacattaatttaaaaaatgtcctcaagaaagcgcaaaacaattaaaacgagatcaccgccaaaaaatatatatataatgtgaatcaaataaataaataaaaagtcaaatattgaccaaatcacttttagttttaatgaattaaaaattcgactttaattttttcccggtctattttacaggaatagagatagttttaattttatttttaaattgatttaatgagtttatttcaatgagccttttatcgagttggttccaaattttagttacccgcctgcaaaaggtatagattttttgcctaatttatatttcgagttaagtctataaaagggaatgttaaagcgttcagaaggttgaatatttcaaagggattcagatctgttcggccataaattattttatgagccatgaacagatcagacagctttcgcctgctttcaagtgtcggcagttgcaggtattctaatctttgttggtat

SEQ ID NO: 40870 - DNA, 1161 bp, Heterodera glycines
  misc_feature (45)..(45): n is a, c, g, or t
  misc_feature (96)..(96): n is a, c, g, or t
  misc_feature (1069)..(1069): n is a, c, g, or t
tggttaagatgcacattattttcatttttttggttttacttatcncaacctttattttgtttcggatataaaaattagttatgctacaatataatntaagaaataaatttaatgtaatttgcaagatcctttataagtataataatttgttcatttaatgaacttacttgttatattagatttatatattattttaatttaaagacataataatctaaaattttgagttttatgtttttgttatttcactgctcccacttgtaaatgcggaaatttaacaaaaaattgtgaataattgtttgcataattctaaaatacattttaattaaaatatgtgttaatttgtttattaagaatcttcgattgcattaattatttaataatttatcgttatgtaagctcagaaataattgccgatctcggatggcatcgcctattcttgaaatatctcgcgggaagctctgttttcgataaattcgaataggctggcatttatccacgttttgcaaatttttgtgttaaatgctattttacctttgtaaataaaattacaattattaataacaaaatttaattttaaaaataatatttaataaattctcaaattattgtttaattttttagatcccagtacttggaattgtaaaaaataggttgtattttttcgttcgttatttcttttaattttttaattattattaatttttaatttatattttcctcagctttagtttaattctttattttattcgttttaattcctgtaccagtttttcaataaaaaaaatcaaattgtatcctgacatttattttttaatttaatttaatgtgcatgttcctatttcacaggttccattttttgttgtttcttacttttaagtcaaatgataatatatgaatatattttattttatatctatttacaacattctaatttatccagtaactggaatttagatttttctttaaaaaacggcacatagtaaatggttaaaaaaagaatttaaatttcaaattaatttattaagttgcattttaattttctagttggctttggaatagtttttanattatacgttgtttatttattaaacaatattctacatatttattatataatattttatcattttataaatgataatggagaaaattttgaac

SEQ ID NO: 40871 - DNA, 1093 bp, Heterodera glycines
tctagagtccaaaaatgggccaaataatggaccaaaatatggataaaaaatgccaaaatatatattgtaaacccccaaaaatcccaaaaaaggtgtgcatatttaatatttgcttaaataaacctaaaaagtacaataaacaaccaaaaaatggggtttaaaacttaaaaatgcatatttttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttttgaaaatttccaaaaaatggccaaaatatggactaaaaatccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagctataactcgtttcattcccaactaaactgaacaaatagtactaggcttttctctgcacagtggggcgtacccatagtgccgaagtgcataaatagtgaccgttcctttcatattttgattctctccccattcattcgcaatttgccttttctcttcattcactctctttcctcagacttttattattttattattgtcaataaatatttgtgttctttggacacaaatttgttgacagattttaccaaaaatatccaagtttgcgtcaaataaaaaaaccgtggaaacatttttctgcttaggttttcagggtttctgaccacgaattaacaccaattgaccaattcataatctctaaaccgaacccagaaaacaaatttttcgagtttcggattttgttcaaatttaggttaagaattaagaatctgttgaaaaggaggtaatccttcggaattgatgtcccgacgg

SEQ ID NO: 40872 - DNA, 1008 bp, Heterodera glycines
  misc_feature (939)..(940): n is a, c, g, or t
agttgcttttaatattaaaaattagcgaattatcttatccaaatttaccactattaatattgatgcatccaccgtggggttgttctatacggcttgtatgcgtctttaattataacattcctcgtatgaacacctgtgaactctgctttgacattctttcgtcaaactttgtcagttgcttttaatattaaaaattagcgaattatcttattcaaatttaccactattaataccgaggcatccaccgtgggtctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaatactgaggcatccaccgtgggttgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggaatccaccgtgggttgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggaatccaccgtgggttgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggaatcacccgtgnngtgtctatacagcttgtatgcgtctctaattataacatccctcgtatgaacacctgtgaactctgctt

SEQ ID NO: 40873 - DNA, 475 bp, Heterodera glycines
  misc_feature (56)..(56): n is a, c, g, or t
cgagaattgctgaaaaaattaactggaaggatgggcctccttagaacgatcccttncggtattacaaattaaaaaaaactacgtgtttcggcccttccatagacacaccaaacaagaaagctcacagcaataaataaataaattcgaatcgaagattcatcccccgtgtgttgtgaacttcatattttcttaatctatctgttgcaattctgtctttgctttttaagacattaatgagccttcaagaaattttttgatgaatggaaaaagtcttgagttatttttgtgttaatgagttgattcatagagctgttgattggccttcaacaagcaataaaataacataattatagctttctcaacttatgcattgctttttgctccttatttatgcttcctatttgttagttatttatttattgctgtgagctttcatgtttggttgtctatggaagggccgaaacacttagttttt

SEQ ID NO: 40874 - DNA, 958 bp, Heterodera glycines
ggcttaccaaaacttcatcgaacctggctctttctattctctttcaaatcgccccaaattttttttacagcttaactaggccctattaagcttatttccagaaaatctcgcatgaattctcatttttaaattttttatagatttttaaatgtttggatttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttaaattttttatagatttttaaatgtttggattttttttggcttaccaaaacttcatcgaacctggttctttctattctcttttaaatcgccccaaattttttttacagcttaactaggccctattaagcttatttccaaaaaatctcgcatgaattctaatttttaaattttttatagatttttaaatgtttggatttttttttggcttaccaaaacttcatcgaacctggctatttctattctcattcaaatcgccccaaattttttttacagcttaactaggccctattaagcttatttccagaaaatctcgcatgaattctcattttaaaaattttttaattgctttttaaatatgccaaaaaatgtaggcttaccttttttagtgaaaattcgatcactcatattttttgctaattgagcagaagcctaccaaacttcgcagggatactccccggtaaaggaggtaacttacactgaaatgagcgccgagctagctgg

SEQ ID NO: 40875 - DNA, 445 bp, Heterodera glycines
tttgtagtgttccgatacgtatccctgcaaaatttgcgttagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattctgaagggcgggggggg

SEQ ID NO: 40876 - DNA, 1189 bp, Heterodera glycines
ttctttcatccacaagctctcttatttttcagcaaaggggtcacaattgccatagacgaagacgtcataatatttttccctccatccctccggaagaatgatcgtcgggtagccctgccgtttgaggatcaaattgaccaacaaacggcagagccgcccgttcccgtcgaccgcaggatggatgatgcactatgaaaattaacaaataaaaatatatatttggcaatcggacagaatggatgataataaattttagctcacaatcagattattttataaagaatcgtcaaatgttgatttttaacttgggtattatttttcattggttttactaatttttaaaataactgaaatattattctaagcctattagtagggttcaaaattgtatgcactaaaaaaatgccaaatacgcgcataaaatatgcactaaaaaccccaattaataatttagaattgactttaaaataccaaaacaattgctaaggagtgtttagagaattgaaaaaaaattttttgtttttcaaaatttttatatgcaatttcgaatttttaatgtttttattaggtataggctaaacaaaatgcattatttccaaaaagtctatccttagtgctgtacttttgggacccacgcgtttgggcgccagcatgtttttccactataacttttttctttgtcatcaaatccaacattgttgatatcattcaaaagctcttaacatgctctatagccttaccaaaagcgaaaagattttcaacctggaaaaaattttattaagaaaaaagttcaaaaatttcgacttttcgcaatcgtgaatcaatagcttagaaaaagcttctaaagatgtattaagctttcgaatgatatcaacaaattgtttttgaaggtttttgctaggattggtcacgagcggtcacagcactttttgtcgcatttaaaaaaaaataaatcagttaaaaataaatgcgggatgaattattttgaaaaaattcaaaaataagaaaaaatgtaaatacctatcgaaagattacgaagaggaaaagcttctactctaaatttctaagcaagaaaattataagcccatttgattaaaaatcatagtttttataaaatttaactcatattaaaaaagcgaaatatggattttccattcaaatataatttttttttttaaattatttttgg

SEQ ID NO: 40877 - DNA, 1413 bp, Heterodera glycines
  misc_feature (55)..(55): n is a, c, g, or t
  misc_feature (1356)..(1356): n is a, c, g, or t
ttcctattagagttcgactaaacaattaattgataatatatcaggaatatatttnaggcaaaattattttaaatttaatatattaataattttatgtgctagaaatttatttatattattaggctttttaataattttgatgaaataattatataatcaaattacgatttttttgtattaatttaaaattaaaaatatcttaagagtgtaaacatgaaacaaaattttcgatctacatgtagattgattatttgtattaattctagttttaaaatgtaaatgcaattttgattttttaattttttttttcattggaaaaatcatttttgaaggagggttttcttttaaaaatgttcgatcgtttcttaatatggatattttcgtatttattgaattcttctcaaagaattttgggagaaagccaatgcgtgttctgcactagaatcaaaacaaacataaaactcgaaaagtagcttaacaagcatatctatttcatcaaacgaagggaggtttaggaaaatcaaatgaccaaaattcaatcaaaattcttgacaaaaagcaaattttaaagtggaaaagagcaaatcaaaaaaatgaaaaaatgaatttgaatatgataaatttattaaattttcatttttaattgcacccctttcagtgccgttgagttgagtgcattcatagtaagaaagtgatcaacagggctgcaaaaaacatgcaaatatcggtacttttatttgcatattttgggtttttatgcatatttcatgtatattttgccatttttcgtcaaatattttccgatttgaatatctcttttgattatgcctaaaattaaatccaaatttgaatggatgcgcgagtgggtcaacagtgagcttcactgccgaaaagcttgagaaatttttgatttgcaattacaaaaacaaccgataaaatttatgaggaataaaattttttaattaatttgtacccctaattttcaagtttttttgtgcatatttggcaattttatttgcatatttaggtcatttttcgtgcatattttttgcagccttggtgatcaattttcatttccttctactcttttgccccaaacaaaggtcattattcatttatttgtttacctcccatttgtcctttcgtcgtccgcttttgcttcagtttctgtttcttttgttgcttcatctgctggttgtgctgttgttctttgattttttctgcaatttcattcataagcttctgagcaattttggaaaaataatttcggtgagagtaattattctaaaaaaattaatataaaataactacttcacatcagcagggtaataacaaagaaataaacgcattgcttanaaatgcccaaaatattcgtcatagtttttgtttgttaattctaatttcattgttttg

SEQ ID NO: 40878 - DNA, 614 bp, Heterodera glycines
caaacgcgccatgcgagcccacgacgcctcccccgtgcaaaccatgcccgcagggaccgcccggccctccaggaccacccgggtcacctggtgaccctggcgaggccggcacacctggacgaccaggaacagacgcatctccaggatctccagggccgcgaggaccacccgggcctcccggcgaacctggaccacaaggaccacctggcgagcccggagtgcccgcgcagagtgaaccgcttgtgccgggagaacccggagagcaaggagaccaaggtaaaatgctactaattgattgggtgatcatggtaatgctgctttgccaacactttaggaccgcccggaccccccggtccgccagggtcccctggcgccgatggcccacccggtccgccaggcccaaagggcgagccggggccggatggactgcccgggcaggacggacaacccgggccctcgggaccacccggacccagtggaacgccgggcgagaaaggcatttgtccaaaatactgtgccatcgacggcggagtgttcttcgaggatggcacgcggcgataaaagaattggcattttggaactcaccgtcaaaccactaaaaatgggcaactttt

SEQ ID NO: 40879 - DNA, 1189 bp, Heterodera glycines
acaagtaaaagttgcacacatcgaccgccgtccatagacaacaaagtgccaacagccatttgaaagtgatgtgcttgccccgggctttgtacctgcgaacgacacgaaatgccaaaagaaaattaaaatgaaatcaccaaaagggaaaaataacaccgcacaagcggtcgaggccaatggcaatttgaagcgcaacggtaacagcggagccaatgatgggaagaagctgaatggagaggcaaaagcggagggaaaggtagttgaagccgaagaggaagatgaagaatttgaaggtgaagccgagcagcaggaaggaggcggagaaggcgtaaagagcgatcagaacattgcaatgggaatggagtgatctgagggagggaaaaggaaaggaactcggcgccgacgggactcgaacacgcggccaaccaaaccgaccgcgcaattacgcattattttctcccgtaatttttgtcaacaaatgggaagcttatttcgattattttctgacaaacttctcctaataattgccattaaaatgtcaattttctccggcggcctctcgccacccccggacatccccccacacataattaaatgcaaaacgtgctattaaaaccaataatatgggacgccgagactccgatccgatccgaaacttattgtgcctcgggattccaatttcctaaaatttttgggtgacgcatttactgatttaccatatttgtgtccaaaaaaatcgacaaacaaaaaattaaaacatgaaatgatacggattagagaaattatggcatttttggagccctgtaattatggattacggagttctatatctacgtccagccctgttttataaacgacagactgatcaactctggtcgatctgatcttgatcaatcctttacaaacggtcttgacgaatgcttcctcatcagtcttggtcatctttctcccgatcagggctgggcgtaactggttttcaattacggaaatccgtaatccgtaattacggcgattttctccattacggaatcccgtaatccgtcatgacgggggtcaaaaaccccgtaattttccgtaatccttaccccgaatccgtaattttcaaattttaattttttttaaatatttttcaatttttattttaaaattcaataattttttagcaatttaaaagcatattaaaaagatt

SEQ ID NO: 40880 - DNA, 1040 bp, Heterodera glycines
ctttttagaaattccaaatgcgagtaagcagtttaatggcaacaagtatatggtcaaatttgtgctctaaatatgaaagacccttgtggaaggaggccgccacataatcatgagcaatcacgtgtcctttttagtagaaattcccaaatgcgagtaagcagtttttaatggcaacaagtttatggtcaaatttgtgctctaaatatgaaagacccttgtggaatgaggccgccacataatcacgagcaatcccgtgtcctttttagaagaaattcccaaatgcgagtaagcagttttaaaggcaccaagcttatggtaatatttgtgctctaaatatgaaagacccttgtggaatgagttcgccacataatcacgagcaatcccgtgtcctttttagaaattcccaaatgcgagtaagcagttttaatggcaacaagtttgtggtcatatttgtgctctaaatatgaaagacccttgtggaatgagttcgccacataatcacgagcaatcccgtgtcctttttagaaattcccaaatgcgagtaagcagttttaatggcaacaagtttatggtcatatttgtgctctaaatatgaaagacccttgtggaatgagttcgccacataatcacgagcaatcccgtgtcctttttagaaattcccaaatgcgagtaagcagttttaatggcaacaagtttatggtcatatttgtgctctaaattgaaagacccttgtggaatgaggcgttcgccacataatcacgagcaatcccgtgtcctttttagaaattcccaaatgcgagtaagcagttttaatggcaacaagtttatggtcaaatttgtgctctaaatatgaaagacccttgtggaatgaggccgccacataatcacgagcaatcccgtgtcctttttagaaattcccaaatgcgagtaagcagttttaatggcaacaagtttatggtcaaatttgtgctctaaatatgaaagacccttgtggaatgaggccgccacataatcacgagcaatcccgtgtccttttagaa

SEQ ID NO: 40881 - DNA, 1448 bp, Heterodera glycines
tggtggtggcttcatcattttgttcgctaattgttttgccgtgccgttgtcgttgcgcgacttttgcgatttttgtcggcctttgcctttgatggtcgccgcctgctgctgttgttgttgttgctgctgaggacactttcgcttccgtgacaacgaatggtgacgcaacagcagcaaatcatggacatcgaaaaagaaaaattgaaaataaatataaacatagagacaaattttaacaaattatttaattaaataaatttgtttgagaatttttgtctgaaatatttttaaaaaataactaatttttgtgctaattatttatttatttaattaaggcaaagtaataaaattcttatttagcaaaatttagcatgtaataaacaaataaaatgaaaataaagttaatttattatgtaacttactaaattttggcatgaaaaaaaaatatatatattttatttcaaaccaatttttaaaaacaattttattgttccaaaataaaaagtctttctcaaattcaaaaatgatgattaaataataaaaattctgtataataattaataattaggcctcacatttatagttttttcactatttttttcctgagctccccgtggtctaaaacgcacgaaaaccatgtttttttgggctattgttaagctacttttcgagttattagcaactattttatagttttttatttttagcaactaaaaaactataaaaatttttgaaaaaaaactattttcaactatttttgcttgtgaataaaaatttgttacgaaaaatgcaataaaaacgaaaaatacacccctaagaaatgaaaaatttctcaaaaattcatctccaaatttatttatttatttttttgacgagaatttttgattttaaaaattattggtttaattttcttacctttttggataaaatttgtcattttacacccctaaatttgaaagtttttagcaactattttcccatttttagcaactattttgtgggttttttagaaactaaaaattaattattttggcactttttagcaactataaatgtgagccctattaataatatattttaatcagaattaatttttaaataattttaaatgttcggaaataaaatgaaaaaaaaactaaattcaaaactttaaataataaaatttctaataaaattgttaatttccgctgctttattaccacgcttttcctctgtttgtgtggttgatgatgacgcgtttcgtccgccggtggcgacgttcgcccttttgccgtacattacgcgcgtgcaccaccgctgccacagttggcactccaacggcttgggcaggccaagtttgccaaggcacggcaattcgttcccctatgggcagaagaaataaaaatttggaacttttccaagcctggtgaggaatttttaaaaaaaattcctaagctagagaaagtcga

SEQ ID NO: 40882 - DNA, 1633 bp, Heterodera glycines
  misc_feature (115)..(115): n is a, c, g, or t
tttttataattcatgaaaattttttgaattttcaccgtttttgtttttgttaatttgagggaatgcacttactgattcattcaatataaaatttttgaaaaatcgcttagaattntagttttttttctcgggatttcctttaaaaatttttaaacttttcgggggagggtggcgagctgcttctttttttgtctcattttccgatgcttttctacttacaaattagttccattaattaaggtcattccggtgacagtatccatcaccagatgaaatacaacgaattgagcaccgaagtgttcacccaaagtgtgctcatttccacggtcaatcgaatcaaaaacagaagcagcggagaaacgatggagaacattgtcaacaaaacgaacgtgagtgcgtcctgcctacatgatgggagctagcagtttgtccctcccttccgccgaattttatatttttcaagcagaattttttttattaaataaaaaatcctagaaaagttttctgtgatttttcttaaaattgttggaaaaccctattaatttaccataaaatttttgaaaagattactgagatattataagaaatttgaacaatacggagggggggggaggaggaacgtaggctcgtcctgataagaatagggattgtatttgatatgctttttaatcaagttttgaatttcaggtcaaaatgggagggctaaactatgcactgccaatcatcagtgacgggtaaggaaatgtgtcatcatcagatacaaaaaaaggcttacaacctccccccctgccgccgtatcaattccccgtgaaatatttaaaaaaattttcaaaccaaaattttctttaaataacttttcattttttttgaaaaattctttctttaaattttcttgcaattttccgaggggaaacaatacggagggatgtggaaacgaacttccccgttccgatttatttaaaaggtttttttcgttactgtcatttcatgttgcgcatttttcagcatgctcatggagacattggtgatcggttttgccgtcaaccaccccgccggtggtttcggcatggattcggaccagaaaaatggcaacggaagcaatggcacaagcgacacgggcagtgacgcggcgagtgacaatggcaacggcgccaacggacacaaaccgcagaaaaagccgcaagtcttcgagaagagcgtcccgtcagtggtcggggtaagaagtgaacacagtcaagggacgacggagcaggacaaaacgtcgtcgccgaaacgtcgtcagccaaaaaggccgaaaaatttactaacttagaaaaattttcaaagaaaaaatttttagaatttttcttctgaaaaatttctaagttagtaaatttcacggaattttccggcgctttttggcatgacgaatttttgagaaatttaagtgatgttgttttttgagggggcaccaataatgaaaaacaaaaatgtttcccttaaaatttcgactgaggatatcgagttgggtttttgcttaaaaaataaatatttttcctatattttttacacaatttctctttagtattccgcaaacattggagagaataacaatttcgaatttgtcggcgactacaaataccaagtaattttt

SEQ ID NO: 40883 - DNA, 1553 bp, Heterodera glycines
tgtcctgtacaccacacaagtaccgaaagttgcaaacgaaaataatcaacaatcactaaattaatcaaatgtttttggcaagcctaaacgctgagattttatgtgttagcttcttaagtctttgtgctttcaaatggcgggtggggtccggccgggagtttttcgaattagtgcaatttgttaacaaattttgtcaaaaaaggaccgaattttgcgattttagtcttctggttactcttcgttgggaaccaattgaatggatatttaatcattttcatcatttgtccgttcgcctctgcctctataagctcatatctatagttgattcagtggcagcgcagccatctttattattattacccaaaagaacattcttcaggatgaagaaaaaaatgaattttaaaaactttttttttgattaatttaaataattcctaatccactttaaaatttttttattttgtttgtttttggcagctcttttttgtcccacctttgcgcacacttcgcatttgtaccgcttctcctgttgatgtgtcaatttgtgatttttgtaattgccgttctgatggaagccttttccacagtattcgctgagcaatgaatgggaaagataaaaataataaatgaaatggtaaacaaagaaacttttcagtttgctatttaattatccatctttcaaataatttaatggaaacatataatcaataaacaaaacacaccatgtgtacggcttgaaccctaaattaaataaaattaaaaacattaatcattggcatttaagttaattaccggtgtgaatccgcaaatgcgtatttagagttgaggaccttaattaagcatttggcgtaaaatgaagcaagtgtaaataagcatttcacttctttttttaatctctgatttacctgttgaagcatttcccacaaattttgcactgaaaaggcgccgattaaaccaaatttaaattaatttgacttttctcatttcatttttttttaccctgtgcggtttgtcctccgtgtgaatgattttgtgtcgacaaagtgtcgaagcctggcgaaaggcctttccgcaaaccttaaattttgccaatttttcataagtgaataaaacggcactttgcattgaaacggtctggcaccggtatggacctgaaaagcatttaaatttaaatgataaaattaaattaaatcgatcaatcaccggcatgtgccgtgtcaaattgtaatgggcactgaaagttttcgagcacaattcgcacttgaactgctgcgggttcgctgcttgtccatgcttcaccttcgcttcgtccccattttcccctccttttgcttttttcgtcatatttttgtcgctgtccgacggcgatgccgaagaagaggaagaggaagaagaggaggaggaggaggaggaagaggtcgaatttgatgggcacaatacctttttgtctgtcccattcttttgactgtcgccaattgacacttttcgtccaagcacaaaggaagaaccttttaaaaattcttaaatgtatcttctacatttttaaatcacct

SEQ ID NO: 40884 - DNA, 988 bp, Heterodera glycines
  misc_feature (983)..(983): n is a, c, g, or t
agctacggtcgcactccgtttcataaattctcccgtgtcctttaacctactttatctcgggaacagttctctccgcccatgaatcgtccccccccccccgaaaattaaaaaaatttcaaacagaaattttaaaaaaatacaacttagaaacttttttataagaaatttcaagaaaacatttttgtctagtgatttttgcaaaaatttttccaaaaaaaagacttaaaattttactatttttttcctttaaattttcgtataaaaaatttcaaagatttttttatgtggggggggggacgtaaatgaaatgcgcccctgctgatagcagccaaagtaacctaaatacgtacaattctcataataaaaattttttttttttgaaaatttattttactggcaattttccttttagtttaaaaaagatgttttcacaaaacgaaaggcaaacatatgcacaagccatagcggaggttggaaaacccgaaattttattgtattaaaaatagtgaatttaattaaaaggtggacaaaaaataaaatattgtataaactaattaattagttaaaatcaataactagggcttccttttttatgtaaatacattttttttcctggttagcaggaaaaacactttttttttgtgtttacgaacaaaagttgggacttttatttacatattttttacatattttcggatttttctacatattacatatgtacatatttttatacatgttttggacttttccgtacatatttcgaaattttttcgtacatatttattttttttttacatattttgggaatttttgagaatttataaaaaatttctttaaaaattttttttttaatttttttgaaaatgtatatggcataatgtcactatttttcaagaaattttaaggtctgacgcaattttttttttttgatcttttgattcagaatgctctgaaattttataattttgcattttcctccccanaaatt

SEQ ID NO: 40885 - DNA, 247 bp, Heterodera glycines
tgctggcgatgtgtgaactgctcgggatgagcgcaaacgtaccgaccgatatctgcttcagctttaccggcctggtacagcgcggcggccgcaccgggccgcataaggatggctggggcattaccttctatgaagggaacggctgccgcacattcaaggatccgcagccgagcttcaactcgccgatcgcccgcctggtgcaggactacccgatcaagtcctgtgcggtggtgtcccatattcgcca

SEQ ID NO: 40886 - DNA, 1144 bp, Heterodera glycines
  misc_feature (758)..(758): n is a, c, g, or t
  misc_feature (773)..(773): n is a, c, g, or t
tttaaatattatttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaataaatcgattttttatttcataaatatttttcagaaagtgctctaaagcgcaccaaaatttatttacaagttaatttnagcactctgatgctntagtatcaaaaaggaagatggagaaaaaattttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagagttcgattgctctagtcaatttttaaaaatttttaattcggaagtaaacaggccaaaaagtttaggcttaacttttttttcgacctgca

SEQ ID NO: 40887 - DNA, 1241 bp, Heterodera glycines
tcaaaaaggaaaattacccaactaattaataataaaaaaaaatgaccgaaagacataccgtgctgattgaagaaaaggagagaagtgagacccgcaggacgtcatgtgagttcagcgtctgccacccttctgtcgtttcgggtttccgccgtagtgcatccactggttgtccgggccacgtcttccttgacctcttccatactgtggtgccaaagtaggcgcacctctttgttgaccaccgctgccagatggaccggcttgatctgagggccctgtcgtctgtaggcaggaaagtggcgattctggaattggaatgagggagctcgcggctgctgtgattgttgttgtccaaaggcattcgttcggtccaggcgcaacccatgcttcaatgcccaactttcaagaaagccttcatcctccaccgattctcttttggccgaatcaaataggcatgtcgacgacctcacgagtgttcgtcccaaaagtgccaaaacatactcggctcggactacgcttgttcttgttatcgccatttcgatgaaacgtttccacacttgtcctgcatttattgagaccaagtctccaatgatgaagacagcgtggcgagctcttgaaagagcaacagtagcccgttgatcgtcttcaaagaagtgcatgttgtccgtccttccggatcccacctcggagtattttgatcttgttgtcactattatgatgacatcgcactcctgtgcctgataggcatcaactgtgagtgcacgaacaccgcagtgcttcagctttcgttcaatttccgaagtttggtacgtgtactaattagtcccacaggacattcttgaaccggcagaaggaaatctgagcccgtgatgagtgagcgttcttcagcgcttcttgctggaatgagttgctcattgtgcaattcatatgaggcatagctgatgagctttgccaaaaatggatggcttctgtacatctttgtgaggaatgtatagttcgtccctatcgaagcctctgcttgaaggatgacgctttccaatccatatcctgagtggaagatgtcaggcagttcttgcagatgcactccgagctgatgacgatcgcccgtcaaaagcaatgccttgagcttgggcatccgcgcaaccaagtgaaccaccactgcccactgagcttgagtgctttcatcaaagagcaaaacgtctgcatcagtgatgtttccttcaccatgaagtaaattcgcagcc

SEQ ID NO: 40888 - DNA, 1113 bp, Heterodera glycines
tttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgaagagctttttgagcgtaattacgattttacttacaccatttttttctaggcttagatcacatgcgattttcggcactctgataattttagcgctcataatgggatgtataaaggcgattgtagaaggaattggaagcgctaaaattgtttgagaagctttttgagcgtaattacgattttacttacaccattttttctaggcttagatcacatgcgatttcggcactctgataattttagcgctcataatgggatgtataaaggcgattgtagaaggaattggaagcgactaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagagctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgattttacttacaccatttttt

SEQ ID NO: 40889 - DNA, 2025 bp, Heterodera glycines
  misc_feature (221)..(221): n is a, c, g, or t
ggttttgattttaggatttttaacgatttttccagagaaacggagaccctttcaaaacttagttttcaagctcttcgactggtttttttcggaaaaattcggttttttccgggaatagaaaaaatttttgccctgagcgggacatttgagtcccgggcctataactcgtcagggatcggttttagccaaaaattgccttagaacatttttgtagagcattntaaatgctatcgaatggtgtactatatgaaaggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgggatttatttgggatttctatcttctaaagaaaaaaagttattccagaaattctggaaattttagatttttcagaaaaaaattcagaactcccttctgaaaagtcattctgtaaaagtaaaatactacaaaaattcgcaatttttttctctataatataaattttattttacatttttatctcttttttgcgaattgttataaaaataaaagtgatttttggtttcgggaccataggggggtgaccaggatttttgggtggaaaaattttttcaccgaaaatattccaaaaacatgtctttaggggtagtttatgacgctgatcacgaatacgtgatcacattttacttttgacatcgttaagacctcagaatccctgtgtgattggggattctgaggcatcattttgaggggggggggaagttcgaatccggccggtgtacattatttttctatatatttttgtgctatttttcagtgcgtttaatttatatttaaagatttgttgtaaattaataataaaagaatttatgtaaaaaataataattatcttttaataaagaatttcatatttttttttaattgaatttataaaaattaatttcatattaatttaaatattcaattcttgtacatttcaaaattctctttttaattaataaaaggaataattaattttattttttaaaatttataataaattgcattcaatttttgtacctcttttaatcacttttgtacctcttttaatcacttttgtacctcttttaatcacttttgtacctcttttatcactgttgtacctcttctaatcactgttgtacctcttctaatcatttttgtacctcttttaatcactgttgtacctcttttaatcatttttgtacctcttttaatcacttttgtacctcttttaatcacttttgtacctcttttaatcacttttgtacctcttttaatcacttttgtacctcttttaatcactgttgtacctcttctatttactgttgtacctctcctaatcactgttgtacctcttctatttactgttgtacctcttctaatcactgttgtacctcttctgatcactgttgtacctcttctaatctctgttgtacctcttctaatcgctgttgtacctcttctaatcgctgttgtacctcttctaatcactgttgtaccacttctaatcactcttctaatcgctgttgtacctcttctaatcactgttgtaccacttctaatcactcttctaatcgctgttgtaccacttctaatcactgttgaacctcttctaatcactcttctaatcactgttgaacctcttctattcactcttctaatcgctgttgtacctcttctaatcactcttctaatcacttttgtaccactcctaatcacagttgtacctcttctaatcacttttgtaccacttctaatcactttttgacctcttctaatcactcttctaatcactg

SEQ ID NO: 40890 - DNA, 996 bp, Heterodera glycines
aatggatgcttcaaatctgcaagaaattagattggcaataagtggttgtaaaaaactttggggtaatgaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaaggaattattttttgaagtgagtcaaacaccctattagtgctttgctgtgccgagaaccggcaggcaatggatggctttaaatctgcaagaaattagattggcaataagtggttgtaaaaaacttttgggtaaggaattattttttgaagtgagtcaaacaccgtattagtgctttgctgtgccgagaaccggcaggcaatggatggctttaaatctgcaagaaattagattggcaataagtggttgtaaaaaacttttgggtatggaattattttttgaagtgagtcaaacaccctattagtgctttgctgtgccgagaaccggcaggcaatggatggctttcaatctgcaagaaattagattggcaataagtggttgtaaaaaacttttgggtaatgaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttaaatctgcaagaaattagattagcaataagtggttgtaaaaaacttttgggtaatgaatt

SEQ ID NO: 40891 - DNA, 906 bp, Heterodera glycines
  misc_feature (891)..(891): n is a, c, g, or t
agttgatgtaactcgacatataccgcacaaactccttaccctcgcgggattgttagtcgcatgcgatgagctctataagctctttcggatgcgggttgagccgtgtcaatacaactcctccctgaaggcagcaaaggctactgtcctcgtgcgggaagagtagttccccccaatgagagcacttcttgtcgccaatcttaccagcattcgaatattctggataattctttgccgcagctgcagcacagctccaatccttgtggacaaggtagcaacgctgcgtacatgcagtgtctcgctcaacagcatttgttgataatcgacgtcttggtgcaggtgaaggagaacggataatcgaagcagtctcccgtcgacctatgcagcactgatcgccttgtaggcgtcttccgcggtgggggggcgaaggcccaccacgaaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcangaaactgatcagaag

SEQ ID NO: 40892 - DNA, 2031 bp, Heterodera glycines
aagccaaaaaagaatgaatgctccaagagaaaaaccaaacaagaagccaaacacacggcgaggacaaatcacaattgaaacaaggacaattccaccaataattcgccccactacaacaattattccacccacaactcgcactactacaaccgctattccaccggcaactcgcattatcacaacgacaataccaccaataattcgccccactacaacaattaagaggaccgactgagagagggaaaaagcgaagagcgaatgaaggcgtggaaggaatggacgcagcaaaaaaatcaatgggaaagtggtggcacggcacaaggagggaaaagattttttgagaacacgctgaaatccgcagtgatctcggcgaacgaaacacgagccatcccaccagaaggaatgagctggaaacgtcatgtttcgagctttcaaacagcgccgcctggccccggcttcaagcgccgataccacgacgtgagcccaatcagaagaatggacaacacgggacaagtgacgtcggcggcgagcggaacggaagaaaagattgtgaaaattcgaaaattgttgctacaggccaccgacttaatgggagaaatggcggacgaattgttcccatataagaaataagggggacagcaaaaggaatatcaaaaaaaaaccaccaaaattaaacaaaaaataattaattacatacattaaccattatttttgctgccccccccccccccttaattgattacaaaatgaaatgtttgggtaaaaatgactgccctttgccttcggtcattttccctccctttccttttcacacacgctaaaatttctcgccctctcttttttctctcattctattttttcgttctatttccttttcttcatctctatctctctctcttcatctgtctttcatttttgctcgcctgaggaaacgccacaactcaccgatgaccgccccgctcacagaggaagggctgttcccggtggtgttcgtccccacggcaaacgacaccaacaaaagcaacacgaaatttttcggcttaaatttattctgctgaccgcctattgacgactttttaccataagagtagtgaccgggaatggtgtccgttcgaaaaatttgattggatgattaatttaaaaaaaaggctaaaatttcgaataatttggatacggctgacgaaaaacgatggcaaagtgaataactcgaaaaatgagcacatcaaacgaaaggaactgttggatgagacacccacccacggccactgatgtgctgaaaaattcttttgtattccatatttcttcaacaaattcaaattcgtcgccgcggggacgaacataacgccgggggcgtcgtttgttgctgaaggggagtgttgtgcccgcctgggcttgggccacctgttgaaagcacctccacggatttcgcccttcccttctcttcccaatctttctatctctctctctctctctctctctctgttttctctttatttctctttctatctctctctcgtgcattactctttctctgattgctccatctcaaaatgttggccattgtccccgcccccgcccctttccccaatcgctctaatcagatttaaggggagtgatgttgggatttgagtcagttgttgatcactcggccattttgatcattcaccatttcccttgccttttgctacacattctggtcaataaaccttttgttattggcttgacattttgggggagcagcattttggggggagggatgccctctcccacatttcaggttctgcctgaaatgcttggagggcccaacattccttcgcgtattttccccgcttattatggggcttctggggtggatggggaccatttcacccgaaccattcccatatataaaaatttgttttgtttttatttttccctcttttttcacatttaataaaattccaaattaatttaattttttttttcccatttttaatccccttttttggccccacaaggcaaaaaaaaaaaaaaaaaaaaaaaaaaaaaaaa

SEQ ID NO: 40893 - DNA, 945 bp, Heterodera glycines
tgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgatttttttggggaaagtttttttctttcagtttcaccactgattgttgaggcaatttttttcgccaatttcttttgtctacaaacattatttattgcgttcatcctgtagtgtgtaaaaaattttcagtaaaaaaaacttgt

SEQ ID NO: 40894 - DNA, 963 bp, Heterodera glycines
tcatcattccaattctcttttctatttgtaaattttcttttgattttcacctaatttttttgcaatttttctttcaatttttgtccatacttttctcgagtattctttccaatttgcttgaatttctctttttattttatgaaaattttccacaatttctctcttctatttgtcatttaaaattcggatttgatcataaatttgtccattatttgttgtcattggcaattggccacaaatttcttcacaatttgtggacatttcttcactctccgcaccttccaaattttcatcaaaattttgatcaaattgttgatcattttgtccaaattggttattctgatcagcattttcttcataaattttctgagcaattcgaaaaatgtcttcttctgttccatcgtcacatccttggccaaatatttcattaaaacttttttcttgctttattttgccagcctcaatttggttaattgctttttcgaatattaatgcgcataacacaatataaatattaataaaattttcatgattttttgtaaaataaaatgagaaaatattttaaaaatgcttctaatattattttaatccaattaaattattattcaattcggcttttgaaccaaacagtcaatagatcgatataatatgattttaaacaggaaaatgcaaagtgcatatttgttattatgaaaaatccacttacaattagtttcgtaataataatgaaattgaaaactgcaaaaaaatgcagataattttagacgaaaacactcaacattttttatattataaagataatcattaattagcaaaatttaaatccacaattttaaccaattatcccttttatacaataatattaaaaggtgtaaaaaacaaatacagacaaattttaaagtcaaatataagcaggcagacaaaaatcggtaaagaaaaatcgtaatttttttaaaacatttg

SEQ ID NO: 40895 - DNA, 1130 bp, Heterodera glycines
  misc_feature (1075)..(1075): n is a, c, g, or t
atttttaaaaaattcattaaaaatgtaaaaatttttttgattaatttctataattcgtatatttaaaaaaaagtttctctaatcagaaggtaaagcggatttataaaatgcaaaaagtggcggttttatcaatcaaacgaactagagcctacatttccaacgcaattcagtcacttgcctgaagcacattatcactttggaagcggacaaggatggcactgtacccttttgacttgttcagttggtgttcacgacgttcactgatgtggaagaactgacaaaaaaaaatattgtgctttttgaaaaggcttttcaattgaggcctgagatgctttatcatttcataaatatacagtatctcatagggagtgatcgcgtcaaattttttcgtgatcggggttaataatttacatgattagtggggactgggtaatttggggatgatctctgattcgcacacagagagcgaaatttgacctctgatcttattgaaggtaagaaaaattaatatatattttaaaatatctattgcacttttttaatagttttttacgacttaattatttattatttttgtgaatccagaattactgtggttataataacgatttgtttgctagcaccaatactttctggggaatttggagaattattgtgactgagtattgggctttaattgaagctgactattttgtttcatgaataatgtgtaacgagcgaactaaatctcattctttttaataacaagaagttccggtttttaattagtccataataatgacacggtcgtcgccctgtgattttacagctgaagatgcagaagcggcaattctcggccttttgccaccgcaacgataatttttcaatttcctatcaatttttactacggataaactccaaaatcaacaataaaattcttcaacgcaatttgaatttcttctaagattttgaatgaagtgcagcagaggctttaaaacccaatgagtgaactcaattcattttttaaaattttgttttctgtttttaaaagtttaatgtctttttttatttttgttaaatttgaaaaaaaaataanaaataaataaaaaatattacaaaaattttgtttgtttttattgtatatggagaaa

SEQ ID NO: 40896 - DNA, 882 bp, Heterodera glycines
ggcactccccacgatccgatgcgctcagatatatggggagaccgaatcattccggaatagatgcgctatagccggtgctctaattctgcgtgtgatttttgctcaccatatatgtttgagtatcgcacccgcgcacttgagaaaatctagattttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttcggggcagtccccccgaaccgatcacccagatttatggggagaccgaatccttcgggaatagct

SEQ ID NO: 40897 - DNA, 1032 bp, Heterodera glycines
  misc_feature (961)..(961): n is a, c, g, or t
  misc_feature (987)..(987): n is a, c, g, or t
  misc_feature (1003)..(1003): n is a, c, g, or t
tttcaatttgttcatttttagatgcaaaaacctactcctttaaaccgccccaattcttctgtctccaaaacccttgcctgcgggcttgaaaaaattgtgaatttgagtggaaatgagccactctcggtgccggtgctggcggatcggagtgatccgctgggactcaagtcggtccaacccgacgcggtgccaatggagagtgctgagggcaccaaggaagtggaaataatggaagtggatgaaatgagtggaggaaaagggaaaagggatgaaatgggtaaagaaaaggtgaaaagtggtggaatggaagaggaagaagaaagtgagggcagtgaaagtgaactgctcggagaaggtggatttggttcgatacaattaaaccccagcctgagggcgggaaataaagcagttgaaaaggaggataaggggaaaccttatctgatcgcccaagtgaggggcgatggtgtgatcgccgcccggatgaaacttttctgggatttcccggaattggtttttgtcccgtttagcctcttcgacaacgcccagccgatcgaaatcggcgacactttccgcctacataagtgcgaatggaccaagagcgagacaggatgggaagagcgcggagattggctctatgaagtcaccggacggctcaactaccaagccacggcgacggacgtgagccgactgcgccaacgcctccccactcgtgcggtcggcattttggtcgacgtccagagggcccgtgacagacacgtcaaagtggcgctggtctcagcacctgagctaagctgcgtcatgcgagcctaccgtcgccacttcccggccgaattcacggagaccgacatccggtaccgatccgttgtccgtcttcaacttcggcagatcaacagtccgccatgggtgctgtattcgcagcaatttgcgtacgttttgccatccgattttggtaagaaaaggngtgatgagctgctccttcatcatgtnaacgtaatttactggncgtgagcccgagccgatgggctatgagtt

SEQ ID NO: 40898 - DNA, 1643 bp, Heterodera glycines
ttgtttgtttggtttttaatcccttccccgcccgttcccttcctgtttcctccttaagtttccctccgccgcaaatttgccccactttttcccccgcaatcgcaactgtgcgaaattgtccgcccattttctcccccaataaaaaatcgctggttcgccaaattttccctccaaagtacgttgctcccccaatttgtagtgatcagcccatattaagtgtaaattaacaatattcactttttgcccccaattttttatctctttccctattccatatttaaatggccccaaatcactcccaattcacattcacttcgcttttacgggcaatcaatgcctatccctttgcccgcgctcacactctctctctcttccgttttctttccctttacccatgccttaaccatttcttttcctagtccctttctctgtccaaattgtgatacattatcatcccggtccctcattggcattccccggtttctctctttggcactgtcccggtttttcccctatttctgtgattgttccccccggtgacggcccctctttctgtgatcagtcccaatttctgtgatgaccatttgtccgtgattttgtgatcatttgtcccccggtgatggcacatttcttttgtaattttttgtattggatcaccatttctccaacatgaggaacacctgcggtccctcgatgtcctctccggcattgttcagctctcttgtcagtcgttcgagctgaagcaggaagtcttttgtgtctcggagacttcggcacgtcttgagattggccagctcaaagtgtagcgccctgatgtgctcttcaggtgcgccgtaagtgtccttcagcaactgaaggaccgtctcgtagttttggtcctccaggcggaacccagcgatgagttcccgtgcttctccgcccagaagattgcggagcaagttcagcttctgtgctttgctgattgattggctgccgatggccgatttgaaggactcgtagaattcgggccattttcgcttttgaccgaagaatttgtccagctggattggctggaattgatagagcggtgccgtgaatgtaggagctgctattggaggcgttgcagtttgtggtggcggatttgcttgctgatccgctcttgcttctctttctgctctgcctcggtaaagtttggcatcggcactgagcgttgcttcgagatcccgcagatcccggagtttggttgtggctgcgtcatggcgttcagcaattttctcatacgtgtcgaatttgacgtattctttctcgcctttgtctttttctgttccttcgaggcggtttagtaggtcaatccaattgttggagaggtcgcgtagattgtccagttgtgcttcaattgtttggacttctctgttgacgcgtgtgcattgagcctccaatttgactgcgttttcccagtttgagaggtcggcgtctggatgtagtgaaagtgccgtggttgttctggcattatccagcgccttgagtgtgaatgtgatgcccttctggattaggcttgccattgtgagttgtttgccgtgggctttgcgctgttaagttgttctggtgctgccttttcatttgcggttccactgccttttgttgaccactgcttttttgttcga

SEQ ID NO: 40899 - DNA, 972 bp, Heterodera glycines
  misc_feature (57)..(57): n is a, c, g, or t
  misc_feature (68)..(68): n is a, c, g, or t
  misc_feature (152)..(152): n is a, c, g, or t
ttgttttttgcataataatcataaaatattttttcagaaactgctctgaaaacgcanccaattgttanttgcgagttattttaggcactcagatgctttcagtatcaaaaaggggagatgaataaaaaatctaaaaatttttaattgctttntaaatatgcgaaaaattttaggcttaactttttttttataaactgatcagaagcgaaccagattttgcgagggcatcaaaaagacaagggaaggcccaccacgaggccgcgaagcggccgagtgagtaccttcgatttaggaaaattattaaggaagaaagcttcattatttatatgtttttagcaaaattaattcataaatatttttttcacaaactgctctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcattgttgtttttaaaatttttcgaaattctgactttttcatta

SEQ ID NO: 40900 - DNA, 987 bp, Heterodera glycines
  misc_feature (917)..(917): n is a, c, g, or t
tccaaaaaaatggctatttcttttttgggcaattgggtaattggaatttctttggaaacaatgcccagggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaaatggctatctctttttttggcaatctggtaatagaaatctctttggaaacaatgacagtggctgtcatcagttgttatgctctaaaaatgattttcgggccgtttgagtatatgtgaggtatggaaggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagtttgtatgctctnaaaatgattttcgggccgtttgagtatatgtgaggtatgaacggtccaaaaaaatggctatctctttttt

SEQ ID NO: 40901 - DNA, 482 bp, Heterodera glycines
cttgtgcatgacatattttcattttccccgatttttttgtattttttgtgactctttctgcgagtttttatgacttttttaagcgacttcgtgaataagtttttattgactgatattcccagccctttcttgttcttttgtccatcactcattcattgtacacactaaagacagtccgttttcactgatggttttgtccccttccccttcttcgtctgactgcctacggtagtagacagtgagactacaattagaccccatcctactcacttactcctgatccattgcttctcctaattgctcaccctatgcgaacgaatccactaacaaaccgaaataacccttcgttgcagtcttcatcgttcttctgttgctgaaatggcacgggctccccacttcttttgcatcactgctttaaacaatcgacaaatccatattccgtacctttaaacaatgtcggaactttttcttgctttcaaatc

SEQ ID NO: 40902 - DNA, 786 bp, Heterodera glycines
caaacgaaaaccaaccaaagcgtagaacatacacaagattttgccgcccattgtcacccaacagctgtgcccgtatccgaaggtggtaattacggtggtggagaagtaaaatgcctttaatggcaatgtataagagccgcaaccaaaacaaaagaaagaaatttctaaaaatcttgaaaagggaatcagactttcataattgtctctctttctctctaacttccgctttgccctctctctctctcccctcctccccctcttctttgtctcctctctctctctctctctctaatcccctctccaattaccccactgaatttccactgatggcccgccttgtgggggatggcacggacgatgattgactcgagcagagcgtagtccgtctccgtgatgttgtacttggccactaatcggctcttcactgcctccacttgttgcctctgacaattccttccaataattactttttcccctccaaaatttccctctctttcgtccaatgctttcctttgtctgattacttttctctgtcacttcccccattaattattgctcacttgtcgaagttcggcctccgattcgagcgcatcgaaaacggcggagccgaccatcagataagtgagtgtgcagacaatcagcgaaagtgtccgcacattttggcgtttcatccgttaattttggcgaattcagttaaaattttggttcttccgagtgactactaatttggcgatggacagcgaaatgaatccgccaaagtccgccgcgggggggggggggggggtg

SEQ ID NO: 40903 - DNA, 1020 bp, Heterodera glycines
  misc_feature (876)..(876): n is a, c, g, or t
  misc_feature (952)..(952): n is a, c, g, or t
  misc_feature (962)..(962): n is a, c, g, or t
  misc_feature (974)..(974): n is a, c, g, or t
ccccataattgtttcatttaaataatttttatccaaaaaatttttttttgcgttttcggggcagtccccctgaaccgatgcgcccagatttatggggagaccgaatccttcgggaatagcttccctatagcctgtactttaattctgcgttggatttttgctccccataattgtttgagtaccccaaacagacacttgaaaaaatcgatttttttgttttcggggcagtccccccgaaccgacgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacgaacacttgaaaaaatcgattttttttgttttcggggcagtccccccgaaccgatgcgcccagatttatggggagaccgaatccttcgggagtagctttcctatagcctgtactttaattctgcgttggatttttgctccccataattgtttgagtaccccaaacggacacttgaaaaaatcgattttttttgtnttcggggcagtccccccgaaccgatgcgcccagatttatggggagaccgaatccttcgggaatagcttccctatangctgtacttntatttctgcgtnggatttttgctccccataattgtttgagtaccccaacggacacttg

SEQ ID NO: 40904 - DNA, 1006 bp, Heterodera glycines
gagtaaacagcactccccccgatccgggtacagaccccgaaaggctgccctcaagaccgagctcacgcaagctactccgagcatctcagcgccactccgcctgcaaatgccccattcgccactgaacagaaggacagcaaacccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagact

SEQ ID NO: 40905 - DNA, 731 bp, Heterodera glycines
  misc_feature (641)..(641): n is a, c, g, or t
  misc_feature (701)..(701): n is a, c, g, or t
tatgaaaatgttactcaatttatatggattttggggtctttttaacagttgaaattgcccagattttcaaaaaaaaaaccaagttctttcttggaaatttttaattaaacacatttggccaaaaataatttttaaattttcaggtttggggtagtttcactggtgaaatttaagcccgttttagcccggtcaaattgacttgcccgtgatggaaatccatttttttcctgaactgtggtggtcctgaaatacacgaaagacatgttttagcttggttgaagattctaggatggatttcttctatatccatatttttccatatttcgcgatttatgtccatatttccatatttgtccatattttggcatttttccaaaaacctctattagaattgccccaacagataaattggcttttttgacccaaaaaaccgggaaattttccaaaaaaatcatttgtaacaaaattttctcgaggatattaaataaatttaaattttcttaaaaattgataatttattcccgtgcgggattgcgggattttggaaatttagaaaaaaattaaatccggctcagtgtacatatttattatgttcatagttgtcaatatttcgcactttttacatattttcattttgttanaattgagatttttgagaactaattttaggacatttggtgcgtgtataaatatttattccnatattttattagatattttgtgacttttct

SEQ ID NO: 40906 - DNA, 750 bp, Heterodera glycines
ttctatgggaaaaaaacagagaggctcataagaactttagtacttcatcgctcacgaattgtcgcgcatgaaaatttgaaaatttaatcatcgcctcaggaatttgaacccgtatttaaaagataggaaaatgaggagaccaaccaactgagccattagaattaagaaaaacatcaggaaaaactcacgtccatctaacaaaggtttaatgttgacaaaggcaaaggaataggcactgcgcaaaaagcattggacgccataaatttggatgtgaccaaattggaaagtgtcagagtctgaaatggaaaggaatttgttgattggattgaattaaaatgaattcttcgataattaaaatggaatcggtaaaagaaattcattttgtagccaatgggctcttagtaaaaaagaccatccgaccattcccaagtcaccttttggctcatcccactcattaaagtgcagcgaatagaggtcggagcgccggtgagaaaaaacaggcatattcgtacgcacttcctccacataatccaagtccaactccgcgaaacaaaggtctgattttgaaggcattttaaagcagagtttcatgtattcatgaattattctgattgaaccgggtgaaattgagtttgggtaagcatcgagttttcacccagtcaatggcttctggacgttcgagattgaaacccaaatacttgaagccctgctaattgtaaatcccaaggaatcgtcttaaccccccccccc

SEQ ID NO: 40907 - DNA, 806 bp, Heterodera glycines
ttatcatggagtggtctgatcaaatggttttctagtatttccgttgatcactgatcaccggcatttttacttgaattacatttttggcggagaacggaaaaatttgctagtttttttcataattttttttttcaaaatggttcattcaggttgaggaggagcagcgtcggcgtgaggaacagcgagagaactttttgatgagtgaaaagtgagagaacaattaaaaatataattaatattttaatttataaattattcaacaaaaaaaaatcttccaaaatttaaattatttaataaaattaaaaatatttgtttcaggaaattgaacattgtgctgtccgaacgcgatgaacttgttgtgcgccgagagcaaatggaacgggataaacaacgggtggaagccgaagtgcaggaggaacgggcgcgcaagacggagctgcaaatggacaactcacagctgagcgccgcgcgacgccaagtggacaatgacctacaattgacgaaggcaaaaaatataaaaataaaatttgaataaaatatatttcaaaattgaaaaaatgacaattttaaaaggctataaaatgaaatgaataaattttttttattaattttaatttttagacgagattatgtttattaactttagcctgcaaacaaaaaaaaaagaaatttaattttaaataattatatttattaaaaaaggttttttttttattaattatattttttttttattaaattatgtttctttacaatagcctgcaattaaacaaaagaaatttaattttgaatttttgttaattaaa

SEQ ID NO: 40908 - DNA, 772 bp, Heterodera glycines
  misc_feature (7)..(8): n is a, c, g, or t
  misc_feature (26)..(26): n is a, c, g, or t
tagagtnncggaaccgggaccaaccngggaaattttaaaaattcaaatcatttttaaaaatttaaaaaaaaattcaaattttaatttatatctagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggcgcgctttttcaaaaaacttttgggaaagaaggggtcctgcggtgccgataggcgccgccgggggaaattttaaaaatttgggtgcaatttgttaacagattttcaacaaaaaaaggttggtttttgcgattattaagctcaattggtaggattttcatttaaaaaatgataaaatatgtatcaatttaaaaaaaaaactatgagtaatcatattttctctataggaaacccacgagtatacaaaaaaaaaaatttgtgtccccaaatatttcttaaaccgatacttagggctgagggggctaaagccactcccactccccccccccccccccgaaacgaaatatgaaaaaattatttcaatgaaaataggaaaatttcttaaaaagtatagcattttcttaagaaaatgatcagaaatctcaaaatttccgccggcaccgccggacccaaagtttcttagattttcaaaatttgacataaaaaccgcatttttggaagttaaaaatcaacccc

SEQ ID NO: 40909 - DNA, 938 bp, Heterodera glycines
  misc_feature (815)..(815): n is a, c, g, or t
  misc_feature (821)..(821): n is a, c, g, or t
  misc_feature (910)..(910): n is a, c, g, or t
  misc_feature (920)..(920): n is a, c, g, or t
attttcaaaatcaaactcgcccagaaagaaattccggaccattagggttggcgctatcattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcaaaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctattattccgntaatgnggttggaattgtctagagtgttgagcagaaaaagagataggcgtttttcccaaaattttcacaatcaactcgcccagaaagaaattccngaaaaattanggttggcgctattattcc

SEQ ID NO: 40910 - DNA, 1327 bp, Heterodera glycines
gatctccaacaggaaaaaattttgtttacttttctttattttaaaaaaaaacatgacaagccaaatacaatacaatgatttctaaaatataataattaaccagtttttaaaacataaataattttataagaaaatttatccatttttttcaaaaaatatttttctgttttttgttcctcaaaaatttcttctccaaatacatttcttaatcatggccaactccaattttcttcgaaatttcggcataattttggtgccattcttttcgtgttgcgcctgcaaaggtatcggacggggacccaaacaaatgacaggcatttggtgcttgaggaaatatttggaggaaaatgggaagaaaaaaggcaaataatttaaaaattctataaaataaaagagaaaataaagcaaaaaggaaggaaaacacacagcaaaagaatggaataaaattgaagaaaaaatagcaaaaaaattggggacaaatcggaattacattcaaaaatggattaaacaatttgatctacaaaaattcaaattaaaattggagtaagccatggaacaattaaaaaatggaagaaacaatttggcattcgatatatgagaataacggagaaagaaaaaatgaaaaaatgaaaatttattggcaaataaaaagagaaaatccgaaaatgagtgacaaagaaattgcaaaaattatgaaaattgatcaatcgagcgttttaaaatggagacgaaataaaaatgaaaatagttgtaaaatttaaaaattatggccttttgttgtctaccttattttatttttattttgaccacatcaatttttgtattcaccgtattcttttcattctcataatttttgtattccattcaaataaaggagtaaaaaaggttagccgacatttgcggaccgactttaccaaagcatggaagtgaaacacgtaaaaattttccttggtataaaatcctgaactgacttttatgtgtattaaaatagcgaattttttcgctaatttcactacgtgtagagaagcaagaaaaaaatttccacttgttttgggacttctaagataaaataaaattctccaattgaaacagatcgccttgcatcagcttaccttcactaatttcaattttgggagtatttaatttattgaaaatttaaaaaaaattttttttctttattttgacagttcaatcgggaaatactggtccgcaaatgtcgcactacggtaaaaaatgcttgtaaaatgatcatgtaattgctttattgctattatggccataaaacacggaaatcacgatttttaaatttaatgattataacaacttg

SEQ ID NO: 40911 - DNA, 1018 bp, Heterodera glycines
  misc_feature (49)..(49): n is a, c, g, or t
  misc_feature (60)..(60): n is a, c, g, or t
  misc_feature (68)..(68): n is a, c, g, or t
ctagcaaaaaatggttaagtaaaatcgtaatacgctcaaaaagctttcnaaacaatttangcgctccnaattccttctacaatcgcctttatacatcccattgtgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatgagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtcatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaacgcatgtcatctaagcctagcaaaaaatggtgtaagtaaaaatcgtaattacgctcaaaaagcttttcaaacaattttagcgcttccaattccttctacaatcgcctttatacatcccattatgagcgctaaaattatcagagtgccgaaaacgcatgtcatctaagcctagcaaaaaatggtgtaagtaaaaatcgtaattacgctcaaaaagatcctcaaacaattttagcgcatccaattccttctacaatcgcctttatacatcccattatg

SEQ ID NO: 40912 - DNA, 902 bp, Heterodera glycines
  misc_feature (858)..(858): n is a, c, g, or t
cacaaatcatctttgcacttaagtacgaaaaatttcctacacaggacgctgggcacacgacgatttgatgtagaaaccttaagggattttttttaaattataactaattttactattcacccagtttttttggtaacaagttagaagcaattcattgaacatatttatcataatatttaaaattgataaaatattaactttcgttttatcatcttacttttgttttcctctctcatcagcaatctgttgaattagcaatgcaaatttttcaaattcggcctcagaaatgtcatcgttccggtctgtttccaacgccaactttgtgtgggataagatcacgtctggccaagccgaatccttaataattatcacatattaagaaaaacaaaatttttttaaaatattaattaaaaggagaaaattataatttttaattttggtgacggatttaactgacaacaaggcatgaacataccaaatcagcctcaacccaggctgacattgcaagcgccgtatttttagtcagtcgatcatactcccttatctgaagacgatgaaatttgtaatcatcctgctctgtcgacacgattccttcacacatcacaccaagtatttgctaaaaatagtgaatgagtatagttagttcaagtaatttatattatttttgttgttaattacaaattttttggtgtttaatcttacataccactctcaccgcatcattaattataatgttaacgtgatcaagaagcggggctctgcgtttctcatatttggttgacacaatgtttaaaaaacacatgaaataaaaaacattatttatcacaaaaactgaaatcgccgtgatataaaccaccngcaaaatttcaaaaacgaaagtttgaagcttggtttttagtcta

SEQ ID NO: 40913 - DNA, 1496 bp, Heterodera glycines
atgaaatgtcaaaaactcaatcaaacaatggctaaatcacaaaaattttatgattttttaaatttacgcaagtaaagtttttggatcttcgaatttttaatttaaattatctgataaatgaaaaaatattgaaaaaattttgccaaattttccaagaaaattaaaaaattttctagttttttgggaatacctttgcaaatttctaaaaagtcgaccattagaggtgtttttcgatgttattgtattttcttatcaaatttaatcaaaatattttcaaaaaaataaaaatggcaaaatataaattttattctcgaaaatcccaaaatgtgtttttatatgcactaaaaagcttcatcaaataaaaaaatttaaacgcagaaatgttgtttttgagcccctttcttcatagcataagcgcaaaatatgttcaacgtataagcctaactcataccgtaccgatccgattctgttcaaaattgaggttggcgttatgaaaatgcccgacccgacgacacttccaatgaaatacgaagtggcaccccaacgaccaagtttattcttttcagaagatggcatttgaaaagaactcaaaaagaaacataaaataaataaaagagaattaaatttaatttattgccaaaaaaaatcaatcggtccaaaatttgctaatcaaagcgaaaagtgttgggaggaaacgaatgtattggacggacggaggacggaatgtgtgctgtctgtgttatcaccgttttttcagccactttttcaatttgcatttgttacgattaattgttggccttttcctgtattaattacggaacaatcaaaaaagcatttgtttgcattgtccaatcaaaaagtgatgagccgattatcgcaagacgtcgcccaatttacaccgtttcactttgttttaaattgacaaagtgtcaacttcgagaaagtctcgaattatttttagtccacttacaaattgaattcacttatatttcgaccaataattacagaaaattatttaaaaaatgatcaacaaatttgaagaaaaaataaaaatattttaaattaaaaattaaaatcaaatgaattgctcatctgttaacagagttcttttcttctttttctttctcaattaaaaccaaatgagatgggttttgagtttacattgcttttctccgatttgtttctaatttttgtgccgggcaaaaagcggaaaaattccattttgccattgatcactttctcacacaatttgggcatcgtctcatgtcatttttggcagtgccgcatcctttgagcaacaaaaagctgctttcaccgaatcaaaaaataggtcattaaattatttaaaatgggtgcttttttacgcttttgtgggcttttcggcaaacattttgcgctcaaacaccaaacactgtgcgcggaacatcgcaagcgttttggggccaattgaaaagtgaaagagaattattttttcattttggatggatgacctccga

SEQ ID NO: 40914 - DNA, 934 bp, Heterodera glycines
cgtggcgcagttgctccgcttttgccgactcgaagttcagtatcggcggcgtctcctgcgacacgtcgtttggcacgtagaagtgcctgtgtgccgttccaccgcctatcagcaacagtgcggcgatgccggtgctggcggcggcaacaactgagttccgctgtagttcttggttgcgtacccactgtgcgttggcgtttccatccaaggagggcttgcctgcgatgcaccacttgatcagcgtgttgtaaaagtacgtcttgcctaaataattgtttttttatttgataaggctaaataagtcattattaccgcatccacccgcgccttcgaggaagaacagcttctggtcgcacccgccaagaattgatgctgagatctcatcaaaggcggtccgttggtctgggttgaggcgtccaatctgctcaccggcaacttgctgcggcggcttgcggggttcccctgcatcctccccataaaagctggcccagataaaaaattcctccaggatctgcgcctgatgtcatatatggtagcccgctgtcagtccttgcagcccaacatctttaaaacataacgattatatggacaatattatgccagctttacacaattggtgttcgtccccatgcagttaatgtaatactcaaggttgagcatcacctcagccgctcggactacagctgacttcggcacagctactgggtggttggcggcaaccggcgggttcatctcgttgagcaactcgtcgaacagcgcctgagggttggacgtatgggggagcgcaagcagcatggcgaattagtactgcaggcgcttgaggttgggcatttcggcgcaggcttctttcaaaaggcggcgaaagtcttcgtcgctctcttgaaggccccttaaatgggcacgtacctacgcaatgtgtcgaaatgcaatgcca

SEQ ID NO: 40915 - DNA, 953 bp, Heterodera glycines
cgctaaaattatcagagtgccgaaaatcgcatgtgatctttacctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcatccaattccttctacaatcgccgttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcgtgtgatctacgcctagaaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttaacgcttccaattctttctacatcgcctttatacatcccattatgagcgctaaaattatcagagtgccgaaaatcgcatgtgatc

SEQ ID NO: 40916 - DNA, 515 bp, Heterodera glycines
ggattcaaagttcaatttttttaagctctgatagccttaacagcattaaaattaaaaaatcacaatcttccagttttttaggaatattaattttgttgtttgaaatttttattatttttcaaatattcattgacgatcaaatgatcggatacaatcactttcaatcgcttatttaaggctgtttagggggtcagggattgaaaaaacttaattttaaacccgatcttggacaaagccgcaaatgtcgtgacacggtactccacacctctctcgtcaatttgctatggaaattacatttttgagatttttttctttgaaaaattatgagctttttgaaatttaaatttcttagattttcgggttgagggacggacgatttgcaccgtaaaatatgctaattcaatttaaaattagttgaaaaatgtaaacaaacaagatgactaattgggctaaccttgctcgcaaattgagagattaaagttcacgatggactgaagtccgacggagcgcaaaag

SEQ ID NO: 40917 - DNA, 1229 bp, Heterodera glycines
  misc_feature (98)..(98): n is a, c, g, or t
ttatatatatatagaataaagtgggttttcgtagaaaaaattataaagtgcccgtggtttgcccggagggggctgaaagtgcggcattgcttaagcanctttttgaggcgcatctggaaaaaataaggatttttcggtccggcggccagttgagcgccagcggcgctgaaacggcccgaaaaatttttttgtccgtctttggtggcctgtaactttgcgggaagaagagggagcgaaaaatgcttggtgggaggattttaagttggaatgtttgggaaaacttggcgcttatttggcggggctatctacaaaagcctggcctgcagaaattggcgactttttaaatccatttttggcatttttcgaatttcgcgaataactcgctgggggttaagcggagcggattggcgccgcttgagcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgtttgaggcttataactcgtcaggcgttgatcttagcgaaaatttgtcttagagcatttttgtagagaattttaagctctatctaatgtgctttatctcatgtttttaccatgagtttaaaaaaagttataaaattaattgtgattttgaaactcaaaaccataggggggacccaatggttttgcatttcatgaaaaatttttttgctcctaaattagccaaaatgcatttttatggcataatttgaggtgctgaatacgtatatacgctttattttgtgtttcagactttttggaaagtggttaaaattttttgaaaaatcgtcaaaatttgagccctggaaaatcctgtgaaatttcgaaaattcataaatctcttcgtttttggtcaaatttagtggaataaagctttaaaaatagagaaaaattgggagaattttatgagatttatttggaatttctatcttccaaaataaaaaagttattccagaatttctggaaaaattcgatttttcaaaaagaaaatcagaactcccttctgaaaaagtattttataaaa

SEQ ID NO: 40918 - DNA, 804 bp, Heterodera glycines
ggcttagatcacaggcgattttcggcactttgataattttagcgctcataatgggatgtataaaggcgatggtagaaggaattggaacccttaaaattgttggagaagctttttgagcgtaattccgatttttcctccccccatttttttctaggcgtagatcccatgcgattttcgcccttttgataattttagcgttcataatgggatgtataaaggcgattgtagaaggaattggaagcgctaaaattgtttgagaagctttttgagcgtaattacgatttttacttacaccattttttgctaggcttagatcccatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttaagagcgtaattacgatttttacttagaccatcttttccacagtagagatcgacatgcgattttcggcactctgataattt

SEQ ID NO: 40919 - DNA, 778 bp, Heterodera glycines
  misc_feature (758)..(758): n is a, c, g, or t
gtgtcaaagggtgcgcatataagcgactcgctgtgcgtgtccactgcaaatgtaataggtggtaatttatttctgcgccctataacacagaaaatctctatatctctttttttggaatattttacgtgtctcagggtgtgcacataagcgtctctctgtgcttgcccactgcacatcaaataggcggtaatttttatttctccgccctaatccagaaaaaatcactatctctttttttggaatattttacgtgtcaaagggtgtgcatttaagcgcctctctgtgcttgcccactgcatttcaaatatctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctcttaaatggaatattttacgtgtcaaangggtgtgcatttaagcgact

SEQ ID NO: 40920 - DNA, 905 bp, Heterodera glycines
gtctatcgaccaagcacatgaaccaaatgtctgaaccctctcttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaaagtttcctttggcttaacattcagagcactggggcagaaatca

SEQ ID NO: 40921 - DNA, 963 bp, Heterodera glycines
cccatttttggttatggatttgatttaatacacattaataaatgataaaattacacggggcaagcagacgcagctgctgcatgtttgccactctcccgtagcgttcaaccatacggatgcacgtattaaggatcaagttttcctgttaaagcaaaaaaagaacattttaaaaacattttaagtttgtgattttaattataattagcttttgagtggtgtggagggaagggggaaatgggatagattaagatcaactaagatcccaaaaaaaagcaatacttttcaaggcaaaaaaatgaaaaacttttgttaaaaggatatatgcctgccacctaaaggtccaaaaaattgcgaaaaatcgacttatagtgggaggaggaggtggtggcaccctcagctgaccaaattttgactttgacacgacccggagtggtgtagttaacctcatcccaaaattaatgcacaaaaattttgaaatgagtaaattctaaacatacgtatgccggatcgtcctcattggatcacgcacgttttttgcagcaccactgatcacccacgttttgtccggcaccactgaccagtcgcacgttttttcaggcaccactgatcaggcacgttttgtccggcacggttcactcgcacgtttttccggcacaactgatcacgcacgtttcaaatcaaaaggcaatctaaaagggtttaaaaatattaaattcaaaaaacaataaatgtttagcattataaaaagctgcttggccggaggaggagggggggggggcagtaacaggagttgaagaataatgaacacaacgattgtccaagttgcttaaatggggctgggcctgtgattagcattaacggtacctcccccaccttcccccccccccccatagaacattgaattcaactggatatgaaatgataatttggtcaaaagattataaataaataagatatttaaat

SEQ ID NO: 40922 - DNA, 952 bp, Heterodera glycines
taatcctgtattttattggtcccataaaaaaaagattaaaaagttgtttttatgcatttcgtagtactcgagggttttcgggggcgctgatcacgaatatgacgtcagttttgacctatttcgaatcccgaacccgaattctaacacaaattaatttttcaccaaaattcatatgtattgtccaaaatcgattcaaattcactaaatggccttgaatctacaagaaaaaatattatttacaaacaaaagtcatttttttgatactttactgatttataagtaacgcaaaaagatttctctcagccaattttgtgtttttttaaggaatttttccttaatatgtacccccgtgtacccaccccctcaatcactccttcctccccattggctaccgaatccacaggaggagtcctatttcacaaatccgctcataaattttgtatttgattttccacctcactgcccccgtcctccgagtcttggtcttggtcaaagtcttccccctgctgttgtccacggaaattcacgcgtcgttgcaaaattgaacggcccacatgcttaattttaaaaatataaaaatgcagatggatttcaaagctacacatatatatatttgattttttaatgttcgtattttaagtgtaagaaatttgttgtcccttttctcaccgttcttcgctggccaccgccaaagtgcgaagagtgagtgttcgccaataaaaaggggtcctcattttctttctcacggcgtttggtgggcggtttgaacaaattctttagatttttgatcatttttttagtgttaattcgagtaaaagacttaaaaaacatgcaaattaatcttttttgcaatactataattagaacttttgaaatgaatttgttaattggtgcttcgaaccaaaaaaatgacagtggggccaacctatttgattaagttttgaaataattt

SEQ ID NO: 40923 - DNA, 1134 bp, Heterodera glycines
ctgtttgatcatttcctaaatcaaagacaggataagccaattagtcccccgtaaaacttcgccctcccctaattgccaatttcctttcgcccgtacatttcgctgttcgtccggtgccttcgcaatttgctgaattcgaaattggacttgtgcaaagtgagtgctcagttgcttaattgaggggccattcattctttgccgttctttgcctttgccctcctcccaaaatgactgaccatcaccgattcgctcagtctctgctgttgctgctccaactctttgattctgccggtcgattcgctgctaatttcaaattggaactactaaaaaagatgccattgaacgaaaaacctttgccgaaatgcgccattggcacagttttcctcctcctcaagcgaagagcacgcccatcggtcgatgtcagcacagaccgagtcatcatcagcttaacaaacaattgggggaaagtgattctaatcactaaccatcagaggaatgggcaaacagaggaaaggcgggacaattatcattagcagcaggggactgaattatcgtaatgggcggcgaatggagcaaaagggagggcgaatcagcgcgagaaacaccgccaattgggcgggggaggggcgtcgggtcggaggcaattagcgaagaaatgggcgggacaaaacccccaaagggatcactcttttcttcatccattccaaagcagaacagaagcaacgatcggcggatgaatatgatcaaaaagggaagaaaaaagagggaaaatgtttaaaaatggagagaaatgaaaagggagaaaagtcattcggagaaggaaagagaaagagagagagaaagagaagggatatagaggggagcgagagatgagagaaatgccggcggggatgaattgagagtgcgtgccgttgtatgttcttatccgtttggatgccgtcctcattctttctatgctttctcggtttctctttctcacttctccttccatcaatatttaatggacatcacctcagggcacagaaaaggggagagtgccaatgccaacaaatgtagtaaagagaaaagaatgacgaggacggaatagagaaggaaacagaaagtgaatggaaaggaaaagccgagagagaaaag

SEQ ID NO: 40924 - DNA, 1123 bp, Heterodera glycines
  misc_feature (1014)..(1015): n is a, c, g, or t
tttttggtagcttaaattttttttatatcatttttgcgatattgtagtattgtaaaatgtaaaaattatttatccagaatgtatgtggaattttttaatcctaaaagttcaaaacaaaaaaaatgcgcctattttttaagtttcttcaattactgtatttttaatgtaatttttttttctaaggattaacctgtagtttttattgtaacttttcaagggttttaaagtttatttcggtaagcacaaaacattaaaaaaaatcgccgggaaaatttcagaaaacccctctttttttagtatagatttttggcactatattttccggcaaatgttttaccctgctcggttttcttttcaaaaaatcaaaattagatttaatttaattgcacttgcccggatgtcaaaaagtcgccacgtttgtccaaaatcaggaacatgtccttcttggtcttcccgtcctgtcccgtgtacaaataactgttacaaaattaaaacaataaaatttaaaatataattccaattttactgttcgaggggcacgggccgcttcagcgtttggatgacaaaaatttttcgattttttatgcgcctaaacttttttttggctttttaaaattcagtttttgccaattttgctcacccaacccaatccgcaaattccatacagttgggcaccgtggcggacaacatcacaattttgacatgggccggcaacatgatcagcacctcctcccagacatggcctcgctggaaattgtttttcaaattttaatgaatttttctcgtaaaaaaagcgatttttttaataaaaaaaaaagcacaccaacctcggcatcgttgatgtagtggacctgaaaacagaaacaataaaatggaaattaaagcatccaaaatttttaaatccgaaaaatttcggctaatttataaaatttattatcccaaaagttgcaacaaaaaaaaacaaccaaaaattgtgtttgtgccattacctcgtcaaaaatgcaccactccaannttccgatgacttccgacccgttgtaaagcattgagcgcaaaaatttcgtggtcatcaccaaacagaaggcgtccgagtgcaattggatgtctaatgaggggggggggg

SEQ ID NO: 40925 - DNA, 267 bp, Heterodera glycines
cctcccatttccccccctcccctctttccctcccatttctctccctctttccctcccatttctctccctctttccctcccatttcttcccatttctctccctctttccctcccatttccccccccccctcccctctttcactcccatttctctccctcttcctcccatttctccccctcccctctttccctcccatttctctccctctttccctcccatttcttcccatttcgctccctctttccctcccatttcccaccccctccg

SEQ ID NO: 40926 - DNA, 969 bp, Heterodera glycines
  misc_feature (112)..(112): n is a, c, g, or t
ttgacgtcaatgattattgatttaaagctacaatgaaaaaataaagcaatgatgcattttatataataaattaataaaaaaaaatattttcaaaaaattatttaaaaaaatntaaagcattataattaggaatgatatttttaggtttattttttcctgaattccctatggcctgaagtacacggaaaaaatttttttcttttcgagttattaagcctattttcttgattttatttttagagcctaaaagtctaaaaaaaattggaaaacttattttcaattattttggcgttttgcccaaaatatattaacaaaaatacaaaaaaaaaaaaaatacacccctaagaatcgaccctaaaattttcaaaatatagccctatgaactgaaaaaattttcgcaaaaattatgttcaaaatttatttcttgacaagaatttttgattttaaaaattatttatttcattactgattttgctaaattttattatttttttgaataaattttgtcattatacaccccccccccctaaattttagactttttagtgccaattttgaggggtttttagaagcgaaagcctacctattttggcagttttattcatttaataatgaatagtaataatttttaattttcattatctgtttttatacagaaattttcacacgagaacaatggaaatagcgtttatataaatgagagcgaaaaagaaaaaaagacaacataaaatagacagttggccaaatgaagagcatgacagagaattagaagaaataccacctgtggcataggtcatacaattgttggcatatgcagtatgaagtttatagaaaagagagtggaaaagaaataaagacaatataaaatagacagttggccaaatgaagagtatgacagagaaaatgggcgaaatacgacgtatggcataggtcatacaattgttggcatatacagcatgaaagaagata

SEQ ID NO: 40927 - DNA, 1314 bp, Heterodera glycines
tccctcgttaccggcgtgttcgtagtggccaaacggcacatcgcatgttcggcgtgcacgcccgtcttctcgcattgttcgcacaggtcaaagtccggacagaccatgcatttgtaacgaatgccgaccacacccccgtcgcaaagatcgcacataatgtgcggatgcaacgacttgtccccattgccattagtgacgtcacgcattttgccgattttgttgatgtaagggcaacccgttttgacaactccggtcttaacagttccttcgcctcctgtaatcgtataaatagaaacaaattgtataaatttctaatatttttgcgacttttaaagaccaatttgtaatatgaaataacaaaaaaaaagaaacaaacccatcgtttcgagtgtcactgtgtctttgttcattttcttctgaaagtggtcgagcatcacacgcatttcggcatccgttgtgaaaacaattgcatctccatcggcgtcttgaaaatgaaaaagcattagcaagaggagagattctgtgggattcactaaaagtgggccaaactcttgaatttcaaaaaaacttttagttctcttttgaaacttcaaatgtacaattaaacatttggtgatttactaaacagaaacactgccaaatgtcttaataacgtgattatgactattacccagttttgcaaaatgaaaaaacctcgataaaaaagttggccactgaagttgggctcaatggtgcgaatttcagcctgaagtgcgctgtaagtccactcggagcattgaaaacgtcgccagtttccgtggaagaaccatttgaccgcaaccgacacgttctgtttggtgccgtgttcagtggcggaggcgtcctccgccagttcgatgtcattgtgctggtggtcagccatcagcagggaaaagttggtgtttggtttggaatttattttgtattgaataactgaaacaagaaaattgtacaacaatttgaccaagagaacaaagaaatattatacgggtgactaatttgagaaagaagcgatatttaggcaaagaaagggaatgggcaatgaaatgggcgaaatgaacgagcgtttgtggactttggtcagcgaatgagcggcggagcaaagcaagaaagagacgaccaaccacacccatcgattatctcccgagaccaaaggtcggcaaacaattcgctatcaattaggcataacaaataacacatgcacacttatcgggacaagcctttcattttaacagtttaattaactgttgcgtccgttcaacagtcaaggaataaatattgatttattcacacaaa

SEQ ID NO: 40928 - DNA, 1007 bp, Heterodera glycines
  misc_feature (948)..(948): n is a, c, g, or t
  misc_feature (950)..(951): n is a, c, g, or t
  misc_feature (979)..(979): n is a, c, g, or t
cgaaaaataatacttgctggtgtggtaagtgtgaagaactgtgtacctccaggcaaaaaattctatgaaaatttatatgcatttgtagtgttctcagcagtttccctgcaaaatttggtgagctttcgatcagtctagaacgttgggtgataaaatgaaaaaaataattttcaaaaaataatacttgtgtggtaagtgtgaagaactgtgtacctccaggcaaaaaatttatgaaaatttatatgcatttgtagggttttcagcagttcgcctgcaaaatttggttagcttccgatcagtctagaatgttgggtgataaaatgaaaaaaataatttaaaaaaaataatgctggactggtaagtgtgaagaactgtgttcatccaggcaaaaaattctaataaatttataagcatttatagggttttcagcagttcccctgcaaaattgggttagctttcgatcagtctagaacgttgggtgatcaaatgaaaaaaataatttaaaaaaaataatacttgtgtggtaagtgtgaagaactgtgtacctccaggcaaaaaattctatgaaaatttatatgcatttgtagtgttctcagcagtttccctgcaaaatttggtgagctttcgatcagtctagaacgttgggtgataaaatgaaaaaaataatttaaaaaaaataatacttgtgtggtaagtgtgaagaactgtgttcctccaggcaaaaaatttatgaaaatttatatgcatttgtagtgttctcagcagtttccctgcaaaattgggtgagctttcgatcagtctagaacgttgggtgataaaatgaaaaaaataatttaaaaaaaataatgctggtgtggtaagtgtgaagaactgtgttcctccaggcaaaaaattctgagaaaatttataaagcattgtagggttctcagcagttcccctgcaaaattngnngtagctttcgatcagtctagaaatgtgngtgataaaatgaaaaaataatttaaaaa

SEQ ID NO: 40929 - DNA, 1635 bp, Heterodera glycines
  misc_feature (1533)..(1533): n is a, c, g, or t
  misc_feature (1615)..(1615): n is a, c, g, or t
gagactggggagtgaaaaagccgccggaatttttcaggagtcgagaactaaccgagaatcactaatttgcacacgacgccgatacaaattcagctgtaaaaattcgtgtctggtcaatttgtcaccccctttttctagcaaaatatagcggatccaggagattatgtcaatgggatttaaaaattataataaacaaatgaatgtaaaaatttattaaaaatggaaaaaaatgtttaaaataaatttattggtttacaaaatattattatgtgctcacggaagggtccactaattttttaattttatgctaatgctacaaacgcacaaaattatgatgctattgcaagattattatatatatttaaaattatattaaatcaaatacatatataaatttttttgataatttcaattgcgaaagggattattatatataattaattgaaaattctttaaatgggcgatcgaaaaattccggtagacattccgtacattaaggcaccgtaaccaatgagctgctgtttgctgcatgtggtctaagaacctgcaaaaaaataataaattcataacattactccatggctgggaccaaattcgagattctttaggtggtccgagacaaatgacactttattaatttttttataatctaagtgcttatgtttaaataaatttgttttttcaattgttctctctattgactcagcattcattaaaatgatttataattccaggaatctgaaacttttgacttataatatttgtttttttaattttaattcgaaattcattatatattcaatcagtattatacatgaaataccaaagaataaataaggtattttaaaaattgaaaatctaaaataatttgttaaagcttgggaattcggaaatttcatattcccgttcttccttctggaatagtcttttttcggcaataaaatcctatctttaatgcataaaattaacttctttaattgtttttttttgatatcgaatatagcactgagaaatttatgaaaatttttgttgaaaaatgtcaaaattgtatggattttcaataaatgtgccattgtcaattccgcaccgcttggacgttccagtggggttgggaaattttaaaaaaagtttaaaaaaatgttaaattttttttcttgtaaacttataaatttttctaatttttgcgaatatccacaaaattaccattttggtgaaaatctatcaaaaattaatcaataaaaaaaaatattcgcggcaaacgcttgcaaaaaaaggtagaacagtcacaattaagatttgcggttcaaaaatgatgcgaaacgcgctgctatacgcgtatacaaaaaacctcgcccgcgattggcggtttgctttgaagttagtcaaaaaccatcatttgactaacgtcccaacactttcgcttcacaacacttcgcccccgcccggcagcacatacgtaaagtgccgtttctttgatcactttgaaaggcaacagaacgtcctgttcgttggcgtcctctttgttcacacaanaacggatggtcgtacgattttccggtgcagcggcgatcacgtgaatgtgactactgagtctcaatctttcaacaagttttcngtcacctcttccgaaccatc

SEQ ID NO: 40930 - DNA, 1027 bp, Heterodera glycines
cgggagcccttttttagtttttaccgcattttttggaaaaatctcaaatttaaagaaaattaaatattgaaactttgaagtttttttaaaaatattatttcattagcaatcaaaaaagattttatttaaagtaacaattgaagaaaacaataaacaaaaatttgaattagaatcgccacaatctctcttctgtccttctccatctctaatttctctccacttttcctgtgctctctctctctcttcctctctctgtcattgctccatttcttccccatcattttcctctgtttgtctcttctgctgtccatctctgtgccaatctccgcctttcctgcgctctctcttcgcttctcgtctctgccgtctcttttccacccgtcctccgccggcaccgcctttccatgccgccgctttctttttgtttgcccctttccatggccgtgttcgtccaacattttcaatttgctgctgatttccaccatcatcatcaccatcttcacccatttgctttgtcgatgttctcaacagatgagcacttgggcttaaaaagaaattttttttttaaattttttaccatggcaaaatgcgtgccaaatttttttgcataggggagaatcaattagacaatttttcaaagtcggtcgttttccaatcactcgagaaaatttccatctaaacaagacaaactcgcaaactgtaaaccggaaactgtatttgcaatttaaaaattattttcagcgtttttcaaaattttaaagatactatatttttctggctaaaaaatttttattactagatttttttgaaaaattctattattaaattttaaaattttctcggaaggacgacagaagggggagggggggggggctgtggaaatgagatgcacccgcttttttggaagcaaaaatgcattatgttccataaattgacactcaattaaaagcattttcaactttggcgtcgaataacaaaaaaaaaaaaaattggacatcatttacaatacttcaaatgctacccaaat

SEQ ID NO: 40931 - DNA, 1521 bp, Heterodera glycines
cacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtgtagaacgttgggtgatcaaatgcaaaaaataatttaaaaaaaataatgctggtgtggtaagtgtgaagaactgtgttcctccaggcaaaaaattctaagaaaatttataagcatttgtagggttctcagcagtttccttgccaccgccgataggcgccgccggaaaaattctaaaattttgagtgtaatatattaacagaacttgtcaaaaaatgatcaaagttttggttaaatttgcggttttaggctgtttaaaaaaagagaaaaataataatttttaaattgaaatattttttattaattaaaatttcaattgaaaaataatttaaagaaattatt

SEQ ID NO: 40932 - DNA, 1447 bp, Heterodera glycines
ttttaatctgctttcttttttcgaatttttcgagaattctttcgcatcacgaataattaaaaaaacgccaatttttaaattttacctaaatttttgcacacccacagatcagtttgaacgagagcggtgttggcggtgatgacagcgttaccaagccgtactccatctgttccagcgcgtccaccacgtcggacgaagaggggacagcgaccaaatcatcggcgacgacaggcggtggtaaatcaaccgaaacggatgacccgttgacggagatcgaacttcgcgatgtgtgccgggacggcacggccaaggcacgtacggaattggcgcaaaaatttccggtctttttttcgcagtggtggacggaattgttatgtctagaaatttttaaatgcttttggggcggaggggatagtaggtaggctggtcggactgcttgtgttttttgcattttatagaaaaatacatttgtaatttcgttatcggaaaatgcctttcacaattgtaatttagttactggaaaataagttaggtattaacggaaatgcgccttttcatttgatattttacaattgtatttagttagggaaaatgcgcctttttatttgatattttacaattgtatttggttaccgaaaatgcgccttttcatttgacattttacaattgtatttagttaccgaaaatgcgcatttttaattgacttttacaattgtaatttgttatcgaaaaatgcgcctttttatttgatttttacaattgtatttagttaccgaaaatgcgcttttcatttgatattttacaattgtatttggttaccgaaaatgcgccttttcatttgacattttacaattgtatttagttaccgaaaatgcgccttttcatttgacattttacaattgtatttagtgacgtgaaaatgcgccttttcatttgacattttacaattgtatttagttaccgaaaatgcgcatttttaattgacttttacaattgtaatttgttatcgaaaaatacgcctttccatttgatattttacaattgtatttagtgacgtgaaaatgcgccttttcatttgacattttacaattgtatttagttaccgaaaatgtgcatttttaattgacttttacaattgtaatttgttatcgaaaaatacgcctttccatttgatattttacaattgtatttagtgacgtgaaaatgcgccttttcatttgacattttacaattgtatttagttaccgaaaatgcgccttttcatttgatattttacaattgtatttggttaccgaaaatgcgccttttcatttgacattttacaattgtatttagttaccgaaaatgcgccttttcatttgacattttacaattgtatttagttaccgaaaatgcgcatttttaattgacttttacaattgtatttagttaccgaaaatgcgcattt

SEQ ID NO: 40933 - DNA, 1015 bp, Heterodera glycines
  misc_feature (58)..(58): n is a, c, g, or t
aaaatgggaagaaatttaggggggggataatggatggatcagtatgaaaaaaaaagcnaatcattaaatggataattgtgggggataatcactcactgatcaggggatgatattgaccagcggaagggctaaaatgatcaaaggcattggaaaagcaaccaaaaatgcgaaaacagtttattctgactatataaagcattcaacaacaacatatagaaatcttgaaagaatctagaactgatttgaaaaaaaatcacagtagtcattgggctacgataaaatattttaaaatattacggtagagctatgggaatggcatgaggcaatttttataaatgaaaattgactattcaaaacaacaacaacaacaacaaaaaaacgatcgaatcagcaagggcatatgtttctgatgagagggacaacttttgccaaatttttttaaaattttttaaaaggggattaaattccccggaaggcattggcattgagcaaaaagcgcatttcctgatcaatcttccgctgctggaggtggtggtggtggtggtggttgcagcaacagttgccgaaagcgcaactgcacgcccgtcatcatctccagcaacagccacaaccagccgaacagtccgccaaacttttggccgtcgccgtcgttctcccgtgccgtatgaccatcatccgcgacattagcattggtgccattcagctggtgccgataatatatgttttttttttatacaataggttggtgcggctagaaattgaaaattttgccagaaaaaagaaaaatcaaaccaaaatttcaaaattttcatttataaattttaaggtcagcagaacgatggaggttgtgtgtgtgtgtgtaaatttgtgaaaattcaatcaaaatttgtattacctatcatcatatgtagtatgtatgtatttgaaatataattatattgaaaaattatgcgcaattaaatttgcaaaaaaccagcagttaaaatgtgcaaaatatatgtagtgcaattattag

SEQ ID NO: 40934 - DNA, 749 bp, Heterodera glycines
ttgtgctaacggcaaactagtttggtgccgttagcaggtggaaccgatcaacaacacttcggtcgtcgaggaccaaccacacaatcaggtcgccgtaggaccaatacaacaaacgaattgtgctaacggcaaacaaagttggtgccgttagcagggggcacctcccactgcacatcggacgaaccaaagcgaaacgaaaatggatcgtaaccaacgaggacgaatttcagggggatttcccctccgaccggaagggcggggagcggacgaatgcggcgcagctggccaaaacaaagaaagtcgtggacgcgcaaggcatgggttcaagtcaaacaggtgttacacccgcggcatcaaagaatttgcgcagcggaacaattgcggtgaggtcggtacgagatcaaattgagagagtggcggacacactctcggcgcgaatcgcagaagcgcgggagctgatggactcggatttcacgaggggcgaagcgctcgagcacgccgcgcggctgatagcaatggagaggggactcggacaggtcacccggatttttgaagggcacttcgataagggaatagcagaagcgggtgcagcacccgaggagcggcaggatttcttgtacgattccgttgccgcccctttgccagctacgacgaagtatctgcgactgcgggagcatccaactcccgccgaactgctccaaattgcagcggagcatctcagtgatttgcaagctgatgaggcaaacatt

SEQ ID NO: 40935 - DNA, 884 bp, Heterodera glycines
tatggatttattttttaaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaataagtggttgtaaaaaacttttgggtaatgaattattttttgaagtgagtcaaacaccgtattagtgctttgctgtgccgagaaccggcaggcaatggatggctttaaatctgcaagaaattaaattggcaataagtggttgtaaaaaacttgtgtaaggaattattttttgaagtgaatcaaacaccctattagtgctttgctgtgccgagaaccggcaggcaatggatggctttcaatctgcaagaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaacccggcaggcatggatggctttcaatctgcaagaaa

SEQ ID NO: 40936 - DNA, 1212 bp, Heterodera glycines
ccgatatttgaaatgctaacgaaaaaaattcttgcccaaaaaaatgcctatttcttttttctcttggggattggcccgcaaacttggtaccaacatttgccttctctagtctggctctaccaaacactcacacgatatttgaaatgctaacgaaaaaaattcttgccgaaaaaatggctgtctcttttttctcttggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctgtctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaacactcacacgatatttgaaatgctaacgaaaaaaattcttgcccaaaaaatggctatctctttttttctcctgggagattgaccgcaaacttgataccaacatttgccttctctagtctggctctacaaacactcacacgatatttgaaatgctaacgaaaaaaattcttgccgaaaaa

SEQ ID NO: 40937 - DNA, 745 bp, Heterodera glycines
  misc_feature (740)..(740): n is a, c, g, or t
ttaaaaataatattttgatataaatgtatctgtgccggttgttcgaagcggcatctcatttataaagctaattaatgagtttaatgcactctgactctctgtcattggaaaaaataattcatttaattatcatagttgtgttttatttttaattgattttttaaacacatatattgtttatttatttttaaaaattttatgaatttgattttaatttagaaacctaattaaaaatattataaatatttttttattatatatttgatttattttcaatgttaaccgcggctttctcatcgtcatcttgatcgtacaacagcttactgcaaaattcttcttcggccataaggcctccaattttaatttcaaattaaattattcttcaatttattatattttatttaaattatttttttatttaaaaaaaatataatgcttttaaaatcatatttttctctataccttttattaaattattttctatatcttggcaccttcaaatatcccccgattcttcataacgtccttatttttggtttaatttattttttaaaagtaattttattttatatctcaatatattatagaagcatttataatattgaaatttgaaaacatttattttcgctttttgatccaaattgttttctacaatgaatacttctaataatatgatatattcattaaatattttgttatcttattttaattgctaactaatttttagtcgattgcttcanattcc

SEQ ID NO: 40938 - DNA, 818 bp, Heterodera glycines
atcattattctcttatatatattaatttacattaattaaaaaactgctcatttataaatattttaaataaaggtcatttggttttcttattaactttaacataaaaatatttaggtattaatttttcaataaaaggaaaaatgaaggtattcactaggatcattaatttatttttcgaattaaagaatggttttgggtttggaaaccataagttatatagacagtgaaataaaaataccaataagtcatactgtattagtaaataaaagcaatcgctttaagaaacaaaaagtcctattatataataaataaattttttaaactatcttttaatgtcattatatatatgttatataggttttgagtttcgtttcaaaaactaattccggccggccgaaggccggccggggtctgaaagtggtggaagggtcttacaactttttgaggagaattcgggaaaactataggtttttttctccgagggacaactgagtcccagcggctcgaaaactgactttgccgccagtctcagtgttacgaaattttttgcttttgctttcagaacatagtggaccccaaaagcgaaatgccccaactatggcctacaactttgccagcaaaaaatttttgatcagatcaaaggcctgacctgtaggttaggcaacgtaagaatcactttttttggacacttcagtaccaggcgaatagctcgtaagggtttgctctcagcggggggtggccagcagactttttgtagaactcaatgagctcgatttttagtaattttaaaatttcgaaaattttgacaatttctcgag

SEQ ID NO: 40939 - DNA, 1564 bp, Heterodera glycines
aacagtgaaaagggtggacgattgcgcatcaaaaaacgagtgccgaacaccaccagcacataggcaatggacacctgtggcaaattttagagagtaaaatgattagtgtaatcagattttctgtctggcaaataagtgataaatttcaaatggatgaaaatacttttccggagcagcattttgaaactttaaaaatcaaattttcctgaatgtgaaccagatcaaaatctgatcaaggatgattcataaaagagccatgaaaatttggtctaattaattatttttaatttttgcttttggctgatttttgccactatttttaatttgctttaactgtttgacaattatttggacttcatttcattaactttccattaagagatttattgcccacaaaattatagccctattcattaatgttgctcgagaattttggtctcgagtctcggtctcgattttttcaattataaagagttgagagtgctttttggtaactttaaaataatatttgtaaaaatctgtcttattaaggctagaggcccaaggttggggaaaagggatttgccaaatcggagagggccgggaaaaagttcaaaatttaagcggccaaaaatattaattgtaaaattagtcaaatatttttaaattttatgctgataaagcgtaattaatttttcacctgaatggtcaatggaaaacgtccgtcaacccattgcttcgcttcggcctccggaaatttgtcggcagtcaaaatgtccaaaaatttttcgttttcaaatggcaccggtttggtgacattctgccaaaaagaaatgccgcttgaaattgacatttgaatctgcaaaaaaaaaaaaaataaaaataattttttctcgaaaaattgtgtagaaaatttttagggtggcaatagaacaaatagggatggatgagaagacccatcggcacccctaatttttaagggaaaatagtattttagctgaaaatttcgattttccttgttgatactatttctaggcctatctcatcatttatccgaaaattttgctaaatttatcaaaacttagcgattttttttgggtgataatctgttaaaaatggtaacaatttcaatttttttttcttgctggttgcgcctctcggcagcgccggaccctaaaaattcttctttttttatttgaaagaaattactaatgaaaaattaataataattattatatgcattttaaagaaattttaaatatttgttttaactgaaattttgcaacttttttatagaaaatttttaagattttttagtagcggggcaaagattattttcattttccgatcaaaatgaatgattaagttaaatgaatgtgaaatgttctgctgctgtccgtcatcatcacaccacatgaaatgcagcagcaaatgaatgaatggggggagggaaaatgaaaatgctcaatttgtacaaatcgaaaggaaaaaattcaagaaaaaatcattaactttaactgttagacaggagagaaaaaaaacgggggggtatataaattaataaaaaaataattataaataatat

SEQ ID NO: 40940 - DNA, 1318 bp, Heterodera glycines
tgtttttgcctctttcttttcctttttttcctcgttcctttcttaacttactttttcctctttctcttcctcctcctcctcttcttcatcctcttccgtttcctcatcctcttccccatcatcagtcccagttattccctccgctgattgaatattttttgctgcttctcctcctcctccatcattgtcttcttcatccccatctttttggtccgccagcggcgcttcgttggccaattctatttttttccaattaaatttaaatttaatttttctattttttccaattaaattttattttaaattgcatttttaaaatttaccgctttcattttcgtccgaaaaaatggtcaaaatggcggagcacaacaacacaaacacaatgagcacaatccacgtttttaagccacccttttgaaaaaaaattggaaatttaatttttgaattttgaattttccaccttatttacactgtaatccactcgtttgggggtcaccattagggccatgtgatggacatgcgaatggccatctgttaattgattaattttattatttttaacatatttttaaatagtttaaaatacttttttaggggttttttcaattccttacaatttgtaaatttgcaataataaattaaattttcggatttttgttcaaattgaacaataaattagggcaagataaacagaactgtaagtagctcatttaaaaacaattagttaattaattacagcttgatccctgtcgccgaaattgtgcgcggatgcccagcggcggtgacggcgacggaccgccgatgtgcgacccaacggcacttgctgaaggaggggccatccccgaaaataaggtgtcctaattaattaaactatattaaaagagggagaggggaatgggcgacaaattaaaagggacagaatgggaaattgttttcaattggattgttttttttggggtttgggggaggcgtaggcatgcgacagaaaaatgccgcgatagtgaaaaaattggcacgaattgcgcgcggtcacgtgaaaatagcgccccgaaaatcgcgattcattttccgtacatctgaatcggcgcttagtaagcgccgcttacgcccaacttaaaaaaacaaataatttgctcaattgagcaaaaagcgggggggggggggcgagagggagggataaagccaagcaataagcaggctactcaccaaacagcagcagatagcccaaaagtttaaatggctgaagagggtgggccagcggttagcccacggttggcccatggagtgaatgggccgggacgggcgggggggggggggg

SEQ ID NO: 40941 - DNA, 1146 bp, Heterodera glycines
  misc_feature (64)..(64): n is a, c, g, or t
gagggggttaattgtaagctttaaccgttaaggcacttaatcttttaattttcccattaaaatnttaaaaaattaccatttataaatgcgttgttattgctctgagaaagactctgcccgacgtgttcagcgagttggcactccaatggtgaatcagtccgaaactggcagcggatgaaaacgcatctgacggaaaatggcaattttaatagaaaatataaaaaaagggggaatatcgggttcatataagtcatagggaataaggtggtaggtttccattttattagaataattacgaccccgccccctcctctcggacttcgttcatatgggggccgaaaaagggtggacggcgtattaattgggatgaaatgtgaagcgatgcggggaaagatcggaaattcgtaattttacgacattgaatttcgcaaatttcaaaattatttggcaaattttcggaaataagtcatgaagaatccaaaaatgaacttttacgtcgacgcatatcggcacagcgaagctaccccccccccccttgtccctcaagttttttaaaaacagagacgcaaaaaaggtgtttaaaaaaggtttcgttttgcatggactcgcaaaattaggaccgaccaactccaccaatgatttaagaatgacaaaaaaaatttcccactccattctttgtgctttgccagccaatcggtgatgcctttgtccaatttgagcagcgagtgccggttgtcaatgaacctgaaaaatccggcagttttattggcaaaatcatgtgtttattggccccaacaaagttttggtcatacaaaaagtcgaaaatttgaacttttcgaaaactaagatttattattagaagcaggttgttaccgattctttcgaaaaaaaatttaattttaaaaaatttatccaaagacaattcatcttttaaaagtttgaataaataaattaattaattgaacactgtaaaaacggcctaaataccccgcacaacctgaacgtcttgtacggcaacgaacagcaccatgtcgtcgtcgttcaaatgtcgcctaaatttgaccacccccatggaccttccccccccccttttctcacaatgtcctgagaattgtcgattgcatctcctcattggtcctcgtcatc

SEQ ID NO: 40942 - DNA, 1168 bp, Heterodera glycines
  misc_feature (40)..(40): n is a, c, g, or t
agagatttgaatgacattgaaatgctggtgggttgagtcncagtgtctggaatgccggagatttgagtcccagagattgaaatgctggtgtgttgagtcccagagattggaaagcctaagaattgagtctcagagattgaaatgctggtgggttgagtcccagagattggaatgccattgaaagttggtgggttgagtcccagtgtctggaatgccggagatttgagtcccagagattgaaatgctggtgtgttgagtcccagagattgaaatgctggtgggttgagtcccagagattggaatgccattgaaagttggtgggttaagtcccagtgtttggaatgccagagatttgagtcccagagattgaaatgctggtgagttgagtcccagcgattggaaagcctgagaattgagtctcagagattgaaatgctggtggattgagtcccagagattggaatgtcattgaaagttggtgggttgagtcccattgtttggaatgccggagattttagtcccagagattggaatgccggagaattgagtcccagtattggaatgctggtggcctgattttcagtgattggaatgtcattgaaagttgttgggctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccagtgtttggaatgccggagatttgagtcccagagattgaaatgttggtgggttgagtctcagagattgaaatgctgctggtgggttgagtcccagagattggaatgccattgaaagttggtgggttgagtcccagtgtctggaatgccggagatttgagtcccagacatttaaatgctggtgtgttgagtcccagagattgaaatgctggtggattgagtcccagagattgtaatgccattgaaagttgatgggttaagtcccattgt

SEQ ID NO: 40943 - DNA, 1416 bp, Heterodera glycines
  misc_feature (13)..(13): n is a, c, g, or t
  misc_feature (37)..(37): n is a, c, g, or t
  misc_feature (91)..(91): n is a, c, g, or t
acttttgttttcnaattcgggttcgggattcggtttntaatataaatggatgtcagattcgtgatagccggtctctaaacctccagggganaagtgttctacacgacttttttttatttttatttttttcaaaaaatcaaaaaaattcctgtttttaaccctaatggaccctctccgattccggtacctgtcttttttgacccgggttctcagcccgctttcatttcatcgcccctcgtctcgcggatccgccctcctctgaggtcacaagaaaacatgacatttgggggcttcttgggggatggaccatcccacacaatgaaatttgcttcctctcgtttttctgtccgcctacgtcggaaagacggtggttgggagactgtggaattgaatgagagtcccaagataatcccatcagtcgagtttttgagggaaatccattggaacccttccgaaaacgtaaaaatgggagtgacagttgaggagccacaaattttgcttggaatcaaggaattttggaaattttttgtgggaagaacagaaatctccccaggcttttccgaatagacactgttttcggccctgtatttggcggaggaatggaccatttttgtccgcccgtggtttcgcattcgattccaatggcctgtggggcaattctgaggcaagaagaccctaaggaagtggtcaagcgcctatggaatttggaatcaattgggattagcgacccgttggatccggatgacgacgaattggctatctccctttttaaagattccgtcctgatttgaaggggaaagatacgaagttgggtggccatggcgtccagggggaagggaccgattgcccaacaatttttccctggcattttcccgcctagtggctttgtctcacaaattgcgggtcaattcagaattccgggaacgatatcaggctataatcacggagcatttgcaaaggggaataattgagccggcggctcgttccggtgcacaggaacattttattattcctttggctgagagacccctccaaaccactgaccccggacaatttaatcattttcacgggatgggatgccccgatcggggaaacgctcgaaagggcttgggcagcgatcgcggctgaatgggcttgcccacctctcgccatttcacgcccaaccccctgcggtagggccacactacaacttcatgtttttctgacgcgggccctaactgcttttccgccgctgcttacctgcgctcagagattaatggatgcgcggcggtcacacttgtttttgctaaatctcgcctgaggcctaagaaatttaaaaatgatggtttgacaataccccggctggaattattaggtcttttaactgcagttcgcgtaaaaaatttcgtgcatgcaaattttggtctgccttttgaa

SEQ ID NO: 40944 - DNA, 1275 bp, Heterodera glycines
ggtaagacttcaattcaaggggtaaagcaaaatcacgtttaagggttctaaaatggcgtataattaatagaaatcatcattttttggcgtaaaaccgacgatttcatggcgaaatgcaattttttttgtcgaaaaaaatggacaaaattgagcaattttagccttttaaaggggtcaaacccacacaaatttagtatcattcgaaagctcttgacgagttaagtcgaaagattaaagaaaaaagtggtaaaaatcaaaccgacgccatctaagcattgggacaactgagtctcagtgaaaatggacacttcagtaccaaaaaataaaaataaaatttcttcttatataatgcacgaaaagcgtttagccttgaatatcgagtattgcgctaaaaaaccgccgcaactcgactacggcggccagtaggtggggcgagactacgggctacggaagaagtccgcgcgtaatccgcaggcggttgactgattgtaaagggtcaggggccccctttttcactcaatttttcgagttttaaaccggttgaaaaaccggttttttggcatttccgcaactggagacctactttttcgtgcatagctcgtcaagacgaatcgattggtatatcatttgtgccattttttccggggggttgactatagtacacccaacttttgaaatggagtaggattaatttttgcttcatagccaaaaacacagttttacggacattcggaaaatgcataatgagaaaagctttaataaaaacttatgaatagggcttcgttttttaagaaaatgcctaaaatccaagacatacaaagtgaaattaataaaacggttagaaatttctatgattgataatttttttaggttcgcccacattgacacttatgaataaaattttgtcaaagtcaacatgaggtcaacatcacaaaatattaattaatttaatgattgttaaattaaatgcgaataaaaatgaaaacataataaacgtataattattaaagataaaagataatttaaataatttatttatttgattgctaaaaatacttatataaattaaaagttaaagttataaaaacttaatcaaaaatgaaaataaagtgaataattgagtataatcctcaaaaattgcattccaacattccattggtttcgccaaaagaatggcgccaaaattatgccgaaattggtgtaaaaattcgattatccctggaaaaattatgtaaaaagagaaactattggaagagcaaaagcataaataaggaa

SEQ ID NO: 40945 - DNA, 862 bp, Heterodera glycines
atacttttttcttcttctaaagttcaattccccaacccctgttttaattattttgtgtttttttcttatccagatcacttcttatgctttttactattagtaaatgggagcataaaatttttttatattttaaatcaatatgaaaaaaaacgtgtgtgacgatgtccccgcaaatcttatccatcgatgagagattgataaacatacaaagtgggactccatatgcaacttagagtgacaaattatccgccgttactcagttgttcaccggaccggaaaacccttatttttcccagatgcgcctcaaaaagttgtaagacccttccactactttcagggcgctcccggccttcggccgggagattttgttttttgaaacgaaatgcaacttttctctatggtaatataaactagcgtgtcgcggcgcagtaattgctcggtgtagacagtatgctttgcacagtgattgctcggtgtgtaggcagtatgctttttatatgtatggacgggcgctgacatgagcgcttcgcgcaaaggacttcgttgctagtgcatgcgcggttttgaaatgaatttatggatgtgataagggattttggtatataggtatcgcgaggacgcattcataattttgtggaggactttcggccgcttcgcggcctcaaagggcgctccgcaccctttttatatttaaggtttaattcggccgcttcgcggcctcatgacgggcgcttcgcgccattttcataattttatgtgatcattcggccgcttcgcggcctcaggacgagcggttcgcgcccatttcataattttatgggatcattcggccacttcgcggccggctgttaagcctcaggac

SEQ ID NO: 40946 - DNA, 985 bp, Heterodera glycines
  misc_feature (906)..(906): n is a, c, g, or t
  misc_feature (931)..(931): n is a, c, g, or t
  misc_feature (935)..(935): n is a, c, g, or t
  misc_feature (962)..(962): n is a, c, g, or t
ccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtcccgtttggggtactcaaacaattatggggagcaaaaatccaacgcagaattanagtacaggctatagggaagctattnccgnaagcgatcggtctccccataaatctgngcgcatcgggttcgggggggact

SEQ ID NO: 40947 - DNA, 1111 bp, Heterodera glycines
gataatttagcgctcataatgggatgtataaaggcgatgtagaaaggaatggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagacaattttttctaggcttagatcacatgcgattttcggcactctgataattttagcgctcataatgggatgtataaagaagctttttgagcgtaattacgatttttacttgaccatttttttctaggcttagatcacatgcgattttcggcactctgataattttagcgctcataatgggatgtataaaggcgattgtagaaggaattggaagcgctaaaattgttgagaagctttttgag

SEQ ID NO: 40948 - DNA, 986 bp, Heterodera glycines
cgtaattacgatttttacttagaccatttttttccctgcttagatcacatgcgattttcggcactctgataattttctcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttaaatcacatgcgattttcggcactctgataattttagcgctcataatgggatgtataaaggcgattgtagaaggaattggaagcgctaaaattgtttgagaagctttttgagcgtaattacgatttttacttaaaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcaattttcggcactctgataattttagcgctcataatgtgatgtataaaggcgattgtagaaggaattggaagcgctaaaattgtttgagaagctttttgagcgtaaagtagcgcggccgagcgcggtggacgatttttacttagaccattttttctaggcttagatcacatgc

SEQ ID NO: 40949 - DNA, 880 bp, Heterodera glycines
  misc_feature (46)..(46): n is a, c, g, or t
  misc_feature (60)..(60): n is a, c, g, or t
  misc_feature (64)..(65): n is a, c, g, or t
aaaagaggaatatgagaataatgttcggggtcacccgtataggggncctcctcatcaggngctnnagggcgctccctttgcagttgttcgtcatcattttcgggaagttcggcttggaattggaggcccacaccaatttgagacggacgagctgtgggcaacggcacaatgccaccgcctaagagcggaagagaaaacggttggacacatttaatagaaaatgcattttttaatataaaaataacaaatttatatttaatagggaataaaaattaaaaaaaagacaatgtaagccaaatgattggataaaagcccagaaaagtggctgttggtcgaaccactcgaattattttctttgcaccgaataaataggacagtttctcgaccgagtctcgatgagttgttgagaatagcaaaaaattattttacattttatgagttcactcaaaatttataatttcaatgcaataatattatgcgttttttagacgatacttttttcaggttcaaacacacacatatatttttcttagtgttttcgaatgatgccgaaaataatatcgaaaatataggatttcatagagtgtaatagaaccaaaaaaagaaaaaaaagctcgtcgccagaaaaatctgtaaaatggtcttcgtgtttcttccgggatcatcgatccacccatctggaccaaatcgaaaaaacccaatccgatccgaaaaatttaattgttgtacctttgttttcaccctctttgtccagtagtttttttaatacttttccagctttttcatttttcattattttttaaattaattttcttttttgtaacatcacctccttccgattcctcctccccctcctgcgtaattgagctgtttgttcaga

SEQ ID NO: 40950 - DNA, 1311 bp, Heterodera glycines
gcgccgctttgttaaaaaccaaaaatgagtcgttttgcacccgtaataaaggaaacccaagagttttaacaaagatccaacagtaaaatgtaattaaaattcgattttactaaagctgccttactctctctcctctgtctgtgaatacgcaaaaaaaaagaagaaaaatttgattgccgactattaaaatcccttgtccaatgcaatttccgtcgagccaataaaaaaaaaaacctaaacacagtcgcaattgttgctggtcgttcagtgggaaacggctgaactcattggcgcaggaattgaggctgatcccacgcggtggcaccgattggttgaggtagacaatttcgttggcaccaaacagacaaacaccgccaattggcacacaacgcgccaccgtcattggcagtccgtcaaagtgccacacaacggcatgcacacggtccttgatgttcatggacacggccaaaatggccacagtgtcgtagcgaacacaggcactaaaacagagtttagaattaagaatcgcgcgatgtttccatttttatttgaattatgtaagaaaaattcaaaaatttctgctttttgtctgaaatttctcgaccaattctctcaagttattagagcacacacattttaatcgcacaacagccaaactgcgcacaggtgccatcagagtgaaggaaagaaggcattccaaacggactgttggtggttgaccagcaaaccatccgttggcacaaaagatgggttcagtcggtagaatttgatgcattttgcacaaacagtgaccagctgcttgccaggacccggcaaaaaactaccccaggcactgaaattcactgatgtggcaccatcggtctcgtgcaaaagtgaatacattgttgattatggctggaaatttttcgggtgccattagtgagaattgatcaattaataaaatatttaagatttgaaacaaatgaatttttataagaaacagattaaggggaaaaaaatttacgcttttacgcaggtcaataaaaatatgcgaacaaattatatgcaagtcaataaaaatatgcgaacaaattagtcatcaataccaccggatccattttttgtcagaagccgattgatgccccgctccattcggtcaaaacgccggtccacggcgtcaaaacggcggtccacggagtcagtgagcttctcaaaacgggcgtcaacgtcaactttgagagcgttcaaattagcctcgacggaaccgactctgccgaacaacccccacaggagcgacaacagaacaccaaagagggtaagcgaaatgccaac

SEQ ID NO: 40951 - DNA, 1011 bp, Heterodera glycines
aaaatttttaattcctttttaaacaggccaaaaagttccttcttgacttttttttcagaaactgatcagaagcgcaccacactttgcagggatactgaaaggaagagaaataacctattttaaatattatctagtcagttcatttaaataatttttatccaaaaaattttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattatgcgttggatttttgctccccgataattgtttgagtaccccaaacggacacttgaaaaaatcgatttttttgttttcggggca

SEQ ID NO: 40952 - DNA, 1004 bp, Heterodera glycines
  misc_feature (895)..(895): n is a, c, g, or t
  misc_feature (963)..(963): n is a, c, g, or t
  misc_feature (966)..(966): n is a, c, g, or t
ttccgtaccaattattatttttataatgggtttgttaaatgcaaaacaattcacaaaagttgttttaactccattcagagatgagatagaaaaaaaacaaaaataagtttgaagagcccttgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatgggaacaaacctatattggactaccatacccaattaattatttttgggatgcgaattgttttgtgcgaaactgttatgaaaaaagggtacgaaaaactgggaaaaccccactcagagactagctaacaaaatcagcataggcttggacttccgtaccaattattatttttataatgggtgtgttaaatgcaaaacaattcacaaaagttgttataactccattcagagatgaaatagaaaaaaaacaaaaataagtttgaagagcccttgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatgggaacaaacctatattggactaccatacccaattaattatttttgggatgcgaattgttttgtgcgaaactgttatgaaaaaagggtacgaaaaactgggaaaaccccactcagagactagctaacaaaatcagcataggcttggacttccgtaccaattattatttttataatgggtttgttaaatgcaaaacaattcacaacagttgttataactccattcagagatganatagaaaaaaaacaaaaataagtttgaagagccctttgagagctgcaccggatgcgagtggccgccgntgntgtacgctcaatcggtgctgtgcaaagacggaaaattg

SEQ ID NO: 40953 - DNA, 1046 bp, Heterodera glycines
aatagggatgggatttttagtgataaaaaatcccaaaataataactaaatagtgaccaaaaaatgccaaaatagtggcgaaaaagttccaaatttacgaatgtaattttttaaataactatttttaatttgaaaataacgctggggcccaaacgtgccggggcccaactgacgggttccgtcccaaaagcagttcggagaattaactaaaattttttcgcataatacacttccctaaatagcttcgaaagaaaaacatataaaaaaatagaaaaaataataatcgaattcaacgactatccctctgatttacaccccttaaatacttaacctttttagtgcgtatttttcggttttggggccggcctttttggcaatttttttgggcttaaacttctccaagtgcctaaaaatctgagcctcgaccttttttggcaattttttttgtgcttaaacctctcgcactttggcgtttttaagtgccaaaaaatctaggccctagaaatcattgtaataagaaaatgaaaaaaaaagatttttttaaagctgggaaaatgatcatatacctaaatgtacagagaaagaatatttgcgtagaataatatttattcaatattgattttaaaatgaaattaacattatttaatataaataaacaaatcgtaaaagatggaaaaaaattttttttcatttttagtggcattgagtgtgtgaatgagagctcagcggaagctttctacaggctgaacttccaaaaatatacaattacaaacgacaaattcggcatttgtcccgaattaattaccgttttctaatttataaaaatccagaattttgggactcagaaaatccaagattcccccccccccgaaatgaaaatttttaaaaattttcttcgaattcgtcccccaaaacgaaactacaatatttatgggaacatttttgaatattggcaattttcgtaacaaagtgcactcaaattttcaaaattttttcaaaaaaaattttctcttgaaaaaattcccggttggtcccggcttttctcgc

SEQ ID NO: 40954 - DNA, 977 bp, Heterodera glycines
  misc_feature (79)..(79): n is a, c, g, or t
  misc_feature (970)..(971): n is a, c, g, or t
tctcttttaggacaatttctatctcgtacccccgatgcttatcgttccggagagcctctcaaaaatttttccattaccntaagagctgcggaaattgtgaattaattctcagaaaaatgtctctctttttaggacaattttctatctcgtaaccccgatgataatccgttccggagagcctcttcaaaattttttccattaccataagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggaaagcctcttcaaaattttttcccattaccctaaganngctgcg

SEQ ID NO: 40955 - DNA, 1500 bp, Heterodera glycines
  misc_feature (19)..(19): n is a, c, g, or t
attaaaatatttaaaaatntaatgaaaaaataaattcgaatatccacctgagacatgctttttcactgtttccgacaacggatcaaaactaaggcgtacagctggtttcacattaatgccaccaattgaacgtggcaccatcccggacaaattcacttttgaattatcaaatctttaaaaaccttttaaattttctaatattcttttatggcattttacatccaatccgctaaaacaattgggcattcctgcacatcgttgggaaaggcactgaagtcaaattggcacgtcacatggaaggtgaaagtgccagccgcgataactttgccatcatttgccacagtggcggaaaccttgtggtgaaaaaagtggaatattttatctatgtgtaaatcagattttcattttgctgacatttatcactttttgagtttggcactttttaagatggtatatcttttgcaaatttttaatttccaacttgcgatacaattttgaataactacaattttgcgctacttaataagtgaaaattgtacatggtgattttccgggttgctgctcacgaatctacatcaatttcatccaattcctaacctaaatttaaaaaaaaaaaccaaattcgaaaatcgtgtttcgattttttgttgagtttgggtcggaattggtcaaaattggtatcaattggttacttacaaacgacccctaacacccttaagttaactaatattacaacaaaataattttcaaatctaaaagatcccccccccctcctaatttgacggtgctaattgtttgataaatgaaaattttccagaaaatttttactaaaaataaaactgactccattcatgtagacgaaccaattagtggaacgtgccgaattatacagagcaaaagtgggctgccaaattttccatgtctccaacgaaaccacataggtgtagttgtgttcagatgggttccactgcagatattcatctgtccatgaagtccttaataaattttatttaatttatatttcaaaatatgaaatataattattttttaacattaaaaatgtatataaaaaattcatcttaccataaaacgccatgcagtagcattgttccctccgattggtcctattttaaaaattattttattaattttttaataacacgaataaaaaattgttaaaagtgccaaatttcgaaaattttacgaaaaacaatttaatataaaatgagaattatcataaaataattcagaaattaaacttccatttttcactcaccactttttcaatgtgatttattgtcagaaacaattggacttgagtgaccgttgactcccttttcactggcctaaatttttgagcctttttcaaaaacaaaaaacaaaaggtcaacctgtgccttcggtcataattacgcaaaatttcttcttctattctccgattttcatttatccagcacaatatatttggcaacaacagaagcaaaaataaaattttcggca

SEQ ID NO: 40956 - DNA, 723 bp, Heterodera glycines
tgctttaaggttttgtctttgactttgcttttttcttctttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagagggcaaatttttacagaaaataaatagacgctgactaattagctaacattttataaagaaagtagaaatttgattaaatgcatatacaatatacaaaaatattacttttttaaatttgtataaagttcctattttgtcttttgactttgctttttttttccattttatttcaatcgggtag

SEQ ID NO: 40957 - DNA, 802 bp, Heterodera glycines
gagagagagaaagagagagaggtaagagatgagagagagagcagagagggtgggagagagaaagatatcagaaagagaaaaagagagaaagagagagagaggagagaaaaaagtgagaaagaagaaagcagtgagagagaaagagcgaagagagagagaggtgaggaaattctttcaaaataatgatacattcatttttgtcagcaacatttattatcagtctctactaattattaaaattttactacaaaaattccatcttaatttgacaacgaattaaaaaatgtcagacaacgcaaatgaaacggaggaccaaatgagaaatgaaatgtaaataaataattaacaatcaattaatggggctcacctccttcggacctgagctagtaggcttattgaagaatgctgacaacctccgatatccattatagcttattcctaaaatagagcacccgtggctttattttcacccactctcaaaaggggggctttattttaggggggagggtttaatttagggagggagagctgtattgtaggaaattctgtaaaatcatatagcatcagatactttttgtttgtaccgaacgaatccgaaagaattttgcgaaaatccacctgctgattggcttataatttttttccactcagtttttatttgtccataaattctttcgcatttgaattatgaaaaatgccaatgccggacaaagcattgcccagcaaagtgatcggattcaaaagcattatgatcaggtaatgctggcgaaaatgcattcaaatggcacaggtttttattagc

SEQ ID NO: 40958 - DNA, 796 bp, Heterodera glycines
ttttaatttatcttatatccaagaaaaatgactattctcttataggtgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttataaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggagcgcgatcgccatttaatttctcatagaattattatgtttatcttatatccaagaaatgtgactatctc

SEQ ID NO: 40959 - DNA, 1070 bp, Heterodera glycines
gtgttgcactttctgagaggaaaagagacactgctttggcagtaaaagaaaaaggaggacgtaagcaaatgtacagataaaggagatgacagaagcaccttcaatacatttactcaattttatttgcataacttctaaaaaagcaccaattttatgcatgtaataaagaacaaatatgccattcaaatgtcacgacataacaacacactattacacaccacaatttccttctttggtggtcattcaccgccattgccggttgcttcgttcccagccttaattataaaagttagaagattataaacttcatatgcgaccctatctaccacatgattggtctccccgacgttgacgttgctcgccggttcagtcttaaacgtctcgccgacgttgctcgccggttcagtctgaaacatctcaccgacgttgctcgccggttcagtctgaaacgtctcgccgacgttgctcacctgttcagtctgaaatgtgaaaagtttcaatgttatgacaatgtcgcttcctacatttccaactccgccaagttcgcgacgaatgaagtcgctcaatgcaacaacagtctccacttgctgctctatagtcggctgatgaactccttgtccacgaagagcctctcggacttcgttgaacacatcctcctgcgcttccccgcgtcctcgcgggtttaccggtgggtggttatgctctgcctggatcaccaaattgtcgttgcttgtttgactccctaactgtagaaaagattatcctattttattgcgtttttttctcacataataaccaatggcgctaccaagcgctgcacctgcaaccaacccggaattaaaagatggcattttgataaataggtttgctcctaaagtatatatgctatgaaaaattggcatagactaatattttgaaaaagattgaacgaatacaaatctaatgaaaataaagtgataaaagctcacaattgtcttatatatacttttataatgtccccacgtcataatgtcccccaagctaaaatcagtcaaaatgtccccaattaaaattagcaaaaaaaccgaaat

SEQ ID NO: 40960 - DNA, 844 bp, Heterodera glycines
cgcctgtgctactaattatttcatttttcctcacatgtttcactttctttctttttgccccattatttcccactaatgaactgttttcccttaatggaccactctcgctccctctcttaatggacctctctctctctctcactcactctctatctctctctctccatctctctctcctctctcactccgctatctctctctctccatctctctctcctctctcactccgctatctctctttctccctctctcacacacacactctctctctctcttaaaaacatatagacgtgccctgcggggcgatatgaacgaacattggggagccttgggggggatgggggagcaacgggataaagcctcaaaaagagcctttcccggctggcaggaaaaacgcgagactcccctcccacctcacccccgccctcccacgaaattcggtacagccggttggcacggaattccattcccttttttcaatgccgctctcactccatccatttcttcgggcattgacgacgacatagtgagtgggagaagagggggcgccaatgggaggagaagcatagtgccgtgccgtcgtccgtcgacctcgtcgtaggccaatggcaaatgaggaataatatgccggcatttttgcaatgccgccgcccccgtccattgcgcaccgaccatttttttattgcaaaatcaataattcgttttcaataggtattaaatgataatgaagtttaagccacaaatttgcatatttttgtgagttccccgatcagtgccgaataattaattacctttaacaaaatgacgaatacggcatctgatcaaaacccagctattcatgatc

SEQ ID NO: 40961 - DNA, 842 bp, Heterodera glycines
ttgtttacgtaaacttcgttttttccattttttattcctttataaatattttagttccatttaaattatcttttttggttttcttccccctcccctctcccacctcgtcccctgaatgcgtctgattgtttgtcggctcgtctcgaatttgcatccccccacattgaacaccacccgagacggtgccaccgctgaaactccgctacaatttgccattttccgtttcgtttggtcggttattcctttgtcattattattttgttgatcttttaattccgttttttttaatcagaaaacccaaagattacttttcttaatgtttttcaaacaaaaatattagcggattatgtacagaattttcttaaaatccatatccaaaatagatactgtatgtttaagaaaaaaaagcaattggacggcagaggaactctgttcaaaactaatcatatacatatgtagagcaaccaattacaaattgaactataaaaagttaaaaataaccattttcgatatcaaaaagcactcaaattgacaaaattaaatgaaaattgagttcgatcattaattaatgaaaaattgttttttaaattgccacccgaccacgccccattaagcaacacttagaaaagagaccgcaaattcccattgccctcgcctttggcgcatgttcccatagtgactgaataatgtgatgaaatttgagcattcctttaaattgtaactgccaattcgatatccacgcttttcgcactttttaaatttaagaaagtgaatgcctttggttcgtatggctttgataatcaccgaccaaaatttatcgcaattcaattacaatgaaaaaa

SEQ ID NO: 40962 - DNA, 861 bp, Heterodera glycines
ttttaattttttgggggcaatttgtcgcttcgcggcctcaggacgggcgcttcgcgcccgttttttacacccctcagaatctccaatcacacagtgattctgaggtcttaaccatgtctaaagtaaaatctgattacatattcgtgatcagcggcccaaataacccctaaagacatatttttggaggatttttggtgaaaaaaatttcccactcaaaaatcatggtcacacccatttggtcccgaaccccaaaatcacttttatttctataacttttttcaaaaaagtgataaaaagctaaaataaaatttataaaatagagcaaaaaattgcggattttttgagtatatcatttttataaaatactttttcagaaaggagttaggaatttttttctgaaaaatcgaaaatttccagattttctagaataatttttttaatttggaagatagaaattccaaataaatctcataaaattctcctaattttttgctatttttcaaactttattccactaaatttgaccaaaaacaaagagagttatgaattttcaaaatttcactggattttccggggctcaaattttgacgatttttcaaaaaattttaaacacttaccaaaaagtctgaaactaaaaataaagtatataatcaagttaagcaccttaaattaggccataaaaatgcattttggctaatttaggagcaaaaaaatttttcatgaaatgcaaaaccatggggtcccccctatggttttgagtttcaaaatcacaattaatatgataactttttttaaactcatggtaaaaacatgagattaaacgcattagattgggctttaaattctctacaaaaaagctct

SEQ ID NO: 40963 - DNA, 1016 bp, Heterodera glycines
aaagaattatttttattcaaaaatttttatttctttcctctcataaatatttttgaccaaagccccgcccccatttcactaataatgattctatctcgactaattattatttatttaatttgcattttaaaataaaaactttaaaaattaaaaaaaaattccacagaaaaatgaaatcattttccatcgtctgctttttactgataacaacattattatgtggtcaatttgctgcggctcacctcggcttttttgacgatttttttgattccgacgaaaattttgattttgacgaattattcaaaagcaaattgcattatgccattggccaacgggacaagaagcagcaacagaagaagccgcataaacatggcaatgttgatgtggagaacagaagcttggaccaattgtacgcggcggcgttggccgagggtggcaaattggtggtgtacgccggcggtgacgcaccacgccaacaagtgatccaatggcgagaacttttcccgagactcatgctgaaactgagtccgagattagtgacataattagggatgtcaattttatgtaaatacattttttttcctggcttctccatgttctaaattagggttgcgtccccgacgtcggggttggaaaattcggggttcggggttgtcggggttggaagcgtcggggtcggggttgccaaatcgttcggggttcggggtcggggttcggggtttttcaatttttatcttatgcctaatagtcaaaatttttttaatattttttcggaaataatatttattaatttccataataatatttgtattgtttttatattttttatttcttttttatcagaaattttgtatagaattaattttttttttcttgaaattttaaaattttttattacttttttgttttccaaaacatcttttttcacgtcgctcttttctaaagacttaaggagaagggggaaacgggcgtcccggcgggtgccataggcgccgccgggaaaattttgaaaattt

SEQ ID NO: 40964 - DNA, 1082 bp, Heterodera glycines
  misc_feature (1051)..(1051): n is a, c, g, or t
catgatagggagggcggtgcgcaatagactttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaatgctctcgcgtatgagacggagggcggtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgataggggagggcggtgcgcaatagaccttttattnttgagggaatttttaaatttatactctatcc

SEQ ID NO: 40965 - DNA, 1028 bp, Heterodera glycines
atttgaagtatttactacttttagttggactaagtcgagagttataaaacactgtaaaaatgtcgactcgttaagtaaataaagagaatatttaacgcatttgaagcctccaattgctaaaagcattttcaatttgttggaaaaaattattcgtaattaaatccaataaatattcattaacgaaaaatcaaaaagcttaattttatttattttatttggatgtcggtcaaacccttccaaaagttccaaccgccaaaaattattgtatcggatgagcaaaatgaacgaattttaacaagcattgacagtgtaagcagcagacaaaataaaaaagcagaagcatgtccaacgacgaacagtgcagcaaaggaacaaagcaaaaggcaaaaaaataaaataaaaaaaatcgaaatttaattatactttttaaacatttacagacgcattcgcaaggacccgaatgacccgaccttgtcccaaaatctctttctagccgatggaatgccaatgttttgtattttcaattgttgccaaattggcccctctctttaggcactgcgataccaccaaaagcaaaatgatcaaaaatcgcgcctcggaactgtaaaacaaaacgaataaactttaatagccaagcaattaattaatcaatcagccaattaaattaaatatattacctaattgtctttactttttcagaataattcgcattccctcgcgccaattgaaacgaattgtgaaaacgcaagggattcgatcgcttcagagagaaacgcaacattttgttggtgggaatgcgttggttggctgctccgtttgactttgtccttctgttaggagtcacctcagtgaacggtttgctgagagtgtaccgtagccgaggcgttttccgtttgttttgggttacggtcactgcagtttcgcttctgcttttgttttggcaaatcaccaaattggtccaattgtatttttcgcggacgaccgcttcgcaggtgttttatgtccccatttttaaaaatgactctaga

SEQ ID NO: 40966 - DNA, 1028 bp, Heterodera glycines
  misc_feature (1012)..(1012): n is a, c, g, or t
aaggaaaatctgtagcaaatttcatgctctttccaatgggactactaaaaattactaaaaaaaaatccccaacgcctaattcgttgcttttaaaatggaataaatcttaaaatattatttattatttttgtaaattttaatcagaaccattgcaaaatatgaacataatactggtcagaagcgttgaaaaatattaaaacaaattttattaggttataaaaaaaatcgtaactaaaaagatgacgaaaagtagacctaattttcaatcaatttgcacacaccaatgaaaatccgaaatttttcttttatttccaaaattattaatgtcaaaaatttaacaaatcattaaatttcctgatacttttcttcgtctgtcatcatttgttagtaatcaattatatcaataaaatattcgaattccttcatcaaatattacaaaaattattttgttttagcagttaatttttatacatttaatattcataatttttttcaaaataagcattgaattaataatatatgtataaagttttactcaaaaacgattttttataaaattttttttaatctttcgtgcctcaagatttctaaaaaaattatgtttgaaatttaacaaaaagcctttgggtataagttgaaaataaaaagaggctggaaacaagaactaattttcacattaatttgcgcaccaatacaaattctaaattgttttttttccaaaattatttattgcttaaaaaaatacgcagcgataaacaaaaaaataatatataaaaattaatcaaggaaatgaaattgtgtcgaatattcaatttaattgtatttttgatcatcttaattaatattaatcatgtcggagcagaaaagaaaaaattacagcaaaagtcatttgatgaaatatttggagaaaaatgggaagaaaaagaagaagaaaaacgaaatgagcacaaaaaaagagaaataattgcaaaattttataaaataaaagagaaaataaaggaaaaaggaatanaatattcaaaaaaaga

SEQ ID NO: 40967 - DNA, 956 bp, Heterodera glycines
tcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattattttttttaaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaagtgctgagaacccttcaaatgcttataaattttcttagaattttttgcctggaggaacacagttcttcacacttaccacaccagcattatttttttttaattattttttgcatttgatcacccaacgttctagactgatcagaagctcaccaaattttgcagggaaactgctgagaacccttcaatgcttataattttcttagaattttttgcctggaggaacacagttcttcacact

SEQ ID NO: 40968 - DNA, 945 bp, Heterodera glycines
ttgctcatctggacctgaacccatgcttaaaaatttttctccggacttttttttgtccaggaaattcagacccaagtctttttttcaaaatgtgtcgaactctaattacataattataaatctacatatatgtatgtatgtatgacttgactctaaacatgtgccgacgttttgcgcccccgggcatttgctcctatgcccaactgtttgaaaatgtactgtatttagtttcaacaattctgtaaataacgcggcggcccttttgacagtcatcgccatttgaatggtggcggcggccgaattttgtcgagcaaattaccaaatctaaaaattccccgtttgtaatgggcggggggggggggcaatggcaatgctttgatgacattaccatctatcggtccctctctctttctgtgcccttctcccttcctttttctctgcccgagttctctctcttcccctctcccttctctctttctttctctcacctcgtccttttcctctctctctctgtgtctctctcgctcgctctgtatctcatttttcttttatccataaatcctctctatccctgagctctctctctcttcccctctcacctcctctctctctctctccctctgagtcatctcatctctgctcaatctctattgcattatctctgctctttgcacccccccgggcgatgacattcttatctcctccccctctgcccccgttttgttgcatttcttgacctttcttattcccaccgacacatttctttcgtcagtgtgtcatacagaacaaacatttttgttgacaaattaaatacatactgtttgggctatagcagaacagcaaagttgaataaaatgcaaaaatggagaacgagcagcagctcgcccccccccccccccccccagggactgtccgagggacgacactcaattcgtactaggccaa

SEQ ID NO: 40969 - DNA, 929 bp, Heterodera glycines
tggtgaacgggagaacgcgagtggcgacgactccgccgacgcggcgacggcgttcgtgtgcgtcgacgacgttcactgtctcgcggcttggaagtgccctttggaacattttcagccacattggtttgcccggcagtcgccgttgctgtcgcttcgacctctgttaatcgcgaatatgaaaattgaaaggcaataaatgattccacctgtacacctcaaaggtgtacttgcttctttcgtcttctccgtaggcgcctttgtttgcaccgtttgccgcttttccaccaccggggtaacagtcactgacggtgcattactgacggcggctgattgtgaggcgccgtcctccaattggaccatcccgtcaaaatgcaccgcatccaatagttgccttttcgcgtgttccaaagagcgcgcaattgtctctcttcgattatctttgttcttttccgtgtacatttcaattattgccgtcaaatatttgtccaatgcttctccattaggccatttcgggttgttatttcgtttgtaaataacgtttaaatcgtaaatttcgtaagccggagtttccttttttggccttttgtccctatttttttcggtctctctgtcctcctccaatgccctcttcacgtccaaatattcgcactccctctcctcaaagtcgtaaattggtattccgctttgattattctccgtttcacatcccttcaaggttctcgcaaataaacggcggatatttttgtgcttttcggccacttccaattcggcagtgatctgcgcttgcaattcgggaatgatcgccgggcgatgtttgtgctgaaccaacattaacaatagcagtttatcatctaaacaacacaaacatttaaaagccaaattaccatgaaataaaaaaggtgggagaatgatcggatgtgacactccaa

SEQ ID NO: 40970 - DNA, 1531 bp, Heterodera glycines
tacccatttcacttccgtttatttgttgctattactttttttttttttgttaattacataatcattaattaacaaaaatgaaagaaaacaatttttaattactaaattaattttttggattaaatgttttttcgactatttgtattaaatctgaatacgaacgatgaagttcaagagtcttggttttgtacaaaaatttttggccttgaccacgagggtgaagtttttcacaaaaaaatcatgcccaaactaattttttacttttaatttttattaaattggtctttgggaaggaattatatatttaaatttttatgagaatttaaatttgtccggaacccggcgggtttttgttaattaataaggttcttaagttttttcaaatttataaatttttcttcctacaattttattaattattttatcaccaaatgtaattcaaataatatttatttattttttccaatataaaagtaaataaaaaaaaccaaattaacaaatcaaaatgaatcatcaaaaacaaaacaaaaaatgcattttccgtcccattcattccgcggattgagcagcgaataattaattcattcctttcacaaccataaattatttttattataatgttaatcatttatttgtccacataactctcatcagaaaactgctgctttataaatatttaaaataaaaataattatttttgaatttaaaatgaaataaaaatttagccagaaatgagtgaaaaatcccatcatttgttgaactgcttcattggcctgctggcgatgatgcttttcatcagcggaggcaaagcacaagagcaaacaacaccgtaagaagacaaaatgccagataaataaaaatgcaaatatttggacaataattagtgtcctcaattaagccccttgggcacatttttaaatgtttttaaatagtggccctgaatcttgagacaaacatggggcaagggacaagggccagaatttttagaaaaattcaggaaaaccctttttgcttggaaaccctggcattttccgaaaaaccgtagcgttaaatgccaaaaaaatttcaaaattatataaatttccaaaaaaatagcattcgtctgactggtggtgacacctctatgttctccattccaattgccacggtggaccaatgcatgccgcatgaagaatggaatacttttggcatcgaatttcgcctgccaaaacagggaggacactgtgatgaagggtacggtagatcagtggtagaaaattttcaattaaatttcggaaattcacagtatgctcatctgttacccgagcacattggcctaccatgatgtgaacaccgtccacacggttgacgaatttgcagtgcgctctgagctgtacaacctccgcaacatggtcaacaaataggggaaattttagtgacaaaattaaaaaacaaatttgaatttttgaaattaactttttcggtttttgaatttacggtttaaacgtgttgattttcaaaaaaccaatgttttctgatgaaaaattataag

SEQ ID NO: 40971 - DNA, 1305 bp, Heterodera glycines
  misc_feature (1243)..(1243): n is a, c, g, or t
gtcaaactggcacttgactcactgtacgagcctttgaaaactttttatgccactccggttgttgtgcaaaacaaagcaacggaagtgcaaattttggcgcaacttctcagtgactctccactttctcgatcggtgtgtgggcaaacaggggcacttgtactttaaaaacaatgataacatctcagattttgcaaataatcgttgaaggcgcagaccgactccgggagaatgcaccggtcaatccctcaagggatgatgcgactttttctgcaattcgcctcttttacatggcaatttctcatcggactgcaatggccgatgccattcgaatggccaattccgaccttatggttgtgtctgtggagtctcttctcttctccgtcattccccactcgcgccgttccaatatcagttacctttctctgctgttccattatcttagtgaagtaacggactgttcgccttttgtttatcttgttcatttttcagtttgaccatttgtctcgtcactctttctacgtttggctgattataaaagaagcggctgctcaaaggccttctgtgcagttgcgtattgtccaggctttgttgccacgacgtgctcagcttatcacttctgcggccaatctatccgccgtcttcgctcccgacgatatttctatttccatcgtcgatttgcttcctaaatccattgaacaaagctcttctgaccgattgcggggccaactttgtcgattgatgttcgaagtgttcaatgattccatggagtcggacccgaacacgccgaacatcgcttacgctctgatgaacttcgacctcagcaacattccatccactgttctcgacattccaagtctgttagttccattgaacattttccattattcgctagtttagaagagtcgagtgagggcctcactgtccttcacaatttgatattcatagccgagcaattcgcaatttccgatgatccttttgtccatcccttttcggggctgtacgactctgtacttcgtcttctggtcagttttgttccattcttttacactaatctccaacttaagtaccgtctttgctccattagggctgtttcttccgccattttgcttcgttttcttcgttctcagtacgatctcatttatcgtcttgcgaattcttctattttttgctcaattggtcttccaacttcggttaatccatctacaaatgatacattttcttcgtcattcttgcaaaactttgnggatgaaagcgtgctccttgaaagtgtccataaaacggaacaggttctgtccattttccttt

SEQ ID NO: 40972 - DNA, 1279 bp, Heterodera glycines
  misc_feature (32)..(33): n is a, c, g, or t
  misc_feature (63)..(63): n is a, c, g, or t
  misc_feature (1201)..(1201): n is a, c, g, or t
  misc_feature (1205)..(1205): n is a, c, g, or t
  misc_feature (1259)..(1259): n is a, c, g, or t
aaaaatacttatgaattattttgcaaaaatannataagtaatgaaaaagtcagaattttgaanaatttaaaaacaacaagcgttggcatttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctgaaaaaatatttatgaattaattttgcaaaataataaataagtaatgaaaaagtcagaattttgaaaaattttaaaaacaacaagcgttggcattttttcaggttaagttagtcctttacaatggagaaggcctgcaaaatttggagagattatatagattttagtgcgctaggttcgatgaaactttttaaaatataagcctaaactttttggcctgtttaaaaaggaattaaaaatttttaaaaaatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaatataagcctanactntttttggctgttaaaaaggaattaaaaatttttaaaaattttaattcatctccncctttgatagaaaaagcatc

SEQ ID NO: 40973 - DNA, 947 bp, Heterodera glycines
atcagcgatttgtactgaaacggcgccaatttgggggacggacaataggtactgaatcggctgacctttctgtgttcttccaacacgtccaattcactcggcttcaattcgtaaacgccaaacatcacattgtaattgattttgctgatgctcaccgttttgtctatttttaaaattaattttaattatttattttaataaaatcaattgctttttaaaagttcaaactgaaattttcaaaaaatgagaaatgttcaaaaagaatgattcgattgaaaacaataaatattgccatagactaaattttttacccaaataatcgacgagttcttcgtaaacggttctatccctgagggcgtatttgaaaatgaaaacggaggagaaaagaatggccatgctgacagcgatcacgaacagaataccaatggattcgcgtacatttcccatttgattcttttgctgtgtgaggaatgtgaaatcagtctcacaatcagtgatgagtgattcattcattaaggcaatttaatgggcaaacattttaaaaacgcatttccatgggactgggaaattaattaaatttatggggcattcaaaagttctgaggcatttttgaacttgtcacaactttttttttctttatggcatattcaattttaaattcaccatctttgatttattattgcgtgtatttgcctcttttttgggtccgccgtcgacatttgaggaagggacagttacgccccgcgggggaattggcggcgacggatcggcggatgggccaccgaacgcacttagcattaattaagagagaatgttcagtcttaaataaatacaaaagttagccgaaacaaaggcaccaattggaaagaaaatgccaaaaaagaggagattgaaaagccaaaattggatttgaggagaagaaaaagtgaccttaagcttaaaaaggg

SEQ ID NO: 40974 - DNA, 1187 bp, Heterodera glycines
  misc_feature (41)..(42): n is a, c, g, or t
  misc_feature (59)..(59): n is a, c, g, or t
  misc_feature (70)..(70): n is a, c, g, or t
aaaataattcattacccaaaagtttttttacaccacttatnngccaatctaatttctgncagatgaaagnccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccttacacaagttttttacaaccacttattgccaatttaatttcttgcagatttaaagccattgcctgccggttctcggcacagcaaagcactaatagggtgtttgactcacttcaaaaaataattcattacacaaaagttttttacaaccacttattgccaatttaatttcttgcagattgaaagccatccattgcctgccggttctcggcacagcaaagcactaatagggtgtttgactaacttcaaaaaataattcattaccaaaagttttttacaaccacttattgccaatctaatttcttgcagatttaaagctatccattgcctgccggttctcggcacagcaaagcactaatagggtgtttgattcacttcaaaaaataattccttacacaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgattcacttcaaaaaataattccttacacaaaagttttttacaaccacttattgccaatctaatttcttgcagatttaaagccatccattgcctgccggttctcggcacagcaaagcactaatacggtgtttgactcacttcaaaaaataattcattacacaaaagttttttacaaccacatattgcaaatctaattttcttgcagattgaaaagccatccattgcctgccgggtctcggcacagcaagcactaatagggggttttgactcacttcaaaaa

SEQ ID NO: 40975 - DNA, 992 bp, Heterodera glycines
accgatgcgcccagatttatgggggagaccgaatccttcttggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcgggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcagggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaatcgatttttttgttttcggggcagtccccccgaaacgat

SEQ ID NO: 40976 - DNA, 892 bp, Heterodera glycines
attaataattaaatgggcaatgtaaattttatgattattctctctgagataatcacaatcaattctaaataattaattaactttcgatcgaaaagactgtcctgtccacaactacacggaatgccactcttcaccgatttaaagggtataattgtatttatcacaatcacttctaaacaatctatccaaatgaaatatttaattaaaataaaaccaaaaaacaaattataaattttcacacaaaaattttcaaaaataaattaattaaaaacaaaattattctataatattcaaacatacgcggcgaaccaaaactttgctagaatctaaatatatattgcaataataaataatgcttaaaatttaataaaagctatatattataatacaaaaaggagatgttaataaatttaaaaaaagttttttcgtattggtattataaacaactaacttaaagagaaaaaaactattaaatttttctttaatcaccacttcagtaattactgagaggcatgataactagagatcggaccggtcggtttttttcgattttcggtttcggtttttaaccgaaaaaaaccgaccgagaaatttttgagtttttcggttttttcggtttcggttttttcggttttttaacagaaatcgttcgacccaaataattaaaaaccgaaacaatcgaccgacttttttgacaaatcagatgccattttttttaacaaaattcttaaaattttcctccggcggcgcctaacggcaccgccgaccccccaaaaagctatcttttcttaaaaaattagctcgaaatctcaaaatttggtatttttatacaaaatcttctaacaaatagcattaaaattacaaaaaaatttcccggcggcgcttatcagca

SEQ ID NO: 40977 - DNA, 1289 bp, Heterodera glycines
ttaattctgcgttggatttttgctccccataattgtcctactaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaagtttaggcactctgatgctttttctatcaaaaagggagatgaataaaatttttaaaaatttttaattcctttttaaacaggccaaaaagtttaggcttaacttttttttcagaaactgatcagaagcgcaccaaacattgcagggatactgaaaggaagagaaataacctgttttatcacattagcttgtcatcagtttttataaaaaattttcaaaattctgagtctcctattattttatttatttttcaaaattttgaagggcggggggggggggcgaaggcccaccacgaggccccgaagaggccgagtgagtaccttcggtgcaggaaaattattaaattttaaaaattttttaattcgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttcttcagaaactgatcagaagcgcaccaaactttgcagggatactgaaaggaagagaaataacctattt

SEQ ID NO: 40978 - DNA, 1285 bp, Heterodera glycines
gtcatgattcacgtgttaattcaaaatcatgatttccttcttaatttacggtcatgattcacgtgttaattcacggtcatgtacgtttaattttcagtcattattcacatgtcaatttacgggttaaatcacgtgtcaattcacggtcatgattcacgtgttaattcaaaatcatgatttacgtgttaatacacggtcatgagttacgtgttaattcacgatcatgatttacgtgttaatacatggtcatgattcacgtgttaattcaaaatcatgatttacgtgttaatttacggtcatgtaagtttaacttacagtcattattcacgtgtcaatttaggggttaattcacgtgacaattcacagtcatgatttacgtgttaatacacggtcatgattcacgtgttaattcacggtcatgtacgtttaattttcagtcattattcacgtgtcaatttacgggttaaatcacgtgtcaattcacgctcattattcacatgtcaatttacgggttaaatcacgtgtcaattcacggtcatgagttacgtgttaattcacgatcatgatttacgtgttaatacacggtcatgattcacgtgttaatacacggtcatgattcacgtgttaattcaaaatcatgatttacgtgttaatttacggtcatgattcacgtgttaattcacggtcatgtacgttaaatttacagtcattattcacgtgtctatttacgggttaaatcacgtgtttcactgtcatgattcacgtgctcaatcaggggcgaattaaaggtaacggtcataattcactatccataattaattagtccaaattaaagttgataaataattgaagactctaatacatcaaatttaaaagaattaaattaaaaggcatgaaatatatatatatatatatatataaattagtcataaattaatagtatgaataaataaatgaatgaagaacacccaaaattaacgcacatataattcaaaatattaaaaaaaattcaaaaatgtctttttaaaattatgatataaaaattaatctattcataaaatcaaccaaaaaaagtcatttttttaaattttgttttgtactaaaatgaatgaataaaatgctttttaaacttgagaatcgcataaagatgatggaatttattttttaaaggattaaaatatactaatgaatttaaatatattttttatttaaattttattcaaaaaaaattatcgtctaaaaaaatttaattaaaatctaatttaatatactttttaatttaaaa

SEQ ID NO: 40979 - DNA, 955 bp, Heterodera glycines
  misc_feature (62)..(62): n is a, c, g, or t
  misc_feature (74)..(74): n is a, c, g, or t
  misc_feature (83)..(83): n is a, c, g, or t
  misc_feature (88)..(89): n is a, c, g, or t
  misc_feature (101)..(101): n is a, c, g, or t
  misc_feature (117)..(117): n is a, c, g, or t
  misc_feature (125)..(125): n is a, c, g, or t
  misc_feature (128)..(128): n is a, c, g, or t
  misc_feature (134)..(135): n is a, c, g, or t
  misc_feature (139)..(139): n is a, c, g, or t
  misc_feature (146)..(151): n is a, c, g, or t
  misc_feature (155)..(155): n is a, c, g, or t
  misc_feature (184)..(185): n is a, c, g, or t
  misc_feature (199)..(199): n is a, c, g, or t
  misc_feature (203)..(203): n is a, c, g, or t
  misc_feature (211)..(211): n is a, c, g, or t
  misc_feature (215)..(216): n is a, c, g, or t
  misc_feature (226)..(227): n is a, c, g, or t
  misc_feature (252)..(253): n is a, c, g, or t
  misc_feature (265)..(265): n is a, c, g, or t
  misc_feature (289)..(289): n is a, c, g, or t
  misc_feature (292)..(292): n is a, c, g, or t
  misc_feature (298)..(299): n is a, c, g, or t
  misc_feature (303)..(303): n is a, c, g, or t
  misc_feature (310)..(315): n is a, c, g, or t
  misc_feature (319)..(319): n is a, c, g, or t
  misc_feature (353)..(353): n is a, c, g, or t
  misc_feature (363)..(363): n is a, c, g, or t
  misc_feature (373)..(373): n is a, c, g, or t
  misc_feature (375)..(375): n is a, c, g, or t
  misc_feature (404)..(404): n is a, c, g, or t
  misc_feature (411)..(411): n is a, c, g, or t
  misc_feature (416)..(416): n is a, c, g, or t
  misc_feature (429)..(429): n is a, c, g, or t
  misc_feature (445)..(445): n is a, c, g, or t
  misc_feature (467)..(467): n is a, c, g, or t
  misc_feature (475)..(478): n is a, c, g, or t
  misc_feature (483)..(483): n is a, c, g, or t
  misc_feature (518)..(518): n is a, c, g, or t
  misc_feature (895)..(895): n is a, c, g, or t
  misc_feature (905)..(905): n is a, c, g, or t
  misc_feature (909)..(909): n is a, c, g, or t
tttcggggcagtccccccgaaccgatgcgcccagatttatggggagaccgaatccttcgggnatcgcttccctntagcctgtnctttnnttctgcgttggntttttgctccccatanttgtttgngtncccccnncggncccttgnnnnnntcgntttttttgttttcggggcagtccccccgnnccgatgcgcccggntttntggggcgnccgnntccttcgggnnttgcttccctgttgcctgtgctttnnttctgcgttggntttttgctccccttggttgtttgngtncccccnncggncccttgnnnnnntcgntttttttgttttcggggccgtccccccgggccgntgcgccctgntttgtggggngnccggtcccttccggcgtggcttccctgtngcctgtnctttngttctgcgttggntttttgctccccgtgnttgtttgtgttcccctgccggncccttggnnnnttcgntttttttgttttcggggcagtccccccggtccggntgcgcccgggtttttgggggggcctgttccttccggcgttgcttccctctggcctgttctttctttctgcgttggttttttgctccccttgtttgtttgggtccccctctcggtcccttggcggtgtcggtttttttgttttcggggcggtccccccgccccgctgcgccctgttttttggggcgtccgtgtccttcgggtgttgcttccctgttgcctgtcctttgcttctgcgttggctttttgctccccctttgtgtttgtgtgccccggtcggccccttggggcgctcggtttttttgtttcgtctctgtttttttcggcgtgtgctctttggcgctcctgcttttctttaaaagttggttttcgcgctctgntgcttttgtntcgngcagtgagaaaaagaaaaaattttttaaacaaatttttcctttata

SEQ ID NO: 40980 - DNA, 1370 bp, Heterodera glycines
caaaagtaaaatcttgatcacgtattcgtgatcagcgccctttaagacccctaaagaatatttttggaagatttttgtgccaaaaatttttccactcaaaaaccatgtgcttccccctttggtcccgaatcccaaaatcacttttatttttgtatctttttttaaaaatgtgataaaaatgtaaaataaaatttatattatagagaaaaaaattgcggttttttgtagtttattacttttacagaatgacttttcagaagcgagttctgaatttttttctgaaaaatctaaaattttcagaatttctggaataacttctttcatattgattttagaaaacccaaataaattccataaaattctcctgatttttctctatttttaaagctttatttactcaaaattggtcaacccttaggctagatatgaatttttcaatattcgcccaaaatcccgtgggccaaaaaattggaaaatatttttgaatttttaaaaaattccaaaaattttgaaacgaaaaataaacatcatattcgtgctcagcacatcaaaataccccagaaaaatatttttgacccccattttcaacccaaaaaaaattttcgaaaatttctagggggcctagctcgaaaatttttgaaaatttccgaacatttagtacaccattcgatagaactttaaaagctctacaattttgcccttgggcaatttttggctataaccaacccccgacgagttatgggcccgggactcaaatgtcccgctgaggccaaaatttttttctatttccgtgaaaaaatcgaaatttttctaaaaataccaccaatcgatagagctcgaaaaacggttgcttgaaagtggtctccgttttcccgggaaaaatcgttaaaaaatcttaaaattcaaaaaccaaaaaatcgttttttaggcctagctcgaaaatttttgaaaattttcgaaattttaaaatttgcaaaaatcgagctcattgagctctacaataagtctgctggcgccccctggcttagatcaaacccgggcgtgctattcgcctggtactgaagtgtccaaaaaaagtgattcttacgttgcctaacctacaggtcaggcctttgatctgatcgaaaaatttttgctggcaaagttgtaggccatagttggggcatttcgcttttggggtccgctaagctctgaaagcaaaagcaaaaaatttcgtaacactgagactggcggcaaagtcagttttcgagccgctgggactcagttggcgaccggaccggaaaatccgtatttttcccagatgcgccgtctcgagctacccccctgtgcaaaatttcagccccctagctattcccgttcccgagattttg

SEQ ID NO: 40981 - DNA, 347 bp, Heterodera glycines
tttttgcataattaattcataaatattttccaacccagggctctgaaacgcaccaaattttatttacatgctcttttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaaggggcggggggggg

SEQ ID NO: 40982 - DNA, 1282 bp, Heterodera glycines
acaacattttggcgcagtcagcgaagctaattaaatttctgctcttaattttcccagtcttaggccattttttctttcatttccatccatttttggcacaactcaaggcccccttcccgtaacactctgtgcggaattccatctcactgcgagctctgtgaacacccgcacagtttaaagtggtttggaacgcgttgaggtggaccgagaagccaaaatacgtgcagccactccactgcgcattcctcaaaattcgccgagggttgaaagccatatcattcgctccattcattcatcaccattgacctcggactgtgcaatcaataaataaacataaaaaaaaggcccaccgctgacttgcacacattcattcaattcacacaaagttctatctttttttttttttctttgaaatctctgtcaattcacatcatcaccatggcaagtcaagcggaaatggcaaatttatttcggcaattaacggatgccctccaaaacattgcaacccaaacaaacccaaacccgaataaacaaaattccgacctattcactacaattaattcacaattgtctgagtttgtgtataatccggaaacggattctacatttgacatttggcatgatcggtttggcgctttcatcgagaaggacggacagcaaatgccagacgacatgaaaacgcggttacttttgggtaaaatgagttcacaggattacgcgaggtattctgagagtattttgccacaaaaaccaacaagtcggacaaagaacgtggcgatcaaattcgaagcaattgtcgaggagtgccgcaccattttgtcacttcgtagtgcagcggcagctctggaacaacccggccaaagtttcaatgccaatgcaattgctttaaaaccccaacaggcaaaagagcgacatagtcggcatcaaaagttcagtccttcatcacgccgtgaaaacagcggaaatcagtcccgctctccatcattgaacattcgccgatcatcaaattcgcgtccaccgttcccctgcaagtggtgcggcgcaaaccattggaacagcgagtgtgataaacggcgaccaaagtgtttcaagtgcaaccgaatcggtcatgtgaagcgcgattgccgagtgaaacagaggtcaaacagcaacaacgactcaatgtcggtgatgagtgtcggagacagcctcgacggctggatttcggtcaaatgcagcataaacggcagacctgtcgaactttgtgcagactccgccgcacgcaaaacatcattcaggagtc

SEQ ID NO: 40983 - DNA, 908 bp, Heterodera glycines
acagaggcgtcaattgtcatcgaatagtcctttccataaggaagtactgcttggagtcgtcgctgtccggtgttgtcaccgtcgccattcgccggtaatttgggccggtgacgcggggacagaaatttggcaaatttcaacaaacgacaaaatgtcgatgtgcttttgctccattctgttcgacgaatacatccatttagtaaaatttcacttagattgcgtgacggtgtgctaatgatgccaatttccgccaatgtggccaccataatgaacgaatatttggccaaaaaggacccccggctgaaaggcgtcgtttctctgaatgggcccaatgttttgctgaagagcaaaggcatttgccactttcaggtcacactccctccctcccatctgtcaaattcgtccaattgacctctgtttctgctggttaagttcgccgtcaaacagtacgtcgagctgaacgaagcgaatcagaaccaaaggaaggattacagcggagagatggcacggctgaacatgagcacgacgaacacggcacaacaccacaacacgacggtggggcagtatcagtacaggaagtagcgaatggcacgacggaatgccgaaaaggccaaagaaatgggagaacgaacggacggaaggcaaccaaaacgccgatggtctcacccgaaattgcgataataaacttaattaattattgatcgagtcgattgactctttgtcgagcgtttgtccctccggcgatcattcgcgaatcggtgactttatcttttggtttattatcgatcgaatcgattcgtttgggaatgattggccttctccactgattagaccggaccgtcttttagaatttgttttcggatgcgtcctcttaaatttaatttatttccttccatttttttgttgtt

SEQ ID NO: 40984 - DNA, 1013 bp, Heterodera glycines
ttccagtggggtaccttaacattcatttgtttctgtacaagtgtttccctgccggcagattgagcgaaaatcgttggcttaatcccaaacgactagtgccaaccagggatggcacggaatttcgatttccgacctttttgtggcctcggaatgccatccctagtgccaaccgtacacgacgtacttgtccacgcattgttcatggcctttgatgctcaagtatttgggcggcaacgccgacactctcttggtgattccggtgaaggtcggcacatcgccgaaggcgaacgacgcctccttcagcacctcaggatccgtggtcatcttcaggctgttgcgcagctcatccgacatttccgcttgcagctgcttcactttgtccagcttctgcttcggcgtcttgtaggtgttctcgtaggcgtcgaacactttcttcatggccttcctcccctccaaatttgcatgagagtacgtgacaaagtcgtccgtcactttccgcagctgtaccactgaatcgtcgatagattctctaacgaggtcctaaacaatagaaatcggctcgtccacccaacaattggttttaccttcataaactgatcgtctgcgctgattgcatccaaaagtgtgtcttcctggtccaccgggctcagatccttgaagccaggcttctccgccacttctctcagctgtttcttcaccttttccacaagctcgtcaataggggtgctctgcaggactttgaactcgttcaccgctgccgggtttggtgccggctcgtctttgccataggcggcctcacgcttccgttttttgcccaagtcgcagatcacggtgtggaacaatttgcagccagtatcaaaagcaaatttgccaatgtcgatcagatcaccgatgaagcgacgtttgcgaagggcaacacgatcggaccgagctgttctcaaactgaaattcaaaaacgaattcgcacaggcacggcactgagttgatgcgtaccctgtttcagcatcggcatt

SEQ ID NO: 40985 - DNA, 1060 bp, Heterodera glycines
aattatataaaatatgtaaattaaaagggtttaaaacacgttaataaattttttgaacagcgggtcaacttttttgaaaaaatttgtccaaagcccacgcctacaaatgactatttcactgggccgggttgtcgcgcactttaaaacagctctacagggtccggctctgctcgagctgcttgactctactaattaataaaaaagaatgtttctttgatcaaataaacttttgactattcccaaatcgatttccgatccccgacacgataatttctaaaggtagcaactctaatcttatatcaaaaacattttaaaaagataaaagttgtgttttcaaagtttaattataaaaattatattgcttttttgattttgcttataaattatatttttggtttatccgtaaatcatttcttttttattgtaaggagaaattatttcaatatttttttgatattagattaatccatttcagaatttatttgcagagagtgatctgtaacctttcattttaaaaatcacttttaatgacgcaagaaagggtaaccaaaattggaattggtttgtgtaaaaggggcatcagttggtcattaattagtcacaaaccaaagtgagggtggaatagtcacccaaagtgagggtggaactggagtgttaataattaattagatgcgcccaattggatgaacataattttatgcaaaaagaaaattttaaaattcacaaaaaagcaacaaaaggcacgcaaaggcagcgcgccgaaattatgaaggaccaaaatattagcattgacaaatgaataaattatctgtttgccaatggtttcccttttgctcctctctcaagggtaaaatgtcgccttatatggccagtctctgtgcgagtttctttggcgcgaggctgttaaaaaccgtgaagttgatccatttgaaaacattttggagcaaattgtggcttttatgcctctttcataatttcggcgcgctgcctttgcaatttgcgtgccctttgttgctttttaaaaaaaatttattttgcggacacataacaggaaagtacc

SEQ ID NO: 40986 - DNA, 1209 bp, Heterodera glycines
ttcagtgttcctctttcggacgagggcatggcttacgacacttatcgcgcgagcagtcttccaacccgaaattgcagtactcaggacattccacattgcccgcccgatcctccggtttgcacgtgctttggcattccaaaaactctttgccgcactggtggcagcaaacggagctaaaaaataaaaataaatttttaaaattaaaaattccaaaaatttatcgaacaaagaaagacttgaaatttaaattcacttggcctccgatttaattagggccaattaaattacacataatccaaattttttcaatcatctcatcttttccgaaaagataattaaactgaatcaatccaaatgaatgctgaaaccccaaaaaaatattaaacattgtagataatgttgtttttttatatgttaaattattttttacaaatttctattttaaattatttttaaaatttatatcgaattttatttttcaaaattttacggttcctccaaactgcacacaatgccaaacatgctcagaaaggccaacgccaacaaaattaattttgccataatgaatacgattgttggttgttttaactgtaaaacaaataaaattaattttatttttattttgtttattatattattttattttataaaaagaattccaatgaattgacattactgaaaacagaatatttatttggttagcacagatagtttctcgcttgtcgtgtgatatgtggaaaactatgtgaaatgtgaagagcaatcattgcataatggaatttatgttaatttattttttcctcaaaataatataaatagtttaatttaattctatgcattctttttttattgtaacaaaagaagtcaatttgaagatatcaaattaattgttaaataattaacacctaattgacatttttaattgaagaaatttaaaataataaccagacctaccaatacaattgacaaaatctaaccgtaaatttttcgtttgtagtcaattttttaagaattaatcaaaaatttatgataatgcaaaaaattgaaacaaatggtaaaagagtctttctatgggttttcggatttattttactcaaattctaacattaaacttagattcgaaaacccccaaataatgcttttccttttaataaatcttttcctcaaaaaattgtaattttaaaggctaaaaccacaaatcgggggaca

SEQ ID NO: 40987 - DNA, 1419 bp, Heterodera glycines
  misc_feature (67)..(67): n is a, c, g, or t
atgtgcgtttttcttattttttcaggatcaatgcccactgtgttgatctatccgattgatgcgcacnaaaaattggatgaacaggtgaaatgtttgctcaaacgtgcctctggcgacgtgtcgtccacgacaaagaaattgaaggcgcaggtgagcgggcaaatacttttaaccaaaattaatcacttgtataacttttcatgtttttctatatttttgctaattaacctccctccccccttctctaaaaggatgccattctcgaagcattggagaccatcgaaggcacttccttccaatacatgaagcgcgaccaaattgcacgtctgatgaccaacaaaggcattttattggctcggatggaaaagtagaaaagataaaattaaaaacaaaatttaagatttttgcccgtttcagacgcgacgaggcgggccgtgccttctctgcagctgcacaactcgagctgagcgacacggccatgccatcgtcattcgcttccgtgtggaagcattgggccaattttctgggcaatctttacctggctaaccagtgagtttacttcacttttttcaatgagttttgattaattttaagacgttgctatttgaatttaaatttaaaaataaaataaatttttgaaaaattttcatagcagattttaaaatttatgataaattattaacaatgcaattaaaaaatttcaaaattcaccactttagctctgagagttcagcactgagcaccggtgtgcaggccatggcgtccactttggagcacatttcgatggtcggtgcgcaaaagtcgcgcacttctgtggccaaattgttgtggctgctcaaaattgcctccgcatgcccttccgaaaagctgatgaatgccgtggatgagctgctgttccgctacgtggacaccattcagccggcgaattggcttttttggtgggaatggcacattttaaaatgggcactgttttctcttaatttgcactaaatccaggttgaacgaactgatcactgatgttcaacagcggaggggtaacgcgatggccgagattctaaagcgagtcggtctcctgcagccgcaagaagtgttctgcgcattgcgcgtcgaacttgggccaagccatgttggccgttacatccaacaatgttcgtaagacattcctcggagtgttttttccattcaattttctatgaatctttggaagtgtcctaaaatttgagaaactctgtcgatacgagaacgaaaaaaaagcggaatttctttttctccctatttttttttgcgatattttttatttgaaaaattttaaaaacgtaattttgataatgaagcccggtcccgctcttctcttaaaaactgaacttttaaattggagaaaattcttttattttattttttaatcattttttgttttaa

SEQ ID NO: 40988 - DNA, 727 bp, Heterodera glycines
  misc_feature (718)..(718): n is a, c, g, or t
cttattatactctaggtgctaggctttttcgtaaaaatccccgttaatatttggcataaaccatggcacaaaaccaaccaaatcaaatgttaccaaaaattcaatttaatttggttttgagcattgatttgtttcttaattttaaaggatttggcacagcccatcaaactgttgaaaaatacttaaaattatggatgttttaattttcaaaaattgtaaaagttttcttagaaataagaagagggtacggcgtgagggatgtgcgtgagtctcgcggttcctgtgaattaatactaatgactcatgtaatttctcgggtatttgggctctcgagaatctctggccaattgttcggtgctgattctgggtaaaacaatttttgtccagtccaaagtggcagcaggtgatcgatcctctgatttgacaaatgaaaatgtgtgcgcaaatggaggtcttctcgttgcgcttcaccgacactcactcccgtccattccttctcctcaaatatttgtttgtcgagagtttgtttgtttttcctgcccccctccccccccagtttctcccggtgattaattattgttgggctgacctttgctcattgccgtttcgaccgcctattcgggaacgttcatttctcgagaataaaggccaaccaaccagagcgagtggggggggggggggggtggaatgaataattttagaaaattcattttccaantgtatcatt

SEQ ID NO: 40989 - DNA, 887 bp, Heterodera glycines
attgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgcttttttatcaaaagggagatgaataaaatttttaaaaatttttaattcctttttaaacaggccaaaaagtttaggcttatattttaaaaagtttcatcgaacttagcgcactaaaatcaatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgttctgaaacgcaccaaatgttaattaaaagttaaataaggctctctgatgctttttctatcaaagggagatgaataaaatttttaaaaatttttaattcctttttaaacaggccaaaaagtaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttagaacgtgctctgaaacgcaccaaatgttaattaaaagttaaataaggctctctgatgctttttctatcaaagggagatgaataaaatttttaaaaatttttaattcctttttaa

SEQ ID NO: 40990 - DNA, 1762 bp, Heterodera glycines
  misc_feature (1706)..(1706): n is a, c, g, or t
  misc_feature (1741)..(1741): n is a, c, g, or t
atgctatacaaattttaaaaacatttcctaatattcttctctccctgggcatcatttaatcttttcaatattgtcacacttctttgtgatacatgccgacccgatattttgcccgtcttccgcctgttgttctgatgtgccaaccatgtctaataaggtatggtagcaattattttgatgacaaatttgtcatggaatgaattcatcatcattttgtttttcaagtcgtctcccgtgcattgaggacgttgaagccgcttgtcaaaacagtgaattgccccaaaattgtcttgaacgggtgaattttttttatgacaaattaattaattatttacctagcacttttcactaaaacagatgcagttctttctagtagaacaatgggtactatctgggttgtgccagcctgcatgctgcttatgcggcgatggaattctccgttgagaattactgccatcggtccgccagcagggcatggcttattgccagccgaaacactcgcaaattggagcaaattattgtaccgcgacatattccgaacaaactccttcccttcgcggggttgtttgtcgcacacgatgagctcttcaagctcttttgggtgcgggttaagctttggcaaaacaactcttccttgacgacagcaaactctgctgtcctcatgcgggaagagtagtgctccacaatgagagcacttcttgtcaccaagcttaccagaatttgaatatcctggataatgctttgctgctgcggcagcacagcaccaacccttgtgggcaaggtagcaacgctgcgtaaatgcagtgactttctcaacagcctttgctaataagctgcgtctcggtgcgggtgaaggcgaacggctaatcgaagctgattgccgtctgcctatccgcgatgatcgcctcggtggcgtcttcggtctgacaaatattgcatcgtctgcctgcgcaattggctcttgcggtgcgcaagactccgacaccaaaccaagcgtgtcagcttggttttcacctgccacttgggcttgggtgagaatagcattaactgcctgtccactcatctgtggcccgatgatcattatgtcatcttcttcatcaatttccattggctcagcggccttggatgtagactgcgcttcatccgcatgtctgtagacaattgggtaaggagttggcaccccttcccttggatgatatggcacattatcagagccatacagctcattgatgtgccacaaaatgcgctttttttcataattgatggataaatctggtagaacaaatgtgcggttgttcataagccatgattcagcatacaggcacacaaagtacccgcagctatttccatcgtgttgggccgtaagattttggacatcaacaatcccggtcaacaatgtggacggcaaaatgtcagaaattatctttctaattttgtccgtcagttgcacatccaatctgccatattgggtaggcaaagagtcggcaaaatgagtaccacattgaacatcatggacaatgagagtccaatgtccagggaaatgtactggcaaaagtataacttctgccggaacattagggtcgtacccaaatgtcatatttttgtaaggcatgactctgtccaggccattgctccataccattgggtcaacaacgaccacttttcgttgtgatatggttgccaagtatgccaagtatgtggcagcnaagccgtcattgagaaactgggtcatatcattccnacaggtctcaatgtatcttgg

SEQ ID NO: 40991 - DNA, 1543 bp, Heterodera glycines
  misc_feature (32)..(32): n is a, c, g, or t
cggtaccggtaccggtactggccggtaatcanccgttttctttggtacgcggtaccggtaccggggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggagtacacacatgcacatgtggtgtagtggttaaactttctatctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaattttttcccggcggcgcctatcggcaccgccggccctccttgtcccccaaaagtcttggaaaaaacgtgccgcgtaaaaagcggtgttgaaagcaaaaaaaaggtcattgatttacattaatttacatggccggagaccccttcacaaaattggaaaattggctgctgaccccttgttttgcaataatctgaattttgaggtctacatctgaattttagtgttctatgtcctgaatttgaaaaaaaaacttggtcaacctgaatatacatatacttctgaacaattctaatgctaaaaaacaggtactcgcgcgaaaactgaataaaaattttgtatttggaaaattttgtccaaaaatttttatgttctaaaattaccggtttttaccggtaccggtacaggttgaaaaagttggtaccggtaccggtaccggcttttttgcaattaccgattaccgctcaactctaattattttcgacagattttattttgtgtaaaatttttgaaatttttgaacatgtcgccaaaaaatgtcatcgcgtcaaaaaaataattttttattgcattttttaaaagaatttgggaattttacatgaaaaattcgaaaaatgctaaaatatttttaaaaaatattgaaaatccaaacccaaacatatttttccgatattttttggaaaatttctcaacaaaaattcaagaaaatcaaaaaatacacccctaagaatcgacttaaaaattttcaaaaaatacactcctaagattgacctaaaatttaaaaaaacttaaaaattggggcaatggtaagtacagttttgtggtttcttcgaaaaattatttaaaaatttaagaaaaacattttctaggctggaaaaatgtgctgatcacgaatctgagctcggattttgcaaaataattgattttatctatgatttttatcaagtactagattttttccaaaattttaagaaattagtcgggcgtaaaaaaacacacaggatgttgtagagctcaaaaaaagctttcgaatgagctattgaatgtatggagaagtcatgtttttagt

SEQ ID NO: 40992 - DNA, 587 bp, Heterodera glycines
ctcattctcatcttacctcttttacccacctctctctccttctttgtctatcctcctactatctctctctctcactcattcttttctttcccctttcttcttctctactttgtattctttctcatcttctttttcttcttcttttttccctcctccaatcttatctcttttccatcctctttctctctctcctccaaacttccctcagtattctcatcatctctctttcttcctgtatttacaattattattctcttctatgtttttctctctctctcactcatcaccctccggaacgggccaactccgtctgagccaactttgagtcaatataactcttgaagttattgaccgaatccaacaatcttgatatcattcgaaagctcttcacaggctctattagcttactaaaaattatagaaaatttcataaaaaaagatagaaataaatttttgcggttttcaagtgacaacttttttgtgaggtgcttaatcacttcggactagcttagaaatatcttttaaacatttaaagctttcgaatgataccatgtttgataaatttggtcaacaaagaaaaaagttata

SEQ ID NO: 40993 - DNA, 905 bp, Heterodera glycines
ccatttgttccttgacaatcccgatcactcacccttttaattcatttgacctatgacatttgtcccttgccaacccctttcattcactgtctttgtccattagtcccttgacaatcccactcactcactgactttgaccatttgtcctatgccatttgtcccttgccaatcacactcactcactgactttgtccatttgtcccttgccaatcccactcactcactgtctttgtccatttgttctatgccatttgtcccttgccaatcccacccactcactgtctttgtccatttgtcctatgccatttgtcccttgccaatcccactcactcactgtctttgtccatttgtcccttgccaatcccacttactcactgtctttgtcaatttgtcccttgccaatcccacttactcactttcattgtccatttgtcctatgccaatcccactcactcactgtctttgtccatttgtcccttgccaatcccacttactcactttcattgtccatttgtcctatgccaatcccactcactcactgtctttgtccatttgtcccttgccaatcccacttactcactgtctttgtccatttgtcccttgccaatcccactcactcactgtctttgtccatttgtccctttccaatcccactcactcactgtctttgtccatttgtcccttgccaatcccactcactcactgtctttgtccatttgtcctatgccatttgtcccttgccaatcccactcactcactgtctttgtccatttgccccttgccaatccccacttactcactgtctttttccatttgtcccttgccaatcccactcactcactgtctttgtccatttgccccctgccaatcccacttactcaatgtcctttgtccaattgtccctt

SEQ ID NO: 40994 - DNA, 930 bp, Heterodera glycines
tgattgtccgctgcaagtggtacagtttgaccgtgactttgcgtgcctccacgtctcggctgtgcctgctcagcaactgctcacggctcagctgcgcccgttggggcagtggagagcccatcgggggcggttgagagagaacaaccgaaggaggtgcgggacaaacaaagggggaagcgggcggaacactgcgaaagaatgacgggactttggaagagatgacgacaccagcggacggataagccgaaggtggtggggtcggcgaaagaacagctccaaaacgttggtgtgctgacggttggacatggtgaccggataatggttgggatggcggaagattgtgctgttgttgttgaaccttagcacagggaaagatgtttatgtcttaagttaaacgataaggcttatttaaaaataaagtcatttttggtgtattacaataatttgttgtggagcgaaatttgtggccgctggtggcccccctccgcccattgggtgctgttgaagttggtaccgttgcatttgctgttgatgatggtaggactgggattgctgcagttgttgttgtgccgttggtggagtgggtaccgtaaattgatgctgcgggtacatcccgccggaatttgggggagtacactgcagcgtaacaatcgaaggagaagtgacctcgccttcttggcgttggagcagtacggggtgatgaagttgactttggcccggtaatgacgccgtggctggtgatgacgaagtcgatggatgtgctgccggtgattgcgccggaaaataatcaccaccagacacggacggcgacgaatggggtggagggatcggcgagcttccatccatggccatgtgttgctgttgacgagcatattgttgtgggaaattgcgaaagggacgtccattattgtgtccaacgataaagttcca

SEQ ID NO: 40995 - DNA, 1232 bp, Heterodera glycines
aaaaaaataagtgatagtgacacataatttcatcaaaataacaaaaataacgcaaattataaataagtaatgagctaatgattatcaaaaataacaacagtaataaccaaaacaataataatcattcgagctttttcggagaatttgcatcacttcaactgaacttggccaatgaagttttcgacaaactttaaatttacataacattttattccactccccaatcttttttttttgcagaaaggggttagcctgtcattattttttactaaataagaatgttttttgtacgaaacgcaaaattgaaacgttgtacgaaccggcttttgtacgaaactccattgtacgaactgctattgacccggtaaaaatattacaaacatttcatattaacgtcgaaaaaccgacaattataaacattcacacatcattttatcgtaaggaaaaaaccggcaatggcacattacatctgtgttgagcacaagtgcagttagatacattgtgcaccactttgaaatgggctaaatgaaaaacaaaatgaaaacaaaatatgagtgtatataagacgaccccttgagtgtttgaaaatatcgctcagatgacgaaggcgacgaatggccgatgaagggacatttgttgggccagaaaaacggggccgacgatgctgctccgagaagcagtccaacacaaaagcggcactaaacagttgaacagtgataaattttcaaaatatcggcgaagctataagtcctttttaaatgaaatttgataaggagggagatacccccaggaaatttacatttcctttcccatttgcctagggttgtacacatcggagaagggctttgcgccccccccctcccgcaaactttttcgcggtcgaccattttttaaaaattgcttttcaaaccaacttttttacggcgcgcgctttttccaaaaacttttagggattggaaggaggagaggggagatccgttcggtttttcttcaacccttttttctcgaccgccccccccccgcctcgtgcgactgacgctgctgccaggggcgtatctagaaacatttttcgggggggggggggacccaacctgaagaccttttttttttgctatttaaccaataactttttttccactgctgggtaacaactgcactttttcattaaaaatgaccaaattttggccgttttaaggcaaaaaacttgtaaaaatagtggaaaaggtaggtcc

SEQ ID NO: 40996 - DNA, 1072 bp, Heterodera glycines
ttggttttttgaacatttgcatatttataaaaaaataacccccataaattaaaagaaatgaaatgttttaaatctaaacatctaaattattttgtttaatttattaagcaattaatctaaaaatcaaaaatgtcttgaattttgcataaagtgtcctggttttgaaataatgaataaacaggcgaaaattttctaattaacgtcatcaaatttatagattaatattatttcaataatatatattcgatattaaacaaattctgccaaactgagtaatttttttttgataaaattattataattcaaaaagaattcatttaattgtataaattttgaaaatattttaaaaccatttagactgtcattgcataaaaatgaaagtatgcttattaatttcttcatttgcatttttgattaccatcttaattagtaataattatgttggatcagaaaagaaaaaaatggaacaaaaaacatttgacgaaatatttggagaaaaatgggaagaaaaaagaaacgaagaacagaaaaaaagagaaataattggaaaatttaataaaataaaagagaaaattaagcaaaaaggaagaaaatacgcaagaaaagaatggagtaaaattgaaggaaaaatagcaaaaaaattgggcacaaatcgccaatatatttatgaatggatcaaagaattgggattaaatcaaaagaattgctacaaatcaaaaactgaagaagaaaagattgaaattatcaataaattcattgaaatgcaaaatgaatttaagcaaaaaagaaaatattcaagaaaagaatggaacaaaaattatgaagaaatttgtaagaaaatcggagttagccttttcataattaaaaaatggatgaaacaatttggaattagccgaaaaataacggagaaagaaaaaatggagaaaatgaaaatttattggcacataaaaaaagaaaagccgaaaatgagtgacaaagaaattggaaaaatgttgaaaattcatcaaaataccattggcaattggaagaaacaatttgtacacggactaatggaagattgaaaacggatgaa

SEQ ID NO: 40997 - DNA, 959 bp, Heterodera glycines
tgaattaatttattattcttcatttttcccaatgtttacctccgcattcaatgaaaatggttgttctggcggtgccaccgattctctccaacctttccaaaatgggcaaaattcgctgctcgcaaatttcttcaaatcatcattcaccccaatgccattgcaacaattgacagcagccgaaaacggcaccaaacatttggcaaatgatggcgcgacggaaagcgtaagggaacaaccgcggaagagggccaatgcttcttcatcttcgtcggcaggtcggaagggtttattaactgtccaacaaatgttagcgtgcttttcagtctcccacccgaaacaaacggtgccctgccgtccctcgccgtcgtccaatggaccaaaaatgaccagcgcaggtaaagcgcggagggggggggggggaagataaagctatccatccaatgatggaattctatttgtccagctcgaaagcgccaaattaatcacgaaaaagcagccgcaaatggcactggaaaagggcaaacggagggtgggccagcgaattcgtccgtgggtagcaaaacccatcgaaaaagcaacacaaatggaggggaccggcaacaaaatggtggagcaattggtggtggtggtggtgaggcggggaagggcagcttcgacgtcggcatccccaacggcctcggcaatgccaaccctttccgaactgccctatcccatgtgcccatattgctgcctgacatttgccgagacgagcgcatttcgcacgcatttgactgttcacgaggtgctcactttcgtcgattcattgctttttacttaaattagtcggattccttttcagagtgaagtcaccgcttccgcttcttcgccctccgccggtgcaccttttttcggcacaaactctgctgttggcgccgaccgacgccgacacagcgaacggaggcgcggaaacggcaacatcg

SEQ ID NO: 40998 - DNA, 447 bp, Heterodera glycines
aaaaaagctaagaataattaaatgatgttgattattttcgccgtatctttctttagctgttcgaattctcttgttttctcgtattattaccttattcagtctttgtgctttcgaatgataccaaaaagataggagttgttcgaacatgaacaaagctattctaaaaaaccaggtattgttaattgatgcactcataaagtgcaatagaaccaaaaattttttaaaaggctgttacacacaaacataaacttccaaccatttcacagcatcaaactaatttgacagttattaaaaaaatttgaacagaagaaaatgtcaatttcagccgattcaacaaatagtggcgatttttcatctgatgattatggtaatgagaaaaggggaaacggtagaatttaaaatttaaaaggagatattaaattaaatgtgatttaaaattaaaattta

SEQ ID NO: 40999 - DNA, 1327 bp, Heterodera glycines
attttatcaattctactaaataatacagaaaatatgaactataaaattttaataaaagattcaaatctgtaaaaaaggaaaatagtttatctaactattttaaataatatttcactttcttaagcaaaacgagagaatattactaacaaataagcgtataaaatttcctttcacaataatctttttaaattcaaccaaaaaaatgcttctacataattccaaatttaatttttaatttgtaaatattgaaattaaatattgatttattgactcgactcgggaatcaagaacagagaatcttaatgaaattaatttaaatgtattttttgaaaatcaaaaacacataaaaaggataggtcaacctaaatttttgcgcaggagctcaacataaataataataaaaatttgtagttttttagtaaaattatgtttatggtatattcaatctttttgagttttttaaatttgtgctttattggtaaaatatattctaatttatttatggtaatgaaattataattaattttcaatttaaatttaataatcaccttttatttagttgaatggaactttttggggcatctttttgatttcgtttttttatttcttttctgagtaaaataaatattaaaatcattaaatgcttatttattacaatttatttcagttgcaagtttctgaatttaacctagtaaatttgtaagaaaaagcattttattccatcaaaaatattatttccttcataattttttaaaatattgtattttattttgttaatggaattgttcttaattgttttaattcttcataattttatacgatttgtattttttcaaatttaatttattcttattaaattaaattttattatggatataacaaatggcatatctatatgatttattttttatgataaaagacaaagaattaaaaattaaaattaatcaaagtgaattgaatgtacatggatggagtggaagatcaaaaagcacttcgactcatgtctaagaattagagttgagcggtaatcggtaattgcaaaaaaaccggtaccggtactgaccggtactgcaaaaaccggtaccggtaccggtaccaactttttcaaccggtaccggtaccggtaaaaaccggtaattttagaacataaaaatttttggacaaaattttccaaatacaaaatttttattcagttttcgcgcgagtacctgttttttagcattagaattgttcagaagtatatgtatattcaggttgaccaagttttttttttcaaattccggacatagaacactaaaattcagatatagacctcaaaattcagatt

SEQ ID NO: 41000 - DNA, 1410 bp, Heterodera glycines
  misc_feature (46)..(46): n is a, c, g, or t
acgacgacgacgacgacgacgacgacgaagacgatcgaaaaacacngacgtaagtaaagtgatgattgtgtcaatacacatacacacacacacagacgagagagagaaagatctgctgctgatcgggctaagaagcattggcttgccttattattattatgtgctttatcccattttgcaaaaatgtgtaaaaaatatatattttttttttattaattattttaattatacaggtggataaattttttcaaaaacacactctttgataaccgataattttgaaaaaagccaaaaattctcaacaaaaaaactttatatcctaattttaaaagtaattttctttgcgcaatatttttttttaaattatcgattttattaaattaataattacggcttattgaattttatttttcataaattaagatgttttttttgcctttttgtcaaaaatttaattgcttctcattttgccaaattactgcccaatttgttaactcacaattttaactacattaattttttttttaaatttatttatttggttaaaccccgacttttaaaaaatgttgctaaaattctggctttcaaattttccaattactcctcactctgccaatttgctgcctaatttgttgactcacaattcaactccataattaatacatattcataatgattttctttatttaatgaattttttaattagttaatttaataaatcccgcctaggcctctattacttcaaaaaaatcctccaatttttcaaaaattcttgctcccaaattttccaattgctcgtcactcttttttgccaaattactgcccccaaactttttggccccattagttttctctcctctatgaaaattgtatagtagcaagaaagagtttttaaaccagtttttgttgtttatgtgtacaaatatttccgatttttgccatcggctttttttcgcacccaaccaaaaatttttggtttgggtttatttactgtatttgttaagatggccacaaaaatttgttggatactcattaattttacaacaatttttttcacaaattcattcgtcttgcagaaaaaagtttttcatgtaatttttgaaatgtgaaaattttcatttcagaaattttcctatgagaaaattaatattacattttcaaaaaaaaagaactaatgaatttaatttaattatttaagcaattatacttttattaaattcaacagaaaaaagcattttttttttataattaaattaagtttttctaaacaataacatatttaatttaatttaatttaatttttttttactaaattatatttttgcaaattaaacaaaataattttttgtcttataattaaattaagtttttgctagaaagtaattttttttattattattttctaaaaaa

SEQ ID NO: 41001 - DNA, 1065 bp, Heterodera glycines
gaatttcggcgccataatgcaccaagggacaccaaacgtgccaacagtgtcgaacaacggaacatcgtttggacgaatagcacctccgggaatttcggacggcacaatgcaccaaggcataccaaatgtgccaacagtgtcgaacaacggaacatcgtttgggcgagtggcacctccgggaatttcggacggcacaatgaaccaagggataccaaatgtgccaacagtgtcgaacaacggaacatcgtttggacgaataacgcctcagggaatttccgacggcataatgcaccaagggacaccaaacgtgccaacagtgtcgaacaacggaacatcgtttggacgaataacacctcagggaatttcggacggcataatgcaccaagggacaccaaacgtgccaacagtgtcgaacaacggaacatcgtttgggcgagtggcacctccgggaatttcggacggcacaatgaaccaagggataccaaatgtgccaacagtgtcgaacaacggaacatcgtttggacgaataacacctcagggaatttcggacggcataatgcaccaagggacaccaaacgtgccaacagtgtcgaacaacggaacatcgtttgggcgagtggcacctcagggaatttcggacggcacaatgcaccaagggacaccaaatgtgccaacactgtcgaacaacggaacatcgtttggacgaataacgcctcagggaatttcggacggcataatgcaccaaggcataccaaatgtgccaacactgtcgaacaacggaacatcgtttggacgaataacgcctcagggaatttcgcacggcataatgcaccaaggcataccaaatgtgccaacagtgtcgaacaacggaacatcgtttgggcgagtggcacctccggggatttcggacggcacaatgaaccaaggcataccaaatgtgccaacattgtcgaacaacggaacatcgtttgggcgagtggcacctccgggaatttcggacggcacaatgaaccaagggacaccaaatgtgccaacactgtcgaacaacggaacatcgtttggacg

SEQ ID NO: 41002 - DNA, 1015 bp, Heterodera glycines
  misc_feature (10)..(10): n is a, c, g, or t
  misc_feature (917)..(917): n is a, c, g, or t
tttatttttntgaaaattaattcataaatattttttcccccctagctctgaaacgcaccaaattttatgtacaagttaacttaggctctctgatgcttttactatcaaaaagggagatgaataaaatttttaatttgctttttaaacatgccaaaaagtttaggcttaaattaaaaaaattttcttcggctctagctctttcaataagcaataaaatcgtaccaaattttataggcatactccccggtataggactaacttaacctgaaaaaatgacaattgtaattgattttaaatttttttagaaattctgagtttttcactgtttattattttttgcaaaattaattcataaatattttttcagaaagtgctcttaaacgcaaccaagttatttacaagttaaataaggctctctgatgcttttactatcaaaaagggagatgaataaaatttttaatttgctttttaaacatgccaaaaagtttaggcttaaattaaaaaattttcttcggctctagctctttcaataagcaataaaatcgtaccaaattttataggcatactccccggtacaggactaacttgacctgaaaaaatgacaattgtaattgattttaaatttttttagaaattctgagtttttaactgtttatttattttttgaaaaattaattcataaatattttttcagaaagtgctctgaaacgcaccaaattttatgtacaagttaaataaggctctctgatgcttttactatcaaaaagggagatgaataaaatttttaattgctttttaaacatgccaaaaagtttaggcttaaattaaaaaaattttcttcggctctagctctttcaataagctataaaatcgtaccaaattttataggcatactccccggtacaggactaacttancctgaaaaaatgacaattgtaattggttttaaatatttttagaaattctgagtttttactgtttatttattttttgaaaaattattcataaatatttt

SEQ ID NO: 41003 - DNA, 1001 bp, Heterodera glycines
  misc_feature (52)..(52): n is a, c, g, or t
ctgaagctgatcttcacaagaatgtttgaccctaatccattacaatgggagncaaaaagattggccaccatttgaaacgtgtctttttatttggaaaaatcttcgcctatttttggtaatttaatttatttattaaaataaaagaattattaagtgagtggagcaaaggagaaaaatatgaagaaagtcacgaaaaattgtggaaaatatttgtaaataatttgtcggatttgaacaaaaattcaaacgaaaaacaattaaattttattaaaatgatggaaaatcttttgaattatttgcgaaatcaatcgccccaaatcagtgccgacgcccaaaggaactcaaaagaattgttggccaattgtgtcaatcagtttttacttctttgcgaaagcaatgccgagttttttgaaaattttcgggaattgtccaaaagtcgcgcagttttcaaagaaattctcgattttgcttccaaaggaatggaagaaatgcttcccaaccgattaatgaattggtttaatggtgggaaaaaataaaaaattaattaggaaaattaactaatttttaaataaaaatctagatcataacaaaaaccaaaaggaccttgaaaatttcggtgttggacgatcttttgctgatcgcatctttgagaagagtaatatcaaaaagtcatacgacgaatgcccaaaggaaaatatgacgaacaaagaactgatcagggctgatcagaaagcacaaagcaatggtgaaaaaatctttttcattaaattttaaatcctctaaatttttttaattaatcaaaattattatttattaaatgattttttgtttgtcagatcctgaggcttattacttgatgacttcttacattgacttcttgcaaacatcagcagatgatcggtaaattgaattttacgaattgccaaaaatctttaaataaataatttcaaaataaaattgtcaaaagcaattctcattcagataataataatcctttttac

SEQ ID NO: 41004 - DNA, 963 bp, Heterodera glycines
  misc_feature (89)..(89): n is a, c, g, or t
  misc_feature (91)..(91): n is a, c, g, or t
  misc_feature (146)..(146): n is a, c, g, or t
  misc_feature (304)..(304): n is a, c, g, or t
  misc_feature (370)..(370): n is a, c, g, or t
tggcggttgttctaagcgagacaatggaatggtaattcctcctggttttattaattgatattaaatggtgggattaccctttagtgatnantctattataggaggtaataggattaattaaattgatagaatgaatatgtgtgtgntgaattctaaagaaattttatagaagtagtatttaaattaattataatataaagtttttgtagaataataaatgataaaataatttttttatattttatttaaatttaaaagaaaattaaattttttgtttaaaagttagaagtaaaattattgaatntgttattggttgattttttttatttggttaagtttgaggtaatttgtaaattatgatttattattntgtaaaataaatcgaaaataataattaaatttaaaaattaatcattcataaattttttaggttcaagttattgaattgaaactattttcgagtcaccactctattatagcatctaatagtaattactgaattaactaattgatggaatacttgtttttcaattcatcactctatcagcactctatcagcactctattagttaggataattaattaattaattattattattttaatttttcgattggttggtcctatgggcgtgagatcatctgtgacggatatacaccccacgtgttggccattgtccttctgctaacaatcgcggccatcaaagcacccgccttttatgccatcggattgatttatcaggcaattttctgaaagtgtaccaaagattggaaaagaaaaaattcaaaaattaattacccctctggcaaaggcacgtagttcaattttttatgcccccgattttccgagactcagaaaaatcctcccctccctcccctccaccctcatgaccggttttggctttggatatggacaccataaatgaataaaccccaattttgcattcatttttcataacaatta

SEQ ID NO: 41005 - DNA, 981 bp, Heterodera glycines
  misc_feature (870)..(870): n is a, c, g, or t
  misc_feature (880)..(880): n is a, c, g, or t
aattttgaaaaattatgtaaaggttcaaaaaaaatatatctctagaacaactcaaaaaaccagattttccaacttttatgcccataaatttgttcaaaattgacggatttttttggaaatttgcaggctaatagagcatttgaagggctttcgaatgataacaaaaatgtttgatttggatgacaaagaaaaaagttatagtccaaaaacctgctggggcccaactgacgtagaccggtcccataccctaccaatggtaggacaccagaaatatttacatcagtgcctccgcgtgtttggggttgcgcgccagcgccttcaggtagaagccctctgcttgcaccacgtcactgcgtgccatctccacgtaaatgccgtactcggtcagaatgtccgggttgtagggcgccaacgagtaagcgtgctgaaaacgggggaggatgcagaatcatcctgacaaaattttaagtgatttttttaacaaaatgtatcaaaatttccaataatttcccggtgacacctaacggggcgcccggattaaaatttatcatagtttaataaaaaaaaaaaaattggtcccaaaatgccaaaaaattagtcatacacttttgatgaaaaacggatatgaattcacaaaaatttaaaatttaccccacttctccctcctccggagccatcagatttaatgaatcattcgagtcatcatttttttttgagacacagacaaattgtttggaattttgtaagttattggattggtagtgcctatcaaaaaatgccaaaattggttcgattttggacgccatggaaggaaaattgtacccaaaaaaaaactccctgttgtgccactttttgccccatcaaccctanaagcatgccnaatttgtccaccacattctccaactacctcaatgatgctgcgcgccttgcgcaaagtgccctcccagcgcgacccgtttggcgccgaaagtgcggcaaccg

SEQ ID NO: 41006 - DNA, 981 bp, Heterodera glycines
  misc_feature (70)..(70): n is a, c, g, or t
  misc_feature (932)..(932): n is a, c, g, or t
  misc_feature (940)..(940): n is a, c, g, or t
atacaatggttggtttatcattttaaattcatatggcccttcctatagaatttggcaaaattataatttntggctcaataattcgaccaaaaaatttgtcattaaattttgaatttgttgatatagattagggctattctcacaaatattttgaattccgctgtgatttgatcgattttctatgcttcggttcacttataaatttcgttttttatttttaaattttttcaattaattttcttatatctgactaatccttaaaaataaaataaagttttttttacagaacaatgatgttgagcggacatggaaaaattacaaggaggagcagctgaagaatggcttgctcgattggcaagactacaggtgaagaaaatctaacagagggcgagaagggtggaaaatttataaaattcttaaacttttcaggaatttgatttacggaaaaccacaggagggccaggagatttcaccggaatacgtcaaaatgattgagcgagacgaacgtcggtggaaggtcagaagcaggccaaaaagacctgctaatttatattaaatcgagaggctaacggccaaattttaatatttttaaatgctttccatacagtaaactcaaaaattgatttacaggtggctgactacaattcggacggtaaaatggaccgcacggaatacggctgtttcatgcacccggaggactgtgaccatatgagagacattgtggtgcaggtggattagcaaatttatttatttaaaaaaaattaaattagattattgcttattaaagtccctttttcaatgattttcattttatatatttttcacttgtcttaacttggaacgggaaaaattcacctcaccctaattctcatatttacccagtattgttgcctaattatttaaaatgatttattattaataaatctttattngctattgnagccattcattataatacttaaaatttctgtacaggaaacc

SEQ ID NO: 41007 - DNA, 1155 bp, Heterodera glycines
  misc_feature (48)..(48): n is a, c, g, or t
  misc_feature (75)..(75): n is a, c, g, or t
atatcgaagctgtttctacgctattctaaaaacggttataccaaaccncagattttgaatccggttttcagaaanaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattgaaaagagcagctcgagctctacaagaaggtatggaaagaaaaaatagttatttctgggactttttcagaaatcagaattaattctccaatgtggcccaaattttagggccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagattgtgaatccggttttcagaaaaaatgccttgtggtgaaa

SEQ ID NO: 41008 - DNA, 1220 bp, Heterodera glycines
ggtcattttttgtctcgattctcggtaaaaagtattttcatcacagccaaagtgattaacgacaatgataaagctgaaggaagcactgggccttctgcggctaatcatcagcagaatgtcagtgaacaatacctcacaaaattggagcttgaaaaggtgagttaatttttttaaaaaaagttttgccaatttctttttttccgatggtttttcatctaaattccggttttcgacagattttatggtaccaaatttccagttgctaaatgaatttttccaacgaaattcggatttccggtttttaattccaaatcgacaaccatggggcttattgcgagaaaaaaaaaattgacatttaagcgaatttgttggcatattttggctctcccaagacaaaatttcaagaaaatttacctgtttttctgggaatttccctgtttggttattggctgctaaagaaacaatggcatttggtgaaaaaaaaaacatttttgtatttcagaggctgctcaaagccgaattgaagcaaagagaaatgatggaagagcttaaagagttgaaagatgccaacattgaacagcagaaaaaggagaatggtaatggaaaattacgataggaaattaaaaagtttaaaaattaataaattacaaattaaagaattaggtatttgtttttcaaaaagttcgctaattaaacaaaaatatttaagcgttcattggacaaatccaagagttgaaggatgaacagcagaagtgcttggacaaatatgaagcattggaaaaagaattggccagaaaatacagcaagcttttttaaaattaattgcttgcaaattttctttgaaaatatacgaagttatggttcctagggttttaacatatattttttgtgctggttttcttcactaaaaatacacgaaaaatccatttttttcatggtttcaatttcgcctatatttttgccgttttcgccccgatttcgacacttatttttggtgtttgttaaacaaatcttaattatttcccaatcaaattccgatccaaattcgaaaatcaatttttaattcttcaatttcattcgaaaattaattaaagctgagaaaaattattcaaaaaacaaaattgtaagaataattaataccatgttttttgaaaatatcatagtaccaagtcagaaaaattttgtttaaaaatttaaatattggaataattttcaaattg

SEQ ID NO: 41009 - DNA, 1074 bp, Heterodera glycines
  misc_feature (46)..(46): n is a, c, g, or t
ttgcatggcccgggcaggtcttgggtcgggaaagttgaataaattntcagttgcaatatggcctccccggcacaatacataaatgtagagcaggctcaaaatagaggaaataccaaagattaaaaaattcgtgtttatggcccactctgctttggctggacataactcgccagagagtggagatagacccttaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccattttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagccctcaattctttcacacataatgtaaaaaatattacgcagaaattatttttagatcctttttagaaatgctgcataaatttttattgtaatagtcacaaaaaacttttttt

SEQ ID NO: 41010 - DNA, 725 bp, Heterodera glycines
tactgtatttaatagctttaatgaataaactttggatcttctaggaaattcaaggacgacttgatggagcatttaaatgctaaattcttcatgaaaaaatttagggcaaataggcaaaaatgtttatgttattacaaacgctgccattaaaaattgcggcggagcgctatcagttattgctgacctggctgattatacaaatacgacttggatatcacaaataagctccagtgatgtaacgccttctgctgaaaagaattaaactactgtatttaatagctttaatgaataaaatttggaattattcggaaattcaaggacgacttgatggagcatttaaatgctaaattcttcatggaaaaatttagggcaaataggcaataaatgtttatgttattacaaacgctgccattaaaaattgcggcggagcgctatcagttattgctgacctggctgattatacaaatacgacttggatatcacaaataagctccagtgatgtaacgccttctgctgaaaagaattgaactactgtatttaatagctttaatgaataaactttggaattattcggaaattcaaggacgacttgatggagcatttaaatgctaaattcttcatggaaaaattttgggcaaataggcaataaatgtttatgttattacaaacgctgtcattaaaaattgcggcggagcgctatcagttattgcggacctggctgatta

SEQ ID NO: 41011 - DNA, 1068 bp, Heterodera glycines
ataaataaattaatatattttaatcattaaaaatattttagttatataaatgataagtcgaaatttattaatgctcatataaaaaaatcatttgataatgattcaacagaaacggaaaaattagcactttgtggaaaatattttacttacagatttgaaggtttcagacgcggtgtagaatcttaaaaaattaatattatttaaatcttttataaggtttacgcgatacaaattaaggaaatagtaaagttatgtgatcttgatagaaaatggataaagaaaaggtggtttattgaaaaaaatggtgttaattcgagtgcaggatctataaataaattaatattattttaatcattaaaaatattttatttatataaatgataaatcgaaatgtattaatgctctgataaaaaaatcatttgataatggattcaacagaaacggaaaaattagccctttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataaagaaaatgtggtttattgaaaaaaatggtgttaattcgcgtgcagaatctataaataaattaatattattttaatcatttaaaatattttagttatataaatgataaatcgaaatgtattaatgctcagataaaaaaatcatttggtaatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataaagaaaatgtggttttattgaaaaaaaatcggtgttaattcgcgttcagaatctataaataaaattaataatatttttattcattttaaaataattttagtttatattaattgataaatcgaaattgattaa

SEQ ID NO: 41012 - DNA, 757 bp, Heterodera glycines
ttttttgggagaaatttttttccatacaaatgttcccagcatgggcagaggggcgcggagagcaagggccccttggttctacagggaatttttaaatttattctctatgccagaaaaatgcctatgtcttttttgcgagaaattttgtaacatacaaatgttcccagcatgggcagaggggcgcggagagcaatggccattctattctacagggaatttttaaatttattctctatgccagaaaaatggctatctcttttttacgagaaattttgtaccatacaaatgttcccagcatgggcagaggggcgcggagagcaatggccattctattctacagggaatttttaaatttattctctatgccagaaaaatggctatctcttttttacgagaaattttgtaccatacaaatgttcccagcatgggcagaggggcgcggagagcaatggccattctattctacagggaatttttaaatttattctctatgccagaaaaatggctatctcttttttgcgagaaatttttccccgcatgggtagacgcgcgcggagagcaatggccattctattctacagggaatttttctacttattctctatgccagaaaactggctatctcatttatgcgagaaactttgtaccatacaaatgtttcccgcatgagcagacgggcgcggagagcagtggccattctattctacagggaattttttaaattattctctatgccaaaaaatggctatcccttttt

SEQ ID NO: 41013 - DNA, 376 bp, Heterodera glycines
ttatttattttttatttaccaaaaataagacgagataaaatatatcatataaaaaatacaaaaaagataatcaattcaaaaattatggcaagcgttaaattattttaacagaatttatttttattattaacaataaagaaaaaatataatcattaaagatatttaataaatattttagaaattataaataaaaccagattaactaccaatataaagtcaaataatataagaaaacaaaatttttttttgtattaattcatattatatgtaatgtactgaatacatttttgttatgttttttagatgaatttttggattttgtggctttttacccccaaattcctcaaaattgttcttttttaaatattttctgact

SEQ ID NO: 41014 - DNA, 895 bp, Heterodera glycines
cacaatttttgccaattccgaatttccgcttttaattccacccggatttgttcatttccgttccgttttccgcaggttgtgcccttttgagggttctcttcacaatcgttcggccgaactttcgtcccacgggcgattcatcgccgtccctcccacagaaaatgccccgcgggaagaacaaaaagagacacagaaaaggcgaaattcgtcggacaaaagcgaaggaggcgagggaattgtggtggtcattcagcagaaagtgttcgaaaattaccatttggtcgcctattcgctggtcattgtgacggttagagacagagtgggagagaaagagagagggagagagaaagagggaatgggagagagttggagggggagagagagagggagggggagagggacacagagaaaagaagaaaaagacaagacgggttgggtgggacaaacccaaccaataccgtacacggaggacggagcagggaaaagaaaattatccatattttcaaatatttccacggctgctcccactaatttcgttcaaaacttttcatagatttgtattttacagaaaattttttggagctgaaaaagcaaaaaatgttcaccgatcaactggggttttctcaactgatcaccttttcggctccttcttctccatccccttaatttgcttgccttttctgatcaatcttctcacccttttattctaatcggttagagttctctctctctctctcctctctctctctctctctttcgatcactcttttaaatgcgtccttcgactttgggggggggggggggggggtaatttgccattttccttttgtccgatcactgattgatcagtcagtcccttcctcttcagtatttgttggctttctgcgagtatctg

SEQ ID NO: 41015 - DNA, 590 bp, Heterodera glycines
cattcggccgcttcgcggcctcaggacgggcgctcccacccctcagaatccccaatcacacaggaattctgaggtcttatccatgtctaaagtaaaatctgattacatattcgtgatcagcgtcataaaatagccctaatgacatgttgttggaagatttttgtgaaacaaattttccactcaaaaatcctggtcaccccccccccttcggtcccgaattgcaaaatcacttttatttctataacttttttcaaaatattccactaaatttgatcaaaaactaagagagttatgaattttcgaaatttcactggattttcctgggcccaaattttgacaatttttcaaaatttttaacaaccacccaaaacgtctgaaacaaaaaataaagtatatattcatgttcagcaccttaaattagcccataaaatgcatttttgctaatttcggagcaaaaaaatttttcatgaaatgcaaaaccatggggtcccccctatgatttagaatttcaagatcacaattaattttataactttttttaaaatcctgagaagaacatgagataaagcacattagataaagcttaaaat

SEQ ID NO: 41016 - DNA, 1038 bp, Heterodera glycines
gggagcaaaaatccaccgcagaattaaagtacaggctataggaaagcttctcccgaaggattcggtctccccatatatctgggcgcatcggttcgaggggactgccccgaaaacaaaaaaatcgattttttcaagtgtccgtttggggtactcacacaattatggggagcaaaaatccaccgcagaattaaagtacaggcaatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcgtcggttcggggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaataaatatgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccc

SEQ ID NO: 41017 - DNA, 820 bp, Heterodera glycines
tctagagtcaaaaataaaaaaggtagtcgccaattagctcagaagcacaatatttgacatttttatagataaattccgttaacaagttgcacaaagcacgccgcaaaaagaagtggtttgaaaaggtagaaaataaaagaagtcgacaaattcgatgttgatatcatacatgcacaggggtgtctcgacaccccccccccccccccctcgttcgtcgtaaggggagcggctgtaaaaaaaggagggggtcgtaactaacgaagggggaaaatgttagatcttgcacaatttccttagcgagatcaatacaaaaaagttttcccggcggcgcctatcggcaccgcccgccacccccttgcccaagttttttggaaaaacgcaccgcaaaaaaaaagatcgccagaaatttttcgaaatttgtaggctaataaagaaattagagctatcaaaccaaatgggatagatttgtcacaactatgaaaggaatttatcccagaaattggactggcgcccagttgaacggcgacatgtcgagttgctccggaaacaaagttcacctcgtcccagtcgggcaacggaccccgcgcccgtcgttgtgcaacattcagtggcggcggtgcatttgggtggtgattccgctgccatcggtcatttctctgttggtaataactgccgcccggacgtcgttccctgtcgtcttcacttcctctccccgattgaccactgccgcctcctccgcctttcttgtgccaataatctgtgccgccgccggaccgtctcggtccgccaatgcctccgccgccgcccgaccgataaggca

SEQ ID NO: 41018 - DNA, 1214 bp, Heterodera glycines
tggttttttatgaaaggaagtttgaggaacaaaatgctcccacgcgctcgaaattgtttcagaaaaaactttgtatttactttcaaatgtaaaaacattggttaaatttgatgtaacattagaaagtaaatacgaatttaagattttaatattgttagggttaaagtttctaatagttattcttggtggaggagatttctgtaatgacaaattaatttgaaaaaataaggctgaatgatcagaaagtataaggctgtccttaatttcaacaaaatgaattaggttcgggtttgtacataagcagaggtctagaacagaatttcctcttgtcggacctacaatttttgtatttaaggaaaatttattgaaaaaatcaacaaaagttatgccaagacaggtatgaggtatgggacaattgttagaccaagttatgtctctgttgcctatgttaaggtctcctataattaaggtggaagctgtaataaatttttcaaggtagttaaaaagtgattttgttgctttaagtttggtattaggggggcgatataaagataaaatagataaatttttagcattttttaatttacaaaaacagatttcgcagccaaattttgtaaccgtgttactaaaataaggctgaatagttttatttataataagagaggttccgccccctttgccttttaatcttttcgcattaaaaacaatatatttgtcattgagtgattgtccaagaaaagttatttcatcagattcagaaagccaggtttccgtaatccccataatgtcaattttctccactgtcagtaatgcacttaattcatttagtttattttttatggaacgtgcattaactaaacaaccagagatggacaaattcttatttgtatttacattatcatgagaaaatttaagatgaggtttaggggattttctgttttgagaatatattttttggaaattttgtctacccccaaacctcagaacattgctgtcatgatttagtttttttgaaagcgtgtcagcagagagtcaatgtgaggaataggcccgctcaagttctctccgttcatcctccttcctttgaattcacttcggagcactagcatcccgttgtagatgatccagtcagcggatgttccttatcgcttttcggacactgcgctttgagttcacgtctcgctttcacttgttctgagtgagcgatccctgat

SEQ ID NO: 41019 - DNA, 1188 bp, Heterodera glycines
ctgcttggcctgtgcaaaaaaaagcacgattaaatgatctcccactagaaaagcatacgccatacagactttttttacttgctgtttttaattttccttaattttcaaatcgggatgattttgtactcttggttttccatttctctatttttgttttttccttggcattcgcttgccttttctttattatttgcatttttgtgtttttccttgaggtttatttaacttttcttaattattcttttctttgactttcacacacattttttcttttcattttatttttccattactgtttttcttttctttacttagctttaaatgattaaaaaaattttatgaatttacgtaaatttttctgtattttttccataattttgtgttttttcgttgacatttgcttggcttttctttttattgcatttttttgaggtttgtttgacttttcttaattcacttggcagatttttcttttctttgcttttctttaaatgaataaaaaatttttaaaaagaattgcgtaaatttttctgtatttttctagaagtttgttgattttgctttgcttttatttattgtttccattttttccttgaatttttcttttgaggtttgtttgacttttttaattcactttggcacatttttcttttctttgctttttttaaatgaataaatcctttaaatgaatttgcataaatttttctaggagtttgttttttttcgtttactttgcttggcgtttctctattatttacatttttccttgaatttttcttttgaggtttgtttgatttttcttaattcactttggcacattttttcttttctttttatttttctttttgtgtttttcttttctttgcttttctttaaatgaatatattttttaaatgaatttgcataatttttctatatttttctaggagtttgtgtttttcgttgactttgcttggcttttctttattatttacatttttccttgattttttcttttgaggttttttgacttttcttaattttctttcacttgccagatttttttcttttcacttcatattctcttccttttgtttttttgcttttcttttctttgctttaaatggataaaaaaatttctcacccgaaacagctgcgcagggcattgaaatagccgtagtgcgcgccctgctgcagcaacaggcagat

SEQ ID NO: 41020 - DNA, 823 bp, Heterodera glycines
tttaggatttttaacgattttcccagagaacggagaccactccaaaacatagttttcgagctctatcgactggtattttttcggaaaatttcgatttttcccggaaatagaaaaaatttttggcatgagcgggacatttgagtcccgggtccataactcgttaggggttggttttatcgaaaaaactccttagggcaaaattgtagacttttttaagctctatcgaatggtgtgccatatggccggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgaggtttatttggttttataatgttcaaaagaaaaaaagttattccagaatttctggaaattttcgatttttcagaaaaaaattcataactcggttctgaaaggtcatactgtaaaagtaaaatactacaaaaatccgcaattttttcctctataatataaattttattttacatttaaatcacatttttaaaaaaagatataaaaataaaagtgattttgggattcgggaccaaagggagaaagagactatgatttttgagttgagaaatttttcaccaaaaa

SEQ ID NO: 41021 - DNA, 755 bp, Heterodera glycines
  misc_feature (607)..(607): n is a, c, g, or t
  misc_feature (637)..(637): n is a, c, g, or t
  misc_feature (665)..(665): n is a, c, g, or t
  misc_feature (738)..(739): n is a, c, g, or t
aaaattcaaaaatttcgtgtagttctgcaaatgttatggcaaaaaatgttaatcaagttttgtgggttttggcaattacttttttcgcaaatttctttagaattttgaagattattagcgaatacaaaatgcatttaaaaatcagcgagtgccgatctctattgatgccgaaccccggctaatggatgttcttgggttctttaacaaagcgatgtgccatccaacagaactcttcccaactatgtcaatacagtttctggccattaccgctgtctgtcccacaaattcttgcatattgtttttaattaatttttttcattcatattgatttctttatagacattctcatttgcaatttgtctaattcattttatttttattttcttttagaaatattttattttttattttattatatcattcaaaaacacttattcatttcctcttgatctcgaatttaaaaaaaattgttttttttttgtaatccaaacttttttgaatccaatattaattttagaaaaataaatgcagctgcagaaataatttttgtaagagataaaggatttagaatgagataaaattaatagaaataattgtaggcgcttanagcggaaaaatttattattatgaattctanagatcaatataaatcaggaaattcaggncaagagcgattcttgttatgaaaaaattcatcataatagagcccggattttgcagcatttgctaataagcatnngaaaacgatttctaac

SEQ ID NO: 41022 - DNA, 1664 bp, Heterodera glycines
  misc_feature (27)..(27): n is a, c, g, or t
  misc_feature (94)..(94): n is a, c, g, or t
  misc_feature (1656)..(1656): n is a, c, g, or t
tttttattaataatataaatttaaaanaataaatattcatattcactaagtttcaaacaaacactgcgttgaaaaaaacaagaatggaaaatanaattaaaaaatgaagtagctttttttaaaaatattaaaaaaatcaattatttccttcaatttttcccattttggttttttaaaaaatttgttttttttggctgaaagaaaattttattcgcctgctgaaaaaatggaatacgtgaaaagaattgaggagataaaaaataaataaacgcaatgatgagtaagccgaaaattgccgaaacatggacattccaattacaaatttaagccaatggacgaaggaattcagcaccaaagtgttctgttaggcttgaaaaatttcaaattctattgcaattttaagaaaaagcatcaattgggtcaatttcactatctgataataagctaaatcttttacttccctatttataaccattattcaattttttttttaaataaatgttttaacctattgagtttcgaggctttctgcttttcatttctcgcataaaagtcttttggccttttttcattttcattaattatttataattttttatgcatatctttataaattgtttattttgtattgaaatttaaagaaaacacggccgttttatttttaatttacaattaaagtggattttaattaattgttttttggtcaaatttaaagaaaataattaccacaatcacagaaagcggaatcaccatatattcagctacaattataatatcaaattatgtaatgagaaggaattgatgaattattatccatgagaaaaattcgaaaaatgaaagaacaaaagcaaaaaaaagttaacgaacccaagaaaattgcaaaacttagctaacatttatttttagtcactaaaagttgcactgaccctccataccaaacaaatttttttggatttaaattatatggaagagaagtcgcaaaataactacataaaaatgtacaaaaaattctggaatatgtataaaaaatgtaattaaaatttttaaatgcttttttgaataaaaattcttagaaaatacgtgaatagggcacaaaatgccacaaaagagcaaacacggtttggaaaattcatattgttttcttctcgatttttgacgattttgaggttattggctatttttatggcatgttttagcgcttttggtgactttttttctttttttatgacttttcatgagttattgaagatttttaagacttatttattaacttttgataatttttcgtaagttaaattcatagccctaacattaattctaactaaattttataaagaatagcctaaatgtatatcaaaatgaaaattgccaaaattgattgaaaattatcatataaattaaacataatccaatgaaggaaaaattgctaaagaaataaaatattcttaaaatcaatgcaataatcttttataaacatttatgaaaaagaaaattaattttcctagatatatattcgtattttaataaaataatatatatatatatatatatatattagttagtttttagtaaattaaaaaatttttaatttatttttttaaataaaacgaaaagacttttattgattttttaatttaattatttttaaattcacanaaatttag

SEQ ID NO: 41023 - DNA, 1009 bp, Heterodera glycines
tttttgctaaatatatttttaaaattaagaaaaatacgcaaattatggaatatgccgaaaaaggagatcccgaaatgcataaacagttgcaaaatttaattggtgcctttcatacactgagcggaatgaatcgttttcgaagtatattcgctcgcgtaaaatattaatttatttttataattttgccgtgctaggttaaattgaaatttaaaaaaaatatagcataggaaataaaattttcggactttttttctcacactttttaaaaaatcaaaagaatttttttttgaaattttgctgcctaacagagacaatctttaggattagcgaatgatactttatttcttgaaaaatattgtgacaatattgttcgtaaaaatgccaaaagagacgaaattaacaaaatatgctctctcaaatttgtttcgctaataaatttactaaaactgaaaaacaaaaataattaaaaatttaaatctaattagcagatttacaatatttaagagcccttttgggatgaacaacaatacaattccattcacaaattagtcatgggaagtgccaattattttcagcatcgttttggcattaatttggccgatttttcgcagaatccaacgcaatttggcgatatgaactcaaaaattgtgccattaattaatttggtgcgaaatcgtctgctgattgaagatgggccaaagcaacagaagaaggcgaaggatggagaaaaacaacagaaaaacaaaaaagatgggcaaaagcgaacgatgccaaaggagggggcaaacgatgccaaagatgatggagtcaatgggcattttaggaaattggccaaatggcggccgacggtaattgatatgcaaattgagtcccaaataaaaaaaactcaaaaaggagattttctgttatttttaactatcggcctcatttcaatcaacaatcccagaaattttatttttctaatgttttacttgattttttatgaaaataaaaaggtcccaatttttga

SEQ ID NO: 41024 - DNA, 1550 bp, Heterodera glycines
  misc_feature (118)..(118): n is a, c, g, or t
gatagaaaagcatcagagagccttattatctttaaattaacatttggtgcgtttcagagcacgttctaaaaaatatttatgaattaattttgcaaaataataaataattaatgaaaangtcagaatttcgacaaattttaaaaacaacaagcgttggcattttttcaggttaagttagtcctttacaatggagaaggcctgcaaaatttggagagattatatcgattttagtgcgctaggttcgatgaaacttttaaaatatacgcctaaactttttggcctgtttaaaaaggaattaaaaatttttaaaaattttattcatctcccttttgatagaaaaagcatcagagagccttatttatcttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttactttttggcctgtttaaaaaggaattaaaaatttttaaaaattttattcatctccctttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaattaggagagattatatcgattttagtgcgctaggttcgatgaaactttttaaaatataagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtattaaaaatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaaaacaaataaataatgaaaa

SEQ ID NO: 41025 - DNA, 613 bp, Heterodera glycines
ctgcgcctcgtccattgccattcatttcccccccccccccttcttaggtgccaatttttccattttcgccgtttgcctttccctgcactttttggctttgcccataatttggcaaaaaatttaggcaaatatttgaacggaaggagcgaagcccaaccaaatcagcctcccaaatgttttctttgcatttacaaattattccatgaataatttttgccttaaaagtttttttccatcatttttgcatcatttaccatttaataaacaattttatttctctttcgtttcgtaaataaataaaattaatttaaaaataaataaataattgtaattattaatcatttccattttcaatggctaacatttcaactcattaagcagtgaatgaatgaataaattccaattcgaatttcctcccccccccctccgattttcttttcccatttcattcttttgccaccgcagcagcacattttgcccatttcgttcgtttgctttttgccccccccccgccggcgtttcccgcttcactttttgccctcgggggatttttgagggaaaagacgacaaaactaagcgaaaaagaaattttcccataatctctccccccccc

SEQ ID NO: 41026 - DNA, 562 bp, Heterodera glycines
atttttgaagaaaagtcgggattttttggaatttttttgagttttttttcaaaaaattagcaatttttgtacaatttatgttaataaattgcatagaaattttcaattttttttccgacggcacctatcggcaccgccggactcaaaaaaaaacttaattttcttgaaaatttgctcaaaatcgctaaattttccattttttggacaaaatttgttaacaatttacattaaaaattacaaaatttttcccggcggcgcatatcggcaccgccggacccttccttctccacagtttctcaaattctctttggataaagcgcgccgcaaaaaaagggtgtaactttcccaaaaaaaaaatccaaaataatgtaaaattacttaaaatattttgatctttttaaaaaatatagaaataaactaaaaacagtttgaaattaccttttacatggttaaaaatttagcctattaaatattttttttaaatttattatatatttttttgaaaaattccgagttccgacatttttggggtcggaattccgacttccgaaaatttttagtg

SEQ ID NO: 41027 - DNA, 1113 bp, Heterodera glycines
atttctaattcatgaaccttttttggcattttttaatcttcctcgtcatataaaaaatttcgttacatttcgtttcatttctattttttaaattttttgttttactttcggttttcatattattttattaaattattagtcgtttctttttgtttttgaaaaagatttctttgatttggcaaacatgtagatttattaacaaaaaccgtcatccccacaaaaaaaatataaataagaataatttttaatattttatattataatctttagaattttttgcagcgggtattattgtaacttcaaggccaaatgaattcattttgttggtttttttggatatatttatacacataaatttggggtaattacaaagataggaatcagaatgttctgattttggtttaatcacaaagatagtaaccagaatatctgattttgacaacaatagaaaccagaattttatgagtttggtttaattacaaagatagaaaccagaatattcgaattttgacatcaacagaaatcagaatattctgtattggtttattacaaagataggaatcagaatgttctgattttggtttaatcacaaagatagaaaacagaattctgatttggacaaagatagatatcagactattctgattttcaaacgaatataaatcggaatgttttgattttcgtttaattacaaagatattaaccagaaatctaatttgaaaacaatagaaaccagaatgttatgtttttggtttaattgcaaagatagaaaccagaattctgatttggacaaagaatataaatcagatgttctgattttggtttaattacaaagatagaaaacagaattctgatttggacaaagaatataaatcagatgttctgattttggtttaattacaaagataggaatcagaatgttctgattttggtttaatcacaaagatagaaaacagaattctgatttggacaaagatagatatcagaacagtagtaacagctgcacgacacatctagtatacaatattccttggagcgatcttcgtgagtgagatcaaacgcgcagaccagacagttattgccgaaaatgttgcaccttgggtcaggcacaat

SEQ ID NO: 41028 - DNA, 935 bp, Heterodera glycines
cggcaagaatttttttcgttagcatttcaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagacagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagacagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcgggcaagaatttttttcgttagcatttcaaatatcgtgtgagtgtttggtagagccagactagagaaggaaaatgttggtaccaagtttgcggtcaaatccccaggagaaaaagaagatagccatttttgcggcaagattttttttcgtagcatt

SEQ ID NO: 41029 - DNA, 1091 bp, Heterodera glycines
attgtcatagtagagtgaaaaaacggtcagaacaggtgcattttagtgatagaataaatagatgaaaatggtgtaaaatgcttcatgatgtaattgtatgtgagtgaagggtattgttgtttatgctatgattttattgagatttcaaaagtggagttttcacccgtgccagtcaaaaaatcgtgccagcctaaaaaaataggccgcagtgaaataatgctacggctttttttccatttcttcgctgtccaaattcaaatttgactctcgcgtaccgctttccctctcacctgtcaatcaaatttgcgtctttgaaattccttgcgcttccttttcctttatagtcggcaattgcatcaaaaactcaaaatacgtcccctctctgcgtgcctttccacactcagctgtcaatcaacttctcttcgcgaaccaaaattcaaattttggttctctcgcgtgccatccttctccgctgtcattaaaattggtttttttcgccggccttcctccatctccccgcgaaccttataatcgatccgccactcgtccgctaaattctccgccctttcgcgtttgtgctggaattggcgtcctttcattcactcttcttctctttctcaaaactcaaagcaacaaaacctactccttccgcttcaacttattcgtttttattgtcttcaattccataatttaaatcatccttttttcattttgtcttctctttacgttttatttttttttgttcgacttttcttctcaaaaaaatggctcacttatgctctttcgttgataacaaggaattgggacgcctcgcaactccgaaggggaaatttagtgcgttttaaaacattagaatttgtaaaaaaagagaagttagttttacatcaatttaaggccctttttacgctcttgaactcgctcgcaattatggattggttggaggggagataacggaagataaattccgttatcttattaaaaccgagcaaaaacaatgggaattggctttcgaattgatggaaagggcccgggataagtggagaaaaaaaacttttgggctgcaacacctttgagctcatccaaaaaatttt

SEQ ID NO: 41030 - DNA, 1310 bp, Heterodera glycines
tgaatggtcagttgaacgcgttggacccggacaatgcctcccggaatttggataagattaagatacacggactgatagcactgatcgggatctgatttcatcgggatcccctaattacaaaatcttcgggattgacctggtcgcttcggtcgcgatcccgactcgagatccctccgtccccatttgtctgatctctaatatgaacgagccttgctttatccaatggtaccaaatttatttcttctttgcgtcgaacctttgttttttatttgtgtttagaatttccagaaaatttttgcatatattacatattaaatattatggttttacatttccttgtgaaaaattgtacaattattgatcacccattttattggcactttcctgcgcacaaatttaatagcataaaatgttggcaaaatgcctacttatggccctttgctcataaaatgccaaatttggcgaaattacaaacagcagggtaatggaaaatgtcatgctgtcaaacacgcacgcatgtgccaccactttgttggccataaatagcagaaaaatcaatggtttttattcacttattattttttaaaatttttatttataataaattagataaatctctgtcgtatttgcttactatgcttcttaaatgaatggtttcaaattaaacgtaaattttgtacatatttttcgtttcaatgaatctcatccctataccgtatatgctctttttatcaccacatgggggatttttttcaacctcctcagaaaagggggataattatagactgggggataaatggagactgtgggattatttttcgactgacttatttagtgaaaaatttttgagtttttttgaacatgtcgccaaaaatgtcatctcgcaaaaaatcggaacgggccaactccgtctgagccaactttgagtcaatataactcttgaagttattgaccgaatcaaacaatcttgatatcattcgaaagctcttcacaggctctattagcctactaaaaattacaaaaatttcgaactataaaaaaagatagaaataaaaaactttgaaaattctgccttttttgcggttttaaactgacaacttttttgagagctgattaatcactgagaaatagcttataaatttcttctaaacatctagggctttcgaatgataccatgattcgaaatttttgctgtgttttcacataaaattggtgtctcaattcgttaaattcctaattttgggggtccggattgaaatccactgtaaaaataaataaatttaattaaatttttagcaaattaaaaattt

SEQ ID NO: 41031 - DNA, 941 bp, Heterodera glycines
tggcgaattctgcttcgcaatgataggaagagccgacctccaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccac

SEQ ID NO: 41032 - DNA, 1216 bp, Heterodera glycines
  misc_feature (31)..(31): n is a, c, g, or t
attgtggaagagctacgactacaaagacatntcggctactttttccaacaaaaggtgcaataaaaattcaaaatctttttttttttattcttttaaggattttatttttaagatcgccaaaatgggtttgtgcttgaagtgggcgatcagaggagaagggtgattttttaaaagctccatatatattttgggtctttaagtttaattgtcatttttcttttttagcaccagttcttttgcgatcaaaccgacattctcttgcgggaaatgcgcgaaattgcgatagaatttgtggttgtggaccttcaattggccagggattctctcagtttggacgattttatgctgactcgtttgggtctttgcaggtttcaacagacaaacacattaattgctttattttcgatttaattcagcaaggatgagcaactcgcttcttacgtggaatttaatgtgcaaaaattcactgcaaaatgcgccagcggcgcgtcgtcggaggcccgacaaaatgcgttgtccacgcggcgattgttatgccttagcgagtcgtgcatcatagagagagacccgatcagttacgctgtcatttgtgccagatcacttcgaacggtgggataacaaaaataaagggaatttgtggcatcatttttcataagttgtcctgtaatgatgttcattaaattgttatatttaaatcttatgcaaatgatttcattagatagaaaaacttcttcccattccaataattgctaattagaactcaaataattccacaaaaccctcactaattgttcaacgacaataatattactcatggaaactgaccaaatcgaaattattaaatagacttgtagaaaaaaatcacactaaaatttttttgattaagttatataagttaattctatgttgttttccaaataacattcagtctcaagtgacttaataaatccatgttttaaatctatgaatctctaaagttttcgacttttttaatttttcagattgtttgccttgtccgtgatattaatgacccgcaaaaattcaccattgtctacgaatgtggcgttgagcggacattcagttccaatgaacggttttcccttttttatattcattttcctttttatttttcagggattctctgctggctgcccttttggatggaattcgtggttccggcaattaccaagtccatctcatctcaagccaaaggcat

SEQ ID NO: 41033 - DNA, 1216 bp, Heterodera glycines
tttcaaattgccataaagttcagggaaatttaggaagcgcatggccaaacattttcaaaatattcaaaaatatttctcttcctattactcaaaaagacaatgaaaaaatagtgtattttatgctcaatacatgacaaatttgatgaaatagtgccgacaatcagttttgactattgtttttttgacccaaaagctttttttacagtttctgtttctatttgaaaatgtcagattggagtcctcataaatttgaacctaagggtaattaaatatttttaagcgttcataagaatgatgaccatcgctaccgcgaggaccgtcgatcgaatcccaatgccgcgttttaattgatcgggaaatcaatggccaaatgcttttttgaaaattacaatttaaacgcataaaaacaaatattttcaaaaaatggtaatttaaaaaattaaaaaattcaatgaattaagcaccaaattttatttatcccttaacaaatatttgcgtattaattcgtatttcatatctattgataaaacgcaagcaaaattaaaaaataattgcattaaactaaaataatatcaccaattaaagaccatcacatttgtagtgcatcgctacattaaagtagccgcataatccggcgagattggcacgtagttgtgctcccaagctgcacttgtggatggcacttttgggtcaggatcaggcgaagaccaaacattttcttgtggtcccaagatcgctgaaaaataagtaattaaaatcaaaattaaaaaaaaaaaaaactaaatttaattgacctatagccgcggtgtattcctcaaccacttttgcccgctccgatctatactgcttccataatgctccaatctttagacgtaatgcttttttaaggaaagcactttgttttttgcgtttttgctcctattaattcaatgttaattatttatggaaaatggcaaaaaaaacctccaattttggcgcgaaaaaccctttttccattacggaagaattattttgtttggtaataaaatctgaaatactatttatttagaaggtttggaaatcgggaaggtaacctaaggggttaaagggtgcatcatcaaatatattaggatggggagttgaagcctttctacgattcccggcgtttccgttaagggcatcataaagccgactgtaaagccgtgccgtttttacaggcaatacagctccaatccgg

SEQ ID NO: 41034 - DNA, 1225 bp, Heterodera glycines
aatccgtaatttcggtggtcaaaaaactcgtagtttccgcaatccgtaataacgcccagccccctggatttgtgagagaacaaaaaatgcaaaatttcttttcatttttttgttcatttccaattctcttccttctcctcctcttcttctccttccttccgcttcttcttcttcttcctcctcctcctccgactgttggattctctcctcctttttcgtcccatttcttctcctttgttctgttggcacaaaaaaggcttttaaaaaatgtttataatttggatttacgcagcgacaaatcaatttaatttgtatcccaaatttttctctacggcgcttttcggcgcctaacccttttaataagcatgccaaagcaatccaaacacagctcgttcacacctaccggcccttactaccttttccagcgcttttgcggccattggcgccgtttcggcaccgtcgccacttttttccgcctcgccgctgcacacaaattccaccagtcgtggcatttgtttctgctcgtggtacttcttgatgtgctccaggcctgtgatgtgaatgagggatttttgatctcgacaattggttgtactgcttcgagagggccacaaaaagcccgtccaattaatttcataagggagcagcagcaacaggggttttcttgaaatcactgtccaaaaaattctaaattcaaaaccctgatcggtctcccgaccagggttttcaattatggaaagccgtaatacgtgattacgcgagtttttaaacctccgtaattacggaaacccgtaattgcatgcagccctgggtccgaccgatctaattcggctccttctgatcacaaaatccatttcgctcgggttccgatcaatcttgcctaggggacttaggcaccggacattttgctgacttatctctaaccatgactcagaaacacagcggccaaatcttttgttttggccacgtcattgacattaccgaagttaatattcggatggcgtaaaaaatcggacggcgtttgattttctttaaatatttcattttgattcaccgggagggaaattcactacctcgttgtcccatgttttgcccacaaaaagtactgcttgctgtctgtttcctgttactgacttccaatgaacgttccgcagatgaacaggaatggcatttcccgcatgggaaaagagtttggccaaatttgcctccaccgcggccaaccgac

SEQ ID NO: 41035 - DNA, 1223 bp, Heterodera glycines
  misc_feature (1111)..(1111): n is a, c, g, or t
  misc_feature (1204)..(1204): n is a, c, g, or t
aactgatcggaagaaaaccctgacggaggaacaaattgacaagtaaaatactaaacaaataaaacaaatacaattttttctcagggtttgcgcggctaccgggtccgttgagacgacgcgcacgagggactaccgagaggttaaaactaaaactagtcgcatattactgcttttctgctctgaaaatcttttattcggttgtcaggaggcagaggatgggctgggtggacgtgttcaagaagcggcggcgccggaagacgcacaaattttcaaaaaattggagaaggaatggtggaggaagcggcaaataggatgatgaagcggcaaaaacagacgacacagacaacacccaccggcgccgctgccgcgtcgagaccaaccaaccaatttgcgtgccgtgtgttcatcatcataatcataatcaacatctcagagaccgtcctacccatcatttccccctccccccccccaaccaccgcgcactgttagaacaatgccggcggcatcagcacccgcaaaagcgccaccgccgccatcagtcgtccgtcccatcatcattaggcggattatgatggcccgccgctggcggtgtcaatgtccatcgacggctctgtgcttgtctctcaataataataattaattgttatagtctgtgttttttgcgagactcgagaattttgagaacacaaaacattgcggggcgaggggcggcgggagaatagggcattgtcgggtgacgatgatgacacactaatgatgatgatgatgattgacccacttccaataacatctcaaaaaatgtgacgacgacaacgaccttttatcgggtgcgggagagcacacgaacaacacagaagaagccagcaaaccgcgagagagaagacaaaaaaatcaatccgcaaccacttgttgaaatgaatgagtaagcgcggccgcgagggaagcggcgccacccaccgaaattcattaggcaatgctaatgactgcacttaaacaccaaccaccaaaattcattaggcaatgctaatgatgcatggcacttagacaatgtacctgctcgccctgtaaattaatctgctgcgccaagatgacaaacactataattggttgngtttaaagagcactctatcaatttgcgcattactaataggaaaatatttatttaacacagaccgtgacgaaatttttgagcaaagatttttgngacgggtttgtaaaagtgt

SEQ ID NO: 41036 - DNA, 755 bp, Heterodera glycines
tttccattttttctttctccgtcattctttcgcccattccaaattgtttcttccatttttcaattgttccatgacttactccaattttcttcacaatttctgcataattttggtgccattcttttgtcgaatattttcttcctttttgcttatattcatttttcattgccataaatttttgcacaatttcaattttttgttcatccgtttttgatttatatgattttatttcttgaagatttaattctttgatccatttataaattttggttcgatttgttcccaattttttcaaaattttatctttaattttattccattcttttgttgaatattttctctctttttgtttgattttttctttaattttgttgaatttttgaacaatttctctttttttctgttcattttctttttcttcccatttttccccaaatatttcttcaaatgttttttgttccaattttttcttttccgctccaatttcaatttgaataattaaaaataatacaattaaaaagaaaaataggaataatttcattgttgacaatttttctttttctttttcttaaaaattaaaatttataatttattcgatatgaaaaaaagaaataaataataataaaaatatttctcaaaaatgaatttttctcttccttataaatttacattaatggtaaaatattgacaggatcactatatccattaaattgtaaagtgaattttttctctctactgaatgatcgaaattaata

SEQ ID NO: 41037 - DNA, 903 bp, Heterodera glycines
acagactatagggaagctattcacgaaggatgcggtctgtccatacatctgggcgcatcggttcgggcggactgcctcgaaaacaaacaaatcgatctattcaagcgagtgtccgtttggggtactcaaacaattatggggagcaaaaatccaacgcagaattaaagtacaggctatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttccttacagtatccctgcaaagtttggtgcgcttctgatcacttaagagaaaaaagttaagcctaaactttttggcctgtttaaa

SEQ ID NO: 41038 - DNA, 952 bp, Heterodera glycines
ttgggcctagttaagctgtcaaaaaaatttggagcgattgaaagagaatagaaagagccaggttcgatgaagttttggtaagccaaaaaaaaatccaaaccatttaaaaatctataaaaaatttaaaaatgagaattcatgcgagattttctggaaataagcttaatagggcctagttaagctgtaaaaaaaatttggagcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggagcgatttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaatatttaaaaatctataaaaaattta

SEQ ID NO: 41039 - DNA, 1423 bp, Heterodera glycines
tacaaatctgaccaatttcaaaatctgtcatgacagataaagaaacaatgccttccaaattttcatgcattacagtaaaagccctcctgtaggtctcttgttgtcggttttgcataagcacaaatgcacttgggacagaagattgatcaattaaaacattcaagctgtaaagctgaagcaaatttgttggaacaaccttaattattcaaaagttaggattttctttttttacatttcgtcccaaaaactagagatgaaccaataaatagaaaacccgtgaagctgagcttaacctccaccgtttatgtaatttaaaaaatgttccgttccttaaatgttccatctccgctccaatgcctgtgccttcttaatcgctgaagaccgtgatcagttgcaaatataaaaaacacaggaagatttggttcattctgtcttgaatcatggagaagaaaacgcaagccatttttgtcgacaataaattcgcccttaatacaacaatttgaaaagaagaccttagggaaatatacatccaaaataatttcattcagcgtttcccggtctacatttcttctgccaacaacttctctttgtctttcaattgcacgctgagaggtcgacgatgatggcatttgcattaatgcttcatcatcaagcccagcacgggattgtccaattaaatttcgtggtctttggtcgaagtttgcccttgcatgttgctttatgtcttcttttcttcctcgcacctttaagtctatcatttcaatatttctaataagctcacagtatgtttcgcagaatttgggagatgattatgctgtgtaatcactctcaattccactgagccaaccgctgagtgtgctcggcccatgcacgtttttagcgggcaaacccaaacttgggtttgctccactgctacacttgttgttttacttcactgaaaacattgcaggtatccgacaactctgctcttgcaacacttttggatgtgggcacaatccgaatcgaaggaacacaaaccgagacaatcaactgaagcaaattcggctttttacttctcaccttaccgttgtatttcttattgtgtaatttccgttaaaacctttggcactttcatccgttcctccgccgttcgcttctgccgggcacagtccctgcttttcctttggcttttccttctccctttgcttctccctctgctgcttcgcttcgccttcgaatttcgtttggtcattgaaaatttcgccttcggcgttcgtctactgttctttgaacaactgggcgaagggaaaggctgaaagggaagaaaaggaacaatcgcacaattggaagtgatcgaccaaccacagcaaattccaattcaatcgaagggaaaatgcgatgaaatgaatttgcagtccaacattcgatcgggaatttggctatt

SEQ ID NO: 41040 - DNA, 912 bp, Heterodera glycines
aggggaagatcaaagattaagatcgacccatgtgtgctctagaggcaattgcgttgtcgccgatttcctcacaaaggggccgtggtggcagaccatccaaaaaaataggcggtcatgatggctcaggcaggagcaaatataatgattccatgagggagagctagttaatggatcataggtgtgaatctatcacagatgtggttgtttttccatctgtcattgataaaataatcttcaccccagtgcaaatcaattttgcaatcacgtgaaattttacctgtagaattaggaagtgggcagcaaatggcctttgaagccgtgatggtgaaacagaactttccacaaggtaaggtccaagattcattgcaacgtggtggaatagtctgagccagcatttcagttgacgacgatgttaaatttaagatgaacaaccccgaaaacgccctagaaattttttaaatgatttaaaaaataattttattttttatggtctgtaaagtgcataagtaccttttttttagataagtattggtacataaatatttgattgtttttcaaacacacacatatatatgcttcacaggcttttgccttttttgtcgaactcacttgttcaaaggcaaatccgtttccgttatgcaattaaaaattatttttcagaaacattgtctcaaaatttgcaagaatggtatcgtcagccgaatcgacagttcaccagcaccagtctgaatccaataatgacgtgtcgacatttgacccaaaatcagtggaaatattgccgcactgctacccgcaagcgccaaggggggacgtcagagacaattaccacggcacaatggtttgctggtagctgagagattactcaaaacctattttgatttccttaggtttatgacgcgtacagagcgctgg

SEQ ID NO: 41041 - DNA, 1042 bp, Heterodera glycines
aaaaaatttgcagtcaaaaaattattcgaatttctccattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccatgtggcccaaattttaggcccccagccacagccccttgcttctcccaggtttaagtcttggatttgtcaataaatttcagacttcaattaataatcaaaaattctcttaaaatttttttga

SEQ ID NO: 41042 - DNA, 1143 bp, Heterodera glycines
  misc_feature (41)..(41): n is a, c, g, or t
  misc_feature (89)..(89): n is a, c, g, or t
  misc_feature (113)..(113): n is a, c, g, or t
  misc_feature (1114)..(1114): n is a, c, g, or t
  misc_feature (1127)..(1128): n is a, c, g, or t
  misc_feature (1136)..(1136): n is a, c, g, or t
tttaatattcacagtgtattccaatataaaaattctatatnaattatgtatcaattaaaattaataaaaacattatttattgtattatntagtttataaattatattgtattnacataaataaatattgtcattaattgtgtcattgtaaaatcagactatttttttatttaatatttaaaagtgtttaatataaaattctaatgaacatacatatttacattttcaattgatttttggttacattgaatttttatttatgtatactttcgcccatttaatattttaattgcttattttttttaatatattatttcttctgtcctggtaatggttatgttagagacaataggtaaatttaactataaataaattaattttattatgtgtaagtctcattacgatgaatccttattttattgatcgcacccaaatatcaaaacggtcagtgaatacttgacagtgtctttattgttgtttttccaaattatatatataaatagaaaaacttttaattcatatttcaggcatttataatttctcttcgttataaaaaaataaaattttacatttatttagcattttacataaataattagactgataaaattcgtttatagattaattatggaatatttaaagattgatttacaggaaaattatatctaattgtactttatttatatatatataatctcattattccatgttagctattgactcagtttgctgaatcgttcaatgttttttttaataaaattttatatagtgcaaacatcttcttgtcaagatggtgttaatccattgtgattcattctaacggcgaacttgttatgcatattcacagaggctcagtgaactggttcttatactatgaattaatttacattttttcaaaatatattttaattcaaattttgaataatcgaattaattcttttttattactctggttgagaattatatttaaaagattttaaaaacgaaaaaaaaatgaaaaatcacttatataaattcctggcgcagcggttttatgtacacaaataaattaactttcaacattaatcaaaaataatgacaattttgaattttaatattcacgagtgtatttcaantataaaaattctnnatattaanttatgta

SEQ ID NO: 41043 - DNA, 950 bp, Heterodera glycines
tgcccacatttttggaatcaatggaagttttaagtctctccacaggagaaataaaatttgggctaataacaatagacacatattattcctgatataggtactcgaaaaactgactttcgtatttttttttcttaatgtcagtcaatatttgcccttttcttgcacttacttatacataaatttttctgagaccttaagctttcgtttgataccaaaaaatgtatagacattgaccaaataagcaaaaaagttatggaggatggtcacgcataaacactggaatagagccaaaatggtttaccactttgcctatgttttcgccactatttttacacacttttcacatttgtaattttttggtaccccaatttaagcgcaattttttttttgttttgtttttttttacccaataaacgcacaaccacacgcatcgtaatgtcatcaaacttggacaaaaacctggagaacattcgccgaattgaccaattcgcccgcaaagtgatcgaacattgcacccatgcggcactgttcaatttcaggtttacatttacatttttgtaaaaattttctcccataatttttcgaattgctcgccactttactaaatgagtgaaaatcgcacaatgcataaattttcaatatcggatgggtttctaatccccgagaatttccatgaaaatttcaacttggctccacatatggcaacctttcagggattcagtcaaaattttgcttcaaataaattggcaatgaatgggtgtcaatttttgggtcaccaatttcgcggcgttttcacaaaatttctttttctcgggggttttttttgggttacagattttgttttcttgttttgtttcattatcgtcttacagtcagaggaaaattttttgcgatttgcattttcgtgactgattgtgtgataaatttaccggaaaatgccaccccaaaaa

SEQ ID NO: 41044 - DNA, 938 bp, Heterodera glycines
ttagaaaccaaaaaattgatataatttatttagatcttcaaaaagcctttgatcaagtcccgcatgatcttttaatatacaaactcaaaaaaaccggaataacggataacttattaaattggcttcgggattttcttcttggaagaacctttaaagtaagaataatcaaaaattttcaaacgaatttcctgtcaaatcaggagtcccacaagggtcagttctaggacctattttatttttaattttcattaatgatttgcctgaagaaattccaaaagaaatctcaattaaactttttgcagatgatacaaaaatttatcattgctattcaaatgaatcccaacgtagttttagaaacagctctaatttcagtctttaattgggctgaaacatggggcttaaatttttcagtaaaaaaatcttccgtcttatatctaggtaaaaataacaaaaaaataccgtacacaattaaaaattcaactttccctgaatcaaaaattattcgtgatctaggtattttaattgacaacaaactcaaattcaacggacatgtttcaacaattctccaaaaagcttatctcaaaagcagaattctttttaaaaaaattaaaaccaagtcaaccaagacttggattacagtttataaaagttatattcgaccccttttagaatacgcaaccgaaatttggaatcctcgaaccaaaaaagaaataaaccgcctggaaaaatttcagaaaaactttacaaaaaatgttttcagaaaatgctgtctcccctatatctcatacagcgaaaggctaaaatttctaaaactttccaagcttgaaaccaggagaaaatatcttgatatcataacagcctttcaaattatcaaaaatactactcaccttaacccaaaaaacctttataatttttcaaataggaaaagatcacctttt

SEQ ID NO: 41045 - DNA, 116 bp, Heterodera glycines
ccggctacatcggtggcagcgccgccaacgcccattatgagcgggtcagcagcggccagaccggtcacgccgaagcggtgaagatcgactacgacccgcgccaggtcagctacggg

SEQ ID NO: 41046 - DNA, 616 bp, Heterodera glycines
ttaggtctatcgtatgatagcaagattgtacaatttagttgcgtctgagaaaagttatgagttgatttagtcaaaagtttagcaaattttgcattttttgtccatcggctaaccaggtttaacagactattttttagaattaaaggaatttcacttttttttgactttctaatctaggttttcgtcacgaatctgtgagtgctctgattaaattcattcaaatttctttattgcttttgcttctcattctcgaaactctcaaaaacgccgcgggggaaaggcgtgggatgggtgccacactgacaatgagaatgagaatgatgggtcccaattggaacatattttcattttatttattattattgaatatcatttgactttgtgttgttttatattattcccttatttcccccccccccccccccctccgcccatttccctcgaggggttttcccatggattgaatggaataatggtctttaattcaggaagaaaagttgatgggggaaagaggcaaaagtgggggacagggggaatgatgggggacacaaatgttcgttcttccacaactttacaccacaaaaccgtcatccaattgccccgggggggggggggg

SEQ ID NO: 41047 - DNA, 833 bp, Heterodera glycines
ttgtacgcatcacgcttttgtgtgtccagtgtctcacgtttaatgcgttcaccttgggaatcattttaattttattttcctatttttaattattaaaattaccaaaatcgactgttacgtaggtgaaaagttcctttgcattgccaaaatgaatgacgaattggcgttggacaccataaatttcatagcttaatttgagcacatgtcacttgagacttggaattttgaaaaatttgaatccgagttgagccctaaaaactcataccgaccggattttctagtctttcttcatattaatccaatttgtatcgattcacatagaatggagcaagtaaaacctagtggattcaacgcaccaggattgtgtttcaggtcttaaatccagattttctggatgctatcaatcaggttaaaagccttatgtacgagagtcgcggtctcgagtcttttttaaagtctcgagattagtgagtggtatttccaaaaataattaatgtactgtatgcatacagtattttcttcacctcgcgagaaaggacgacaagccgccaagcttgatgatttgttgcccatttatttgttcggtagaaacggaaaagccgcgccaatgatggcgttgctcaagtgatctgttgaccaacatgttcttgcaatctttgtccaaattctgttcagttgagtgatttaatatttccaatgtttaaatttcaaccaaaattagcacacacaaacaaaaacaaatatatatttttaatctttttattaattttcgcgcaaattcggtttcgtttttattttttggctttcgaagtaaagcttataatttttcaatc

SEQ ID NO: 41048 - DNA, 1153 bp, Heterodera glycines
ttctttggcgatgatgatttgaatttgcctccagggccacccaatcttcgtccacagccaaatgcccctccgtcacttaacagcgaccaacagaaggtctttgatgctgttttgttggcaatacagtcgaaccctagggatccgactgtcccccgccgtttcttcatatacggcgatggaggtacaggaaagacattcctgtttggccaaattattaggcgcttgcgaaaggccccatacacctacaaagtgcttgccacggcatccactgggtgtgcagccattttgctgccatatgggaaaacagcccattccacgtttcgtctgggtagagaagtgtcattagacaagctcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaatcgggctcggagaaaccggagagcacttctggattcctccacagttcatcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgtccactggacatcgatgagatcgagtccgaagtggctgcgttgaaccggcgcacagactcgggcatgcccccgcacagtctccggcttaaagtcagatgcgtcgtcgtccttcttatcaataaaagtgataaggaaggactgatcaatggcacacgcatagttcaggaagaacttggcgatgatcgcctcattggtcgtgtta

SEQ ID NO: 41049 - DNA, 1339 bp, Heterodera glycines
  misc_feature (30)..(31): n is a, c, g, or t
  misc_feature (53)..(54): n is a, c, g, or t
  misc_feature (145)..(145): n is a, c, g, or t
aagattttttataagcatcaaattgcgtannggaagaattcttcacattttgnnccaagaaaatatttttatctcaatatttgattatatgattaggaagctcataaaatgctacaataaacgccaaaatattagctcgtttatntttcattcaagaaaaagtacaacaatttgtctcggtttcgcatttgtccttaaacataaccatgagtaccatagaattccaacgctcaaaatttttggaacttggaaatccagacccaaaaattttcagttggtatttcggttatccaaaaattgagttccgaccccaaaaaggtcagaagtcacatttcattatttctcaatgcttacaagcttttcttcaatccaatctgccatatgatgagaaatttcccccagtagcgtttcgattgctttcatttctttttcgatctctgtcatgttgccattgttggttatattggaacattgtgtggcaatgagtgcctaaagatttatcaataaataattaataaggtgaatttaagtgtgttatcattaaaacttagatagaatagctgtttcttacagagctgtcacatatgttcgaatttcttttaccgttttcaaaaggtcttgtcgtgcaaaatcggcaaaacgtaaaagttcagcacggagccattcatttccctcaattgcggttttaagccaacaccttaattttcgaccaaaaaatttgatacaataaaggaatgtttatgatgacctcaattattttgtttttccaatttcgtgaatcccaagaattatgtgcaataaaaattattaaggcattaaattatggaaaaccatatttcccccgcggattatgagggttgtttttaaaaaaattattttgagcttcagggatggattctgcccatatttgaatttttattatggtattttttacgagtctgcatccaataatgaataccgcaacataatatacaatctatacagttggcataatcgaagtgttaaatttgtaatttatgtccgtacccctgttcaggcccaatgcgcaatttatgaagctctttttcaatacgagtagtgcttaaattgtctccggcaactgtaaaggtaaagcataatatattttcaaatgcaaataaattttgcttcgggactcggatccgccaaattcccttttcaaaggaccgatcacttattcatgagaaagttcttcaaaaattttttgacaaatggaagtgtccggcggtgccgataggagctgtctgggaatggggaaaaatgccgatataaaaggggcatctttgaaataaaggacggccaaatttcaaaaagattaaaa

SEQ ID NO: 41050 - DNA, 1139 bp, Heterodera glycines
  misc_feature (1064)..(1064): n is a, c, g, or t
caaacgcgccgagaaaaaaattccagaacaattcgtattggcgtgattaatctgagaatgcggtggaaattccttgcactgttgagcagaaaaagagatagccatttttccaatcttttcacatacaaacgcgccgagaaaaaaattccagaacaattcgtataggcgtgattaatctgagaatgcggttggaattccttgcactgttaagcagaaaaaaagatagccatttttccaatcttttcacacacaaacgcgccgagaaaaaaattccagaacaattcgtattggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatatccatttttccaatcttttcacatacaaacgcgccgagaaaaaaattccagaacaattcgtataggcgtgattaatctgagaatgcggttggaattccttgcactgttaagcagaaaaagagatagccatttttccaatcttttcacacacaaacgcgccgagaaaaaaattccagaacaattcgtattggcgtgattaatctgagaatgcggntggaattccttgcactgttgagcagaaaaagagatagccatttttttccatcttttcacatacaaacgcgccgag

SEQ ID NO: 41051 - DNA, 963 bp, Heterodera glycines
cgacaattaattctttatttaaaatgttttttagagacctactgagaaacaatacaaaataatttttaaaaaaattttttcaagactagcttataaatcatgaatattaaaaaatatataaattacctgaaagaaatattattagctagtgtcaaattgtctaataaggttacattttaaaaatcagctaattaccaaattgattggaataaaatggtaataaaaatgataatagttagattatgtagataaaatttatttcaagtcttaaaatttggttttcttttatctgacaataattatttcttataattttaattatttaaaattttcttttttaaaaatgacaatgtaaatgaacacataaaatagctttattataacataaaaaatgaattcaaaacaatgaagatgccgaaaattattgcatatcggtttttgaataggagagaagaattcatgaaaactttgaaagaaaataaattaaaattttttctaaatttttaaattactttaaaaatatgatagtttaaattaaaattaaacttaatgaaaatgagacccaaaattaacttaaataattacaatatctacctatgataaaaaaagtaaatagaaaaaaatgattttttttagaaaaaatttattatttatatcaatgaattaatctttaaagaagaaattggacccatatgacaagattaaatttgctctaaccacaaatgggggaccaaatgttcaccaattaaatgaattttttaatattaatgaaatatgtaatagaagaaaattttttaattgactcaggaaaaaggcataaaaataaaacaataatgtttgtgaaaataagataaacatcaaatttaaataaagaactaacataattaaaaatactcatatgtttaattttaataaatcaaaaaaataataaaatataagattaataaattagaattgagaggg

SEQ ID NO: 41052 - DNA, 861 bp, Heterodera glycines
atttttccttaatttgatatatagatggaattttgacttctattgagacgatttctatttcttcaagtttttcttttataaaacattttttgttttgtttaaaggactaacgttattaccatttgtttagcaattaaaaatcaaaattgttcatggtaatttatggtaaatgcatttttaaaagcaaaattgaatatattaattctttacatttcaaataattacagaaaaaggagaaaaacaaaaaaacatttcgacaaaatgcaaaacaatttaaagaagttataaaaaaaaattatcatgagataaaaataattaattattgaattttaatttaaacacaccaaatcaataaataagaaaaaatttaatttaaaaataataaacacacaaataagaaatataaccatataatttaatcaaaaagctaaaaagcgcagaaaacactgcttattttatcagaagcgggaacaagagtttaattaaataaaatagtgacatattccaaataaaaaaatttaaaaaaaacaatatttaaagaagaaaaaataaatcagtttagaaaatatttttccaaaatttgtatttttgattaattaaatcgctttttaattgtgaggactaaataataaaagtgatttgaaataaagtgattttatattccaaaattgcaataaaaataaaaatttttgttttattttcttccaattatatttaaagattaactaaaaaattttactttttattttacatatgaattctcttcgaaggttaaatgccaaaaatataattcaaataaattcgagttgttattatttaaattaacattatacaatatttatttttgctttcgttaatgat

SEQ ID NO: 41053 - DNA, 1058 bp, Heterodera glycines
  misc_feature (959)..(959): n is a, c, g, or t
  misc_feature (1030)..(1030): n is a, c, g, or t
gatcacaaatcggacattaattttcaccaatccctcccccctaactcgaaatcgaaaaaataaaaataatcaaatatcgccaaattacgttttttgttcaattagattagagagattcgtaattggttgaaatatttgtcaagttcttgatcacgaaaaaaacttacgagaacaattttatactttgcaagtagcgcctttattttttattagtttcttattgttaataattcaaaaaaatttttttttttttttgcattttacattttttaaatgattaatttgtaaacattccaaatttgtgatagactgactaatcatggctttgcattacacatgtgttgaagcatgttattcgcatgaatttgttgcgcaatataataatatttgtgtgccaaatttggctccgtgtcgcgccgcacatttttctcgcattcatttttattattttttcgtatttttcccatgcaattaattgttttatgaataatatgctttttcttgggattttttaaagatctaagtttggcaaatttagttcatatacttactgcctgcgccgagaatttatttattcatttcctcaaccaccagagtcttgccatttctattcatttttagttttggtttttatttttgaaattaatttgaatactttttgttttaataaaatatgaaatgaaaaactatagtaaatttgtccctttaggaaattaaaattctagcgaatttttttccctcgcaatagaaaaatgaaattaaaaatagaaaaaaaaaagaattttttcatttgtttggcgaagacattttgatttcctcaaaagtgcatttttaatgacatttatctttttaagaaaccctttaaattccttttttttctcttttaagtggatttcttggcatttttaaatgggtcaaaaacatggttgtggcataatcccctttttggcattttttanatattttatttttaagcttaaccgcccaacatcttggttttcccgaagtcgaccatttttttgtggttttnctgcataaaatattttttcgtttttaca

SEQ ID NO: 41054 - DNA, 858 bp, Heterodera glycines
aaaataaacaaaaaagcgaaaatttcgcttttcaggttgatttttctccaagatgagtaaattttaaggtttatcgtgttttttcttgtaaaatgatttttaatatagtatttaggcatttttgagggttttaccttacattgagcgaatttgaagaaattttgaaaatttacacctcactttggaaaaatttatgtccatatttttgccattttatatgtccatatttcacgatttttggtcaatgttttaatgggcatatttcgcgattttatatccatataattcaacaccctagtaattaattgttgtttctctgcttggcaattacctgcattcttttgaaatgtttaatttgaattgctttaaatgctttaaaataaaattatgcgttttttccattttctgatcactttgagtgattacaaaacacccatctgaaatcaaaatttaccaaacaatgacttatgtgtaagcacggttctgttgaaatttgttttttcgttagcaaaaacaacttttgtacaacccaatttgatgacaaatcacaagcattgtgaacgcgaaaagaattcattcgccattgcttttgtgcttttgttgttttacagttgcatcaccctgatcaaccaaccatttggccatgcttttgttgtctctttttgcctctgattgattgcttgctaatacttttcaccctcgcccccccccctccctccatttttttggatctctctctctgtgtcacattaaattaaattatataaatattgtgaacactgtgactgatgtattattacttgatgctgttcgacatggaaaaaaacccccctttctgatcgaattttgataatattg

SEQ ID NO: 41055 - DNA, 1294 bp, Heterodera glycines
aaaatttttgagacttggaaatccagacccgaaagttttcagttggtatttcggttatccaaaaatggagttccgaccccaaaaaggtcagaagtcacatttcattatttcttaatgcctacaagctcttcttcaatccagtctgtcatatgatgagaaatttcccccagtagcgtttcgattactttcatttctttttcgatctctgtcatgttcccattgttggttatatcggagcaatagtgtggcaatgagtgcctataagatatctcaataaataatgaataaggggaatttcagtgtgttatcattaaaacttagattgaatagctgtttcttacagagctcatcgcatatgttcgaatttctcctaccgttctccataggtctggtgggacaaaaaaaataatgcaaaaagtgtaattacgagtacaagcataatttaagcatttgaacatttgataaaaggaaaagcaaaaagagatgaaatcactaaagaagaaagaacggagagaggcgaacggaacggcaaattaatggggggggagggggaattagtggcaaaacaaagactaattgactgataaatgccatttggggctgaagaagaaagtaagaaaaagggaaaataagagaattattgaaaagggtttaaagaatttttattttaaactcatttcatttgcgttttgaagaatggatgttggaatacgaagtgagtaaaaatttatgtgggaattcggggggggggggggggcaaagatacaaaagacgaaggaaaggcggaacaaatgaaaagcaacaaaagaatggcaaaaaaggcacttttgaaatgccaaaaaagccattcaaatgcaaaagtaggcaaattttcatacggataaagaacaaaaataaattattttttctgattttttcccttttccttcaaaattccgccacttttgtccaccttcttcggccattctctcatttccaataaattgccccaataaaaggaaaatgaggcttatggacagctgactgactgaatggtaaattggcacgggaatggcaaaggcaaaaggcaaaagaggaggaaccaatggccactcaatttccattcagagggaatgagtggctaaaattatgtgttcaattgggggggggcaattggaatttaaaaaagaaaggaaaggcaaaaataagaaaaaatatcggcaaagaaagacgaaaggcaaatggcacaacagagagaggaaaagtgagcagagcaaagggaaaggcgtgaataattaagtaatgagaaagctta

SEQ ID NO: 41056 - DNA, 867 bp, Heterodera glycines
  misc_feature (851)..(851): n is a, c, g, or t
gttattggacagttttatgttgacatcccccacttgatggttttttatataacgaccattttgatcggtttttatataacgactccagcacctttattagccattaaatttatcggtaaattctgtaaataaaaagtagcgaaaaagtttttctcatttttgtacaaattaataaaatttttatgaaaaagcattagaaaaatgataaattcccgcttacaggcgctcgatgtgccaccgtgcaaaattacattggctttatccgtttggcgaaatttgaaaaagcacaaaattcattaaaaaatttatgttttataataagactggaaaccaaatcactaaaaaaccaagagaaattaaacatgattattagattattaatattaaattaaacaattttaattgtcaaatttaattggctaattggggacagactccttgcaaatcttacacctaccccactcgtctttcttctcaatcgattaaagagtacaaaacgtgaaaaaagcacattacaaatttatttaatttagacataatttgtaaaacttttgttaattaataactaataagtctatataatatttaaataatttaagcggtaaaatacggtagcttaaagtgttgacaaaatgcgaaatgagcaaagcaaccattaactaacgaaatatgtgataaatttaatatcaagtgaaaatgcaaatttgtttcgataattttaaaagaccagcttaaaaattgtgttttccgctaattaaactaatgatgaaaaataaagattttaaattaaaacaaagtttataaaaatttatatatttttttcatgtttcaaaataaaataaagatataanatggaaaaaccttaac

SEQ ID NO: 41057 - DNA, 806 bp, Heterodera glycines
gcataaatgccataccaaaattgagttaagatctcttcgaatgggtctgcaattctactcgctcgctgttgtttaaaaaaaattcaaactttggcctcaaaacggaaaagtaccaaatttattatgaatctgattgtgagctcagattttgtagtcattgattctgtcaatgatttttggtactaattcagtttgggtcccggttttcggtcaaatttttcaaaagcgtaaccagacagtcagacagtgcactatttccttctttatttttctcacctcttcccttttcccacacacaatgctgctgcacagcgagcacacggctgtttactgtctacccttccacggggttggggtcaattccctaccgccaattccctaccagccaattccctaccggccgattccctactaaggcatttgggccatctccgtaccaaaaaatttttcgaaaattttcggaaaaatttcaaaaacagaaaggggattttcaacattttgatgtttctcgtgaattataagacaataaattttttgtttaatgttgcagagaagaaaatgaaaatacttctaacaaaaaaagaaccgtacaaatctttaaaacaatgaccattcatactttttcacaaatcgaagtaaaaattttaaaatagtgttttgtctattttagcagctttatccagtctccggattcttaaattggatcgtgaattttttttcgaatttacaattgatttcaaatcgctttgtaggaaggacttcaggggcccgaaaattaggaagtaaggccggggtttaattattca

SEQ ID NO: 41058 - DNA, 907 bp, Heterodera glycines
agtagatagactagaaaaaattgaaattttgaaatcatgttctcactcccttctctcagaggtattattttgtaaagtcttttttctccccaataaacttgtcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtaaattagactagaaaaaattgaaaattttgaaatcatgtttcccactcccttctcccaggggtattattttgtaaagtttttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttatcgaattctgaaccgttttgagtagattagactagaaaaaattgaaaattttgaaatcatgtttcccactcccttctcccaggggtattattttgtaaagtcttttttccccaataaacttttcaaaccccatttttcgcaccgtgaatgttatttttattgaattctgaaccgttttgagtagattagactataaaaaattgaaaatttaggaatcatgtttcccactcccttctcccaggggtattataaaggaagtcttttttcccccaataaacttgtcaaacccc

SEQ ID NO: 41059 - DNA, 805 bp, Heterodera glycines
ccggaggaccggtcgttgaatttgtacgtgaacctccccccgaggtgctgacgatgcaccgacacccggtggcccacctttaaacggaatgcggggaaaagtgagggagggacaaagggacaaaaacgccgtggggcaagggacagccacttcaatgggggcattaattaattaataatggggaaatgaaacggaaacccaaaagtggaaaatggagaccaaagtattaatagccgtcacttttcaatttaattttgtctctgttgcctcggctctgccaatgctttcgtctcttaaggttggctacacgcgcggcttccacgtctggcagctgaattggccggtcaaccaacgcggcacccacgcggtcgtcggcgtggccaccaaagacgcgccgctgcacgccccgggctatgtgtcactgattggggcggacgcggagggcttcggctggaacattggtgggcaaattgcgcaatttgtgccacaaaaacgctgaaaatgccaattccgtcgccagtggagaacaaatgctaccacgacgcacagaacacaaagccatggtccttcccttatgagcagccattcgtcgcgccggagaagcttttctgcgtgttggacatggacgagggccaattggccttcgccaccgactccaaatatttgggcgtcgccttccgcgggctcaaaggcaaaaaactgtacccggtcgtcagtgcggtgtgaagacactgcgaaatcactctcagatatttggggcggattggaccgtaagtccacgaggattagaattattggcaaaaaa

SEQ ID NO: 41060 - DNA, 727 bp, Heterodera glycines
ttgatgtttcgcagctacctcagcggcaacaggtccgtggtagtgggaaaaggacaacaaattcagtgtagcatatcgtcaaagagagtgctcttctgcggatcaacaacaacgacaacggtgatgcctattgtcttttttacgctttggaggcaagcagaaagtaccacagcaaagagatgagccgaagaaatttctgttattatattaaccatcagaacggacgacaactggaagatgcactccgtctaatgagcgacgcgaacattcgcaagagatagacccgtggctcaagtgggcctggtgatggagcaaatgtcgtgcggagaaagtgacccacgggggacgatgaagcatcggcagagaggacatcttgaaccaaagtgaggacagaacatcgcctaaagaggcggaatgccgttggcgttggcaaaggattggtcgtcgctaacagatgacatttcatttccagttagtggttgaacaatcacaagcccaaccatcttctcatcaccataccccaattgatttatccgatctggtaaattattacccgccgccccacccatattcgtgcttctactctccgccggcccactttatattgtcctttgagaatgaatagataatggcggatgagaaaaatcaaaacacccaacatttgggagatgggaggggggatgaatgggacgggggggggggagtgaaaaacattcgaaagagatgg

SEQ ID NO: 41061 - DNA, 1270 bp, Heterodera glycines
tgagaagaacacctccttatatagagagaaaaccttggaatttgggatatggatacctacctacggtactacctgacttttgccctcccttgttgcgtagtactataaatattgtgcccccttttcctcccttttcattcattcttttttcttttatgagtgttttactctgttttttgtgaatttcataaacttcactgtttcaaaaagacatatttcttatcttaaccagtaaatacccaacccgaattccaaaaattatcgacatcgacctgaaagtttatcagagtttccctgactggcctatactaccaaatttgaacctaaatttatcaaatttttttttacaaaaactgcaatttccctatttttaaatttataattcatttcattatgtattgtttttatgttttttccttttttagaacagaactatttgcgtttatcatcatcatcccttcattgtgcaataacaacaacacttcaaaagcgacctcatcgccgtttctcatcgttcattcgtccgtccgtccttcacatcaattcgctcgccgttttcgcaatggcacgtcgacgcatccaaaaggtggcaaatgacaactctctgatcaaccaatgctttaaatgttttgatccatttgcaggaaatggcggagctgcatcaggaactggtcacgacgggttacaccgcggcaccgatggatgacggcagagacttgtaccattggaaggcctccatcaaaggaccgcccgagtcgccgtacgaaggaggcaccttccatttggacatcgttttccgtcgcgactacccattcactccgccaaatgtgaaattcgacacgatcatttaccatccgaacgttggagaaaggggcgacatttgtttggacattctgaagcagatgtgggcgccgtcgatgaccatttctaaaggagaaggagaccacaaaacggcgaccagatatcttacttagagcgaatgtttccacacttcaaaacagacatgtcaaaactgtagtttttgtatctgcgatattttgtacgtctgaagatgtctgagtgagtttatacaacggtggatacatatatatctactgctatattacaatatacgaatcggaatactcttacgtcttatgatagaaataggaatatctgatatatcatatgtatatttttattcatatcatcgtcctttcatcgcattggatatgttttgatggcgccgtgattgttccattcatctctgtgcttattgatcccatgatga

SEQ ID NO: 41062 - DNA, 741 bp, Heterodera glycines
  misc_feature (51)..(51): n is a, c, g, or t
  misc_feature (58)..(58): n is a, c, g, or t
  misc_feature (63)..(63): n is a, c, g, or t
ctaatgtgatataacaggttaattcttttcctttcatctactagggaaagnttggggngcttntgataagtttctgacaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattatgcaggaatacgtatcggaacactacaaatgcttactaattttcttagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaatttttattcatcgccgccttttgatagaaaaagcatcagagtgcctaaactaatatgtaaataaaaatttggtgcgtttcagacccctttctgaaaaa

SEQ ID NO: 41063 - DNA, 989 bp, Heterodera glycines
atttatcaatatattgtttgagtttgatttagtggttgttgtttctcagtttgtttgtttgttcattttttgtgttcttagcgtgaaataattatgctaaatgcttaggcttaatgtttaatctcttattagatttttgattctttgtctaatttttccgatttagcaaaattgaagtgcttaattaaaataaattgtcaacaggtttaaaaataatgttctgctctgccggttcggcaatatcttatcataatgcttagcatttcggaagaaaaagtaaattgcttttgtactcagaattatgtaaaagagtgctataattcgtttttgtggtttaaattgatttagatttttcttatgtaattgtatttgcaaaatttagataatgagctaagtgggatggcctaactttttgttgaatgccttgggattacgaaattcccaaatgcagatgttatacagtttagcgcagaaaatggactcatacttattggaaacttgtaagttcttaattctaagctttaatttgaaggttttaatttgactatattgtttgcaaggtttggaattgtttgagaaaaagtgttgttcgagttagaaaattgcattcgtgtggtatgttgtttgtgttagataatagtgtggtgtgcggttttgtgttagtaaaccacattaatgtggtgtgtcgtttgtgttagacaatagtgaggtgtgcgatttatgtcagtcaaccacattagtgtggtgtgtggttttttagacaagaatgtggtgtgttcatgttttgataaaacattagtgttcgttctgtgagtttagtgtgacacaataatgtgcgtcatgttcgcgaagcggccgagtcgtaccttccaagaaaatgccaagaaacaaaagatgaagaaatgctatgaatgttgtaccataagaaaatgccaaaaaacaagaaaaaagaagaatgctaaaaatgttgtaccataagaaaatgccaa

SEQ ID NO: 41064 - DNA, 666 bp, Heterodera glycines
tcttcttattgtacttttttgattttctattatctgttatttcttatcactggcaccaaatgtgttaaattattcttcatgtactgtcctaacacttataatcttatctcaaatttagaatttccaaaaaaagcttttggtttatttttaaccaaattttcttgtaaattttactcttttcacctctgctgtctgatgcaacgcccccccccccctccctgccccttatccggctattttttttgtctgacatttttattaattattaattgtttctatttttagaaaaatgattataaaaataattttttaaagctttgtgaatccattatttttctgaattgactaattgccctttttaaaatcgcatgattttaaattgtttacctcaagcatttaatcttattctttttccttcaattgagttttgaaattgctacctgttttttatttatttaattggcacatcttttcttgtaattttctcttttcacctctaatgcaaccacccccccccctcgctgcctcttcgccgcttcctccttaattagacccccccccctttctgatgcgaagggatcctctgattttgcccttcttcgacatccccttcctaccttttatttacatatgtaaacattctacagcaaaactattaagtttaag

SEQ ID NO: 41065 - DNA, 934 bp, Heterodera glycines
  misc_feature (6)..(6): n is a, c, g, or t
  misc_feature (53)..(53): n is a, c, g, or t
  misc_feature (57)..(57): n is a, c, g, or t
  misc_feature (62)..(62): n is a, c, g, or t
  misc_feature (67)..(67): n is a, c, g, or t
  misc_feature (181)..(181): n is a, c, g, or t
  misc_feature (219)..(219): n is a, c, g, or t
  misc_feature (288)..(288): n is a, c, g, or t
  misc_feature (444)..(444): n is a, c, g, or t
  misc_feature (501)..(501): n is a, c, g, or t
  misc_feature (528)..(528): n is a, c, g, or t
ttttcnggggataaatccatatttcgacattttgtgattttttagggatattntggncattnttggnaaattttcacaccctaatggaaaaaagggaaaaatagaaaggtaaagttgaattttttggaaatttttaaaaattagaatggaaaaatctgaaaaattttgtgttttagtagtnattttggaatttttaaataaatattttgggtttgatantataaaaaatattttggaagttggggagtaaaatagttttttttgggagaaatttagtattttgagaantatttttgagtatttagatatttttttgaaaaatttataaagaaaatgaaagaaaaaatataattataagaatgggtaaaattggtttgggagtaagaaaagtttttggagtataattttttgtttatgaatgaaatataatttttggtattattngaaataaaaattttattaggtttaaaaaaagttatggtgagaagaattgaaaaaatnagattttgtaaattgtttaggtataantttttgtaaaattaattaattttttaaaaatttttgaaagatattcatccctcattttttcttgacaaaattttggatttacaaaatgtcaatattttataaaatattagaaggaaatgtaacctcatttgcaatagcacccagtgaataaaataaaaattttgctcaattttgggctgaaaattatgtcattatggatttttccgccactattttggcatttgtagtacttttactgtcaattttgtttgttttttagaaaaaaattgacggatataatttctgaaaattctatttacccccctgggggataaagggagaatggggggggggattaatttccaaacccctcctaaaatggggggaaaattcgaaattgggggatatatgaaattgggggaaaatt

SEQ ID NO: 41066 - DNA, 871 bp, Heterodera glycines
cgctgtgatcggtgtgtgatgattttccatatatatatcttttttgtgtaaccactgattttattaacttggatatgtggtggataaagttaattgaagacttgactagtaatgaaaaaatcgattaacattgcccagaatttttacttaggtaattaaaagataaaacaaaaatttctgtaaattcacaaaaaaacatgggctgcggaattggttcttttgcactttatgagtccaatcgcattttatgaatccaatcatatttatgaattgagtccaattaattagccattctccattttttgcatcataacattattcattttgagcgaatccgttaaaatgtaacatttattcggaaacggaaaaggttacgaccaaaaattggttgttaaatattgaacagtttgtatagaatttttcctcactttctggttcgtctgacctttgaacacacaaaaattcgtttttctagcggtcgccgtataatgcggtcaggttcaccaccactgactaacttttgcagtaataatggaaatccgccgtcacttccgcccaggccaaactttggcacagttcaacagcaaagtcagcagcaactctttgttggccaacaaccggcatttgtgccgtacaatgccagtggaatgtacaattacaatttgtgtgtattctgtggcgtttttcgacattgaattaccattttcaatttcagttatcaacagagtgctgctcccttcacaaatccatggcccgccattcactcgaaaaataattttttgttggcagccgaaggttttgataacattaggataatataaattgagttggttttcacaattttccttttcgaatcgtcaaaaaatgcgtt

SEQ ID NO: 41067 - DNA, 1129 bp, Heterodera glycines
cttaaatttattaatcaaacaaaaataaattcacacaaaccttaaatgtaattcatgtttttttcatatgtttacatatgtaaatgtaattttataattatcggaaataacaatcaatccatttaattcaaataaatgacttaaaaattgctgctttcttagaatataaatctgaattaaatcgtcaatttattatttattttgacaaaataattgtaattattaattatataaaaagtttaatgcatcgcaattttgtgtttcttttgctgtcattttgcgtaaaaacagccaaatttgactcaataaaaggcgcaaattgtgataaccaacaacaacagaatggcaacaattcaatttttgaaaagcttaggcaaatgtatggcaaaggtgagttagggaatgccaacaaaatattatgatgataatgaaatatttacaatatttatttcttaatatttttaattatttctacaatttgaatttttaaaatgtccaatatcaaaaggcaaaaatccaaaaaaaaacatttaacattttaaaaagatcaacaaatgcaattgaccagcataatatgtgaagcggataaaatgtattgcattttggaggcaattaaaacggaagtaaaaattaatttattataattcatataaattttaatttctcaattaaagaaaccaatttgttgcaatttggcaaaaagtgatgaatacaattttattaaaaagcgtatcacattaattaatcacaatgatccgccgttgagccaagtgatggacactttaattgttacactaatgagccttaaaaaggcaatggaatcgggtaaaaagcaaataatatttttattttaataaaaaaaactcctattattttgataatttttaatataactttaatttaaagttaaaataattttttattataaaaaaacaaatttaaattaaaaattatttttttacataaatataattaatttcctcatataaaatttaggaaattttggcgattctctgattaaaatggtcaaactccgtttgaaatttgcactaaaatttgctgcaaaacgtcatggaattgaatttgatgaacaaaataattttcgtttatggtcaaaaaatggtcaaaa

SEQ ID NO: 41068 - DNA, 1615 bp, Heterodera glycines
accctataaaaacacctgggactgaatcgtggtggacacctcccccgagacaaaacttttaaaccaatattatgggaacgactatagaaaaaatattaactcatgtttattatgatctccgttcgccggcaagctatgcaggagttcaaaaaattttacttgaagctataaaaaagaattcaaatataaaattaaaagatgttcaaaactttttagaaaaacaacgcacttacaccttgtttaagccaaaaagaaacaaatttaaaaggcttaaaactgtacctagtggattacacactgattggcaatgtgatctatgtgttatggatactttgaaagatcagaatgacggattccgttatattctcgtatgtattgatgtgttaagtcgaatgttatatgtttcgcctacgttatccaaaaagggtgatcacatgattgaagcatttgaaaaaatttttaaaaagtctggtgttttgcccaataaaatgtatagtgatagtggagtagaatttcagtctaaacaaatgcttaattattgtaaggaaaaggatattataaaaaaatgtaatgtacagccctcatctacatgccggcgttgttgaaagggcaaatcgtacaatcaaggaacggctttataaatattttagcgaaaaaaatactcttagatgggtggaagccgtcgatcaaatagcaaaaaatattaataattcggttaatcggataacaggtctaaaacctattggtgttaatttcaaaaatgctgtagcattacaacaaaggctatataaaggaaacaattctgcaaatatgataacacaacagataaaatttaaagtgaatgatatagtaagaataacaaaagaaaaaggaaaaattttcaaaaggttattacccaaattatactgacgaactttttaaaatcgaacgcgtaaataacacaaatcctgtcacataccgtttgagtgatttaaaaggtgaagaaatcaaaggaatattttacaaccaagaattggttaaaaccacagaacagaccacccatagggccgaaattttaaaaactcgtattacaaagggtgtaaaggagcattttgtaaggtggataggtcattcagaaaaacagaacagttggattcctgattcaaatcttattcattaaattaaaaaaactatatcaaaaatggatgatttttatattgtacttccttccaattcacccggaccaaacaacacaacctcacaatttactataagacttcctcatacattagagctggattcaagctggactgttgcactttcatcgctcatttatccatattcatttccgtctgtaggaattgaagaagacgattttataaacattaaattggtcaacccgaattataaatttcctgacgatatacgttttattaatatagaatttagaattcctagtatgcagtttacaaatgtagaacaattagaggtaactttaaataaattaatccgtgagggatatatagaaaaattcgggaacataaacgattcggaatcagtaaaacagagaaggattcgtgatataacagatgatagtctcgttgaactttttttcccatgaaaaccccaattgatt

SEQ ID NO: 41069 - DNA, 1154 bp, Heterodera glycines
  misc_feature (77)..(77): n is a, c, g, or t
gatgataaatagctcgagcgcaaaacgtgtgcatgtttggaaagtatcgttcataccaataattgagggtttatttntaattgaaattttatgataaaccttattatctcagaagctatttaattgattcgaatgtttttatcgaggttaattagagcaacgaaaattggtttgaatcgtgaagattatcatttctaactcacttctcaaaattgttgataaattgcaaatatatttttccaaaagtctgttgacactttctgaaaataaattctatactcatgtattttccacttattagattttgcaggcttattgctgcatgttctttgcactttttcaaaataacctatgccctttattcgttcaaaacaccatctttgttgtttcgctttggattaattagagcaacgaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttcttggacacttcttcaaaataaactatgccctttattcgttcaaaacagcatctttgttgtttcgctttggattgacaagcccgatgataaatagctcgagcgcaaaacgcgtgcatgtttggaaagtagcgttcataccaataattgagggtttatttttaaatgaaattttatgataaaccttattatctcagaagctatttaattgattcggatgtttttatcgcggttaattagagcaccgaaaattggtttgaatcgtgaagtttatcatttctaactcacttctcaaaattgttgataaattgcaaatatatttttccaaaagtctgttgacactttctgaaaataaattctatactcatgtattttccacttattaaattttgcaggcttattgctgcatgttctttgacacttcttcaaaataacctatgccctttattcgttcaaaacagcatctttgttgtttctctttgaattgacaagcccgatgataaatagctaaagcaaaacacgtgcgtgtgtggaaagatcgttcataccataattgaggggttatttttaaatgaaat

SEQ ID NO: 41070 - DNA, 895 bp, Heterodera glycines
aaataaatttaaatttattgcaaattgtggcaacagcaaatattgcaataaaataatgtgcacccgttaagcaaaacgaatgaaggaaagggtcaaaaatcgacaaaagaaaaccggagaaagaaacaatgaaaaggggagaaggaagaaatgggaaaaggggaaggattgccagtaggaaaatcgaaataaatacgcaccactcgcccctcccctcccctctctcccctcttctttcttccccgtccgccatcagtcagtcgcctgtcattttttttccttttttgagttgccattatttaaatagctgcactctctctctctcccctctctctctctgtttctctctatctctctgtctctcgctttccctccctctgctgcctgtctctctttccttcccacccttcttttttctttcactctttctattttctctcgttttctatgcatcttatctctctctctctctgcctaccttttccgcggtcttttcccctttcctcgccctgtccctccctcttcgtttcctgcaatcttttcttcttttgatttgtcacttctctccccctttcccctccgattcttttcaatcgttggctttataacatttatttatttctttgggctttagaatggaaatggtcgagcagtttttcttccatatatgaaaaggagtctcactaataatttgtacaatgtttaaattgatcagcaaatgtttgtaatgcgatgggttattaatgtcagatcgtaaccagggaagattattaatttagtaattacctcggcaccacagaccacagtggtaataagtactgttataaaattgtcattcccagccatttttttacttttgacccatttaagagaaacgattcgaccgatgggaaaa

SEQ ID NO: 41071 - DNA, 965 bp, Heterodera glycines
  misc_feature (926)..(926): n is a, c, g, or t
gggatatgtttaaattatgccaatttgaaggtcgtcggtgatccgttgggccccgtgttggccattgtcagtgcgaacccaaaagtgccaattcacgcgttgggcgatgagatgaacgaattggggtggagtttcacttttctacaggtcctggttttgaacgatttcttatttttcaatttctgatttctttttagaatccgaatgctctccgaatgacaatttcgttgcatcagacaaagggcgatgtgattgaccaattggtggacgctttgaagaaatgttgtgacaaaatattaaccgcaacggaagaatacaaataccccgtaaaaacggtgggaaaaaataaatattaaaaatatatttcgtttgtttatgttttagaatgtgattttcggcatttccgccgctttcgccgaccgcgatatttcgcatttgttgcccaatttgttcgtcgatgcgctttactccacgccgacttcgccccacggggatggcattcgaaagcggacgttgagcattgaggggcggaaactgtcccaactgcaagtgagcaccggtacgtttcacaaacaaatggtgaagcactttggcatggagagggcaataaatgcgagcctttggcatttgaaatggatgattcgcttattaattgcagcgggactagcggcactccaagagcaattcgggcacgagtacgcgctgacctccttccaagcgccgccggcggagaagcaaacccaaaaggaggaaggggcaaaagaagagacaccgaagacgaacccagcggaagatgaggaggaaaagaagacgaagacgaactcacagtcagcggaagagcaggaaaagagtacgaagacaaagacggaggaggaaagggagggagggcaatgaacggagtgacagcggagggaaagggacgcatntcatggcactgactctctctctctctctctctctctttt

SEQ ID NO: 41072 - DNA, 1056 bp, Heterodera glycines
atcactcatttttgggttttctctttttattttccaatattttttcattttttccattttttctttctccgttattcttttacagcgaatgccaaattgtttcttccatctgcaaattgttccatagcttacgccaattttcttacaaattccagcataattttggtcccattctttttccgaatattttcctttttgcttatattcatttttcatttcaataaatttttgaacaatttcaagtttttgttcatcactttttgatttataacttttctttttttgaagaccaaattctttaatccatttttgaatataacaactatttgtccccaatttcttcgctatttttgagttaattttatcccattcttttcttgaatattttctccctttttgcttaattttttctttaattttataatattttccaattatttctctttttttgagttcatttcgtttttcttcttctttttcttgccatttttctccaaatatttcgccaaatgacttttgttgcaattttttcttttctgatccaattttgacaattaaaaataatataattactaatagtagcggaaataatttcatttttgtcgtctcgaaatgattttattttatttttcttcaattaaatggcaattcattttttgaggcatttaaatgatttttttctgattaaaaaactgaataaatcattattttacttaataaaataaggaaatcctgtttaatttcaaagaaataataataataattttatcttaatgacaaaataattgccaattggtaaattaatgattaaataaaatttattagttttactggagctcattcgaaaataataaacatattttcaataaaaataaaataaattcacaatgtaaagagattttagaaaaataaagagattttatgaaatttcattatatcagaaaattggtgtaaaatggccaaaaatgaaattttagcgccgaaaaatgttgctgttcacgaaaataatagaaacttgttgaatatttgaatgctttgaacacctgtgggtttcca

SEQ ID NO: 41073 - DNA, 926 bp, Heterodera glycines
ataaaattaaaataaaattatttaaaaattataaaaactcctccatattccaatatacgcatattcgcgacaataaataactatgtataaagaaatggttgaacgatggtaaggagtctcccatttttgccccttgtagtcggccctcaccctccttattttttgtatgaattacatttaaaaatcacaaaattgaaaaaaaaattagaaaattttagtagggcgacaaagagcttcttctgatgacaaattacttttattaatccattaattgctcagcttttcaaagttttgtcttgcctttttcgctgtgttcgggtgagtcgtgcagaagagaaatgttaaactcattttccggtgggtcgaaaaattcgacatggaaagtggcccaggattccttttttactccaggctcagagtggtaaaaagggagggcaaaaaacggcgatttctgaaattagaaaaaaaatgattaatggaaaaaagtatggcatttttctcacataattaacttcgattgtcgtaaaatccatcacaaatggctggtgtagcagaagaaatttgccggccaactgaatgaaaatgcacgcattttagcccggcattgcagaatttcgaaaaatttcaaaaaattaaggctaaaatccaaagttttttggcttttattttttgaatcataaccaaaattttcgaattttgcaggacatttacggcctatagcaaattaatttatttagaacagctatgaacagggttgccagatctgaggatttatcctcattttgtggctttttgataggtcaatgaggattttttggaaatgaggatttttgtggctttttgagaaatttgaggatttttgaggcttttggggaaatcctcagaatctttttaattttgataaattagcataatgtttggcattt

SEQ ID NO: 41074 - DNA, 703 bp, Heterodera glycines
tttcctgcaccgaaggtactcactcggcctcttcgcgctcttgtggtgggccttcgcccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcgcgaaggattctgactccccataaatctaagggcatcggctcggggggactgccccgaaaactaaatattatcgtttttttctggtgtccgattgggg

SEQ ID NO: 41075 - DNA, 1002 bp, Heterodera glycines
atcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagctcctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagccctagcaaaaatggtgtaagtaaaaatcgtaattacgctcaaaaagcttctc

SEQ ID NO: 41076 - DNA, 125 bp, Heterodera glycines
ttcactcctttctgaaggaaatctcttagctcaacaggacttaccggtgaggtaacgcgtctgtaaatggaaaaaatcgttcctacagaaacgttcacatcaatatttgaagaaccatctaaagg

SEQ ID NO: 41077 - DNA, 986 bp, Heterodera glycines
aaattttgggaactgtccccccctcacggcggggcctaaaaaccattgtactgcataattaaaacccgaaaataattttcgtatatttttcacaatttatttcaaaaacaaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagcgaaaataattttcgtatatttttcacaattatttcaaaaagcaaaaaaaaatgattcaattttgaaacgaaatagtgcacaaaagggaaggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaaccgaaaataattttcgtatatttttcacaattatttcaaaagacaaaaaaaaatgattcaattttgaaacgaaatagtgcacaaaagggaaggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctaaaagcggggcttaaaaacatttacagcataattaaaaccg

SEQ ID NO: 41078 - DNA, 989 bp, Heterodera glycines
  misc_feature (61)..(61): n is a, c, g, or t
  misc_feature (63)..(65): n is a, c, g, or t
  misc_feature (86)..(86): n is a, c, g, or t
  misc_feature (91)..(91): n is a, c, g, or t
  misc_feature (96)..(96): n is a, c, g, or t
  misc_feature (98)..(98): n is a, c, g, or t
  misc_feature (121)..(121): n is a, c, g, or t
  misc_feature (126)..(126): n is a, c, g, or t
  misc_feature (142)..(142): n is a, c, g, or t
  misc_feature (160)..(160): n is a, c, g, or t
  misc_feature (174)..(174): n is a, c, g, or t
  misc_feature (210)..(210): n is a, c, g, or t
  misc_feature (339)..(339): n is a, c, g, or t
cccctcttttttcctctctctcttcccccttctctccctactaggcctctttttttttttntnnntttttttttctctcctcaaancgcgnccgcncncccccgcgcgcgcgccccgcgcncccgngcgcgcccgcggcgcnaggacgcaccccgcaagnagacccacgggagncacggggacgccaaccacgaaaacagaacccaaacnagacaaaggcgagaacggcgaccccgaaagaaacccggcagacgaccaggagggggaggagcagcgaccgcgcaaccaggggaggccaagcggggggcggcgaccggccagcgaccacagcgcacaccngccaaccgaagccaggcgggcggggccgaggcaaaacagccgccacaacagcagcagcagcaacaacaaccacggggccaagggggacgaacgccgagggaaagagacccgacaagcgccaagcacccagaaacgagcagaggcaagcgagccacaaaccaaccccaaccacaaccagcaacaacgacagcagcagcaacaaaatcgacgtccatattttcagcaacgtcaaccattgcagcagcaacagcccccatttcattaccaaggcatgtgttgttgttgtgttgtgtacaatagtgatttgggcgccaaattgtgaatgaatatgccgcaatgaaacccaattacaggacctttgtcagaggaaaaaaaattaaaacattttctagaaaaaatgggcaaatttaacattttcccggccgcccattaccacacggcaccattgaaccacattttaccaaatttttttttttttgaaatttttatcccaaaacggcaaaaaatttgtctgtctttcgcgaaaaatggaattacaaatttctgttttttcttcccggcgctaaaaaatttaaaacactagagaaaaaattaggatttttggcacgaacagcaaaagaaagggcttcgaattcctcatccgaaagttg

SEQ ID NO: 41079 - DNA, 791 bp, Heterodera glycines
  misc_feature (66)..(66): n is a, c, g, or t
  misc_feature (75)..(75): n is a, c, g, or t
  misc_feature (98)..(98): n is a, c, g, or t
  misc_feature (101)..(103): n is a, c, g, or t
  misc_feature (105)..(106): n is a, c, g, or t
  misc_feature (110)..(110): n is a, c, g, or t
  misc_feature (118)..(119): n is a, c, g, or t
  misc_feature (124)..(124): n is a, c, g, or t
  misc_feature (131)..(131): n is a, c, g, or t
  misc_feature (134)..(134): n is a, c, g, or t
  misc_feature (136)..(137): n is a, c, g, or t
  misc_feature (141)..(141): n is a, c, g, or t
  misc_feature (147)..(147): n is a, c, g, or t
  misc_feature (149)..(149): n is a, c, g, or t
  misc_feature (185)..(185): n is a, c, g, or t
  misc_feature (200)..(200): n is a, c, g, or t
  misc_feature (211)..(212): n is a, c, g, or t
  misc_feature (218)..(218): n is a, c, g, or t
  misc_feature (243)..(243): n is a, c, g, or t
  misc_feature (245)..(245): n is a, c, g, or t
  misc_feature (259)..(260): n is a, c, g, or t
  misc_feature (265)..(265): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (290)..(290): n is a, c, g, or t
  misc_feature (293)..(293): n is a, c, g, or t
  misc_feature (304)..(304): n is a, c, g, or t
  misc_feature (312)..(312): n is a, c, g, or t
  misc_feature (325)..(325): n is a, c, g, or t
  misc_feature (337)..(337): n is a, c, g, or t
  misc_feature (346)..(346): n is a, c, g, or t
  misc_feature (392)..(392): n is a, c, g, or t
  misc_feature (402)..(402): n is a, c, g, or t
  misc_feature (408)..(408): n is a, c, g, or t
  misc_feature (478)..(478): n is a, c, g, or t
  misc_feature (490)..(490): n is a, c, g, or t
  misc_feature (493)..(493): n is a, c, g, or t
  misc_feature (498)..(498): n is a, c, g, or t
  misc_feature (504)..(505): n is a, c, g, or t
  misc_feature (508)..(508): n is a, c, g, or t
  misc_feature (523)..(524): n is a, c, g, or t
  misc_feature (526)..(526): n is a, c, g, or t
  misc_feature (531)..(531): n is a, c, g, or t
  misc_feature (536)..(536): n is a, c, g, or t
  misc_feature (547)..(547): n is a, c, g, or t
  misc_feature (567)..(567): n is a, c, g, or t
  misc_feature (575)..(575): n is a, c, g, or t
  misc_feature (577)..(577): n is a, c, g, or t
  misc_feature (585)..(585): n is a, c, g, or t
  misc_feature (587)..(587): n is a, c, g, or t
  misc_feature (622)..(622): n is a, c, g, or t
  misc_feature (639)..(639): n is a, c, g, or t
  misc_feature (698)..(698): n is a, c, g, or t
  misc_feature (704)..(704): n is a, c, g, or t
  misc_feature (718)..(718): n is a, c, g, or t
ttcaattcacaatcataagattcatatgggaattcttcttcaacgtggtttcaagtgataatttgngattatttnattgcgccttttaaggaaatttnagnnngnntttngaagtgtnngaganagggtanggntnntttntgatgnanatttttatctattttgagggggaatagaaaagtttnaagattaattaggangtgagagtggnngaatangagttttttgaaaaatgtattgagnanaaaattgagatggnnaatangagnanagaantgaagggtttgatnagnaggtggtgggnaattgganaattaatggaganaatttgttgggnaaattaaanatttagtatttttagaaatttgtaaaaataagggtattttattatntgatatattnaaaaanaagttagattaaaatgtgatttgtgtaagtttttggtttttggaatttagaaaatggtttttgggtgtantgatatttagangtntattngatggnnatntttaatttgttaggnnantggtnttttnttaattgtttnttggatatgtttttggtatnaaaagaangnttaaaatntnagaaatttttaaatgtaagaataggaaataatggnattaagaaaattaatanaatgagaaaatatgaaaattgagttttttagaatatattgatgagattgaatttttgtntatttnatattttaagattntgtttgatatgaattttatggggaaaggatgattagaaattgtttttgaaaaatgtgaaattaaaaagatatt

SEQ ID NO: 41080 - DNA, 1577 bp, Heterodera glycines
aattggggaaataattttaatacccatttgaattaattaggtggaagataatatcctaactgcggtgatgaaagcccgcgcaaacattcaaatgagccaatatacattggataaatacgaggcattctttggcattgtgcattatatgaaaaagaattggcattgtgtcaaaataacagtggtatttgaagaataggaaaggccagcatgccacaaatatcgcatatattagtacattttgtacaaatatttgtatacagcatacatcggaattaccgcaatggacccaaaatttgtatatgaaaaacaaaatgaaattgaagtgccactaatttttgcggtgaattcactaatcaaagtttcgatgtttgatattatatcatcttcgaatgattcgaagtaagtatcaattttagcgaagtatggagagaggctagttgatccaagcctgtcgaatgatgaggcgaatgaactttgtatttcaattaaagtaaagaatcggaagtgtaacgcccgtctgaggccgcgaagcggccttaaaaccccttaagattttaaaataaattccaaatctctaaaaaaactcaatgcttatctaggtagcgaagctcccaaagcgcgaagcgctttttcccagcgaaatagccgacggttcacgcacccgctagttactatatatgttatattgacaaggagtttcgtttcaaaaaacaaaatctcccggccgaaggccgggagcgccctgaaagtgatggaagggtcttacaactttttgaggagaatccgggaaaactatagaaaaaaattcagcgcggacgactgagtcccagggacggatttctcattttttcgtgcgtttgacggcccataactttttttctgaaactcggatcaaaaaattcccgctgtgagggcactccgcagaagtgtcctctataatccagtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggtccataactcgttaggggttggttttatcgaaaaaactcctaagggcaaaattgtagacttttttaagctctatcgaatggtgtgccatatggccggaaattttcaaaaattttcgagctaggccccctagaaattttcaaaaattttttttgggttgaaaaagagggttaaaaatatttttctggggtaaattagggtcctgagcacaaatatgatgtttattttaagtttcagat

SEQ ID NO: 41081 - DNA, 973 bp, Heterodera glycines
aataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctatcacgctcgagagcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagaggaattaaaaattctctgtgaaattaaatggcgattgcgcaccgcacttcctatcatg

SEQ ID NO: 41082 - DNA, 1223 bp, Heterodera glycines
agaaaaatgactatctctattttgagaacttttatacgttacaaatgctctcgagcatgataggaagtgaggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggcgcgcaatcgccatttaatttcacagagaatttttaaatttatcttatatccaagaaaaatgactatctcttattttgagaaattttatacgttacaaaagcgctcgagcgtgagagggagggcggtgagcaatcgccatttaatttctcagagaatttttaaatttatcttatatccaagaaaaatgactatctcttattttgagaaattttatacgttacaaatgctctcgagcatgataggaagtgaggtgcgcaatcgccatttaatttcacagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttctcttatcattttatcattcattatataaagtatgtgaatcggtctcgagaagtcgtttcagcttgaaaatgccaacagaaattggacaggctttcgtaatttttaaatttgttaaacaataagtcccgcgggactgtttattgcttatctctcttttatcagttctgaggaactcatcaatcattatctaataaatattataatcatactcttgaaactgatcacttacctcactcctgtgtcagctcagatactatttttatggttaaaaaaaaaaaagtgaacatatttttctaattaatcgtttcttttactaagcacaaatgtcatacgaggcggcgttcgctaattttgatctgggagatatgaagaa

SEQ ID NO: 41083 - DNA, 920 bp, Heterodera glycines
tgccatatagccggaattttcaaaatttttcgagctcctcatcctagaaattttcggaaattttttttcggacgaaaatgtgggtgaaaaatatttttctggggtaaaataaggtgttgagtacgaatatgatgtctattttaagtttcataatttttggaattttttaaaaattctttattttttggcaattttttggccctcgggattttggcctaatatttgaaaattcataacaaatcgaagggtggatcaattttcgtgcaattatattataaaaatagagaaaaatcaggagaattttatgggatttatttgggatttctatcttaaaaagaaaacaagttattccagaatttctgaaaattttcgatttttcagaaaaaaattcataacccccttctgaaaagaaatttttgaaaattaaaatactacaaaaatccgcaatttttttctttataatataaattttattttacatttttatcactttcttacgaattgttacaaaaataaaaccgattttgggattatggaccaaaggggtgagcataggatttttgagttgaaaaattttttcaccaaaaatcttcaaaaaatatgtctttaggggttttttgggcccctgatcacgaatacgtaatcagattttacttttgacatggttaagacctcagaatccctgtgtgattggggattctgaggcacccttatgaggaggggggggggcggcaggttcggacccggacggtgtacattatttttctatgcatttttgggttattttcactgtttataattaatttgaagatttgttttaattatttaaatttatttttttttttaataaaaaaatttttttttgttttttttttattaacaaaatatttttatttaattttatttttttttttaaaaaa

SEQ ID NO: 41084 - DNA, 848 bp, Heterodera glycines
atatatatatatatatatatatatatatatatatatatatatatatatatatagaaaaaaatagatttatgaacaaatataaaaagaattcatatttttactaatttattattatttggtcaagaaattatttcaaaataatataaaattagcattgaaataatcatttctttatttaaaataattattcaaaatgaattactaaaataaattaaaaatattcaaaaattaaaaattttactgagtttttaactgtatgaaaaaaaaagttttttatcgagacggatgggcggacataaatattacccgggagacaaatttttcatccgtaaaaatacatgttgagtgcatggtatggggaaaacatatgaatgaatgggaaaaaaagttgggccgggggaatttccgcttaaattcgctcaaacttttgcttggcatttcaaaagagaggaaatggcattttaaaggcttttaaaaataaataaaatttcgtatcgaaaacccaattttaaattagttgctttttgtttattttatataatcaaaaacgacttaaagaaatatttaattgatcaaaaatcagccttatatgaaagtattttttcaaaaaaaaaattataattcaattcaaataaaaaagaaaaaataaaatatttaaaatatctaaaatttccaaaaattcaatccacgacttaataaataaatttgtttttgtttttccgaatgttaataatatgtggaaatgataagtgccagagaagaatagagtatatgttgcagcatttttgatttaccataaatcttagtgtatgtgtaaacgataattaattacttaattaccattcata

SEQ ID NO: 41085 - DNA, 732 bp, Heterodera glycines
  misc_feature (49)..(51): n is a, c, g, or t
  misc_feature (57)..(57): n is a, c, g, or t
  misc_feature (60)..(63): n is a, c, g, or t
  misc_feature (67)..(67): n is a, c, g, or t
  misc_feature (72)..(73): n is a, c, g, or t
  misc_feature (95)..(96): n is a, c, g, or t
  misc_feature (98)..(98): n is a, c, g, or t
  misc_feature (100)..(100): n is a, c, g, or t
cactttctgttcctcttccactttctcttccactatttcaatagcttcnnntttttnttnnnntttntgttnntttccctctccttctaacactnncngngcctcttccactttctcttccactttctattcctcttccactttctcttcccctttcccctccacttccactttctgttcctctccactttctggtcctttccactttctattccactttctgttcctcttccactttctcttccactttctgttcctcttccactttctgtctctcttccacgttctgttcctcttcctctttcctccctcttcttctttttcttcctctttctcgttctcttcctatttctcgttctcttcctcttcctctttccttcctctttcactttctgttcttcttccactttctcttccactttctgttcctcttccactttatcttccactttctgttcctcttccactttatcttccactttctcttccgctttctgttcctcttccactttctgttcctcttccactttctgttccacttccactttctgatcctcttccactttctcttcctcttccactttctgttcctcttccactttctgttcctcttccactttctcttccactttctgtttctattccactttctcttccgctttctgttcctcttccactttctcttccactttcctgttcctcttccactttctgctcctcttccactttctg

SEQ ID NO: 41086 - DNA, 823 bp, Heterodera glycines
  misc_feature (719)..(719): n is a, c, g, or t
  misc_feature (735)..(736): n is a, c, g, or t
tggcagggtcactctcctacgaacaaacaaattggctttccaatttataaaactccgcatgcggcaaaatcacgcgtgaccagcagaacgagtgcgcgtccgaagtctcgaaacaatcccaagagaagaagcgcaatttccgagaaacggtttttttaagccatgaattttaccaatcaatcaatttgcatcgtttttagattgaactgcaaattgctctgaaaaactacgacccacagaaggacaagcgtttcagtggaactgttaggtaaatgatggccggcctttgttggtgtcagacagacccgaacccagggtctttaaaccgtctggggaggaaacaaaaagtggcaattcggtcactgtttccgttaaaaatggttcaaatttctggtgaaagtttgtttttgtctttttttttatccggattggtttattcaatttgttcagcatttgctttttagactgaagcacatccctcgtccgaaaacgaaggtttgcattcttggcgaccagaaacactgtgacgaggccaatgccaacggaattccatgcatgacagcggacgacctgaagaagttgaacaaggacaagaagctgatcaaaaagctcagcaaaagctacgacgctttccttgcctccgaatcactcatcaagtttgtgaaatgggttaaggatttgggggtaattttttgtatgccattcaaaaaataaatggnatcattttaggactannatcggttaaaaaaagtcggttgacatggaaacccaaaatacagccaatgactttaaaaacttaaaaaaggtttataatgttctatgt

SEQ ID NO: 41087 - DNA, 1331 bp, Heterodera glycines
tttatttacaatatatactaagattccggtaaatgtcccccccggtcaatttataactgttatgaatttaagtaattcctatcataattttattaacaaatttattggcttttttattcacttgttctatttttttaggcattgcatttaattattcatttaattttattttttgatatcaccatgcttttgaaacgagcttcaagttcgttttattcaccttttaattagataaagtttttaagttttgatcaaaataattaaatgtcttttaatacaaattactggataaatatataaaataaattaattactcatattttcaacaattgtaatttacttttcattgcaaaagtgtcgagtttgtcacatagattcgatatgtgctcaaaatggcaaaattgtatacattgatatgaatcatggtaactggcgttgttctgcttagcatcagagaccgtaattaatttaattattttaaaaatttatctattcaatttatatcttctttgtttaaaattattttgaatgattatgaattgaatttaaaataaaaaatgcgtaataatttagagtaactatttacttgctttatactttttgcttaaaaaatttggttatatttcaatttatttacctatcgtctttctagttctgaaaaataaggatattgtggaaaatttaggtgcttatctttttaatatactactatttaataaacttactttaaatattaaaatttcattaaatgatccatcatttactggattaatttttaacaaaattgcatggtttttatgaaactcttctaaatatcctatttaacttctctcttttgtttgataatcattttattcattacggctaataaaatatatttcttaatgtcacttggaatttttcaactcgcttttgtcactattaatttagtttgtagaaaagtgtattagtaacaaatgttttatgaatattttcgaattaatatatttacaaaaatctacaactacttaaaatccgggttcgctaaagggcatataaaagtgaagcaccgccattaaagaatttgaagagaaatttttaagcttttattctgaagaattcttttattttgtgaatccattaaatatgttttttcatatatttactgtcatacctaaaaccttttggctcaaaattgcaaaaatcatcagttttggataaaataataattttatattacgtgaacatttgattttgttgatttttaaataggattgaaaaaaaatttcggtgcgttatttttctcgaaacttctgcaaattacaaataattatttttttaatgtatcctaa

SEQ ID NO: 41088 - DNA, 675 bp, Heterodera glycines
gaaaaataaaaatgtgtacaattgacaaataataatccccactagattggtcctttactaagtgcggagatcataaaaatctaaataaatgtgaagggttggttcacaaattgaataaagctctcaatgttataggaagcgaacaattacaaacactgggctaataataatagagatctgcaatacgctacttaatattaataactaaacttaaaatacgaataaaacattccattggattggatttatgtgggggaatcagctagctgtctcaaatacttcatcatcatccggagaatgttgctgaacagttgaggtcaaaacactgtttgacgaagcaccctcagccggtgaaatcgaaaaaactctttggccaattggagaatcggtaggagattttcgcagtgctggcgaatcgctgggagacctttgatcattgataaccgactcagcaagctcttaaaataaaaattaacacaaacaaattgtaaagcataaaggttcctctatcaattgtatcaagattaccttcgtcctctgcccccatttcctccgtatcttcatcgtcaatgattcggttcatcagatcaactgaacgataatgctttggtgggatccgtgacagttgagcggcaatatccatctgaatttgtatagtaaggtgagagaaggact

SEQ ID NO: 41089 - DNA, 1141 bp, Heterodera glycines
  misc_feature (945)..(945): n is a, c, g, or t
  misc_feature (1123)..(1123): n is a, c, g, or t
ttttagcccccattttggttcgagaaaatatcggccgaccatcgacacgtttgtccgatgtcatagcgctatgttttcatactcatttatacagtttaatacttttttattcgtaataaaatatatgttcccacttcaacaattcgtctccgaattgggccgtgatccgtgggagatgttgcagttgtttttgccgcggtttgctctgctcattgtccgccgcaacaccaccagtgtgctcattccgttgttgttgctgttgtactccttcgccctctccgacactttgttgccactttttccgtgccgccgcccattccgtgccgatgccctcccgctcgatgaccacaacgtccatgcgttgcacaatttcggcacggatggcctctgcaaggttggcggcggatgcagtggcgtcactggtggtgccaagcaggtcgtacacgacgccatcggcggtgccggtgggatccatgggcctattaaaaaattcggaaggccttttgacaaattttaacagtagaaatcaataactaataaaaaaaaatcttttgaaaaactaaaaatgtttaaaattactaaaatgcattacaaatttctgtaaaacctttaaaaaattaggggaaaattgcaaaaaaaagcgttttttgaaaaaatgtaattcaaattttatttttttggtttctacttaaccagggtaaagtagaaatcggggaccgggcgggtcaaataatctgtctgatcaaaaaccggaccatttctgattgattcgattcaagcaaataaattttcgttggtcaatatctgtttttatgatcagtagaattggaattaaaatttcataaaatggttttatctttctgtataattgcaaagatttgagaacagtagagaaattatatatacaaattgatgataatttttgaatgaatgcctcttttgccnaaatctaagcgctttttgagaaatatttaaataattattttataatttaacacaaataaaattgtcaaaaatgaaaatatgctatttttatccgtttaattgaatttttaattgtgctaatttaaattggagctgaaaagaaaaaaacagaacaaaaaacatctgatgaaatatttgnagaaaaatgggaagaaaa

SEQ ID NO: 41090 - DNA, 1182 bp, Heterodera glycines
ggcagattggagtttcgtacaaaattttcctccactttaattaaaacttagaatgttttttctcaaaaaaccctagtgatttattttttatttaaaccttaaaaaattctttttttttaatataattccaaataaacctgaaaaatttgctgaaaaaattaagcaaaataaattgtttttaattgttttttcatagaaatataaaatttgtacgaaattctattctacgaactgtcatttttttattaattctttagtgactcctgggtgaagaacaaaaaacggaatggtgcttaattgttggaaccctatccctcggaaaatttttcgaaaaatgagacaaatgtttttcaaatttcctgtctctaattaagattgccaacgtttcgactaattcaaatcaaatttgaataaaataaaatctttttaaaaatttaacaaataacgggcctagtcaaaggacgtgtaccgacgccctcaaaaaatttcgtcaattgcattcggaattccgtcggctcaaaaaaaatttcgactatttgaaatcggttattacaaagacaaaaaatgttgaaatttgccaatcaaaaaagcgaaattccggcatatccctgtttttaatccttaattcattttattttcaaaatttacaaactgggatctttataggtaggtctaagagaaccttaacaaataactaacttttccatgatgttggcaaattttattgtcgaaatttcatgctccatgatcagtaaatttttcattttttgctccaattctttttcaatgccggaatattcagaattttctgagacaattttggcacaaattgagtgccattcttcagtaaatttgtgcccaattctgtttaacacattcacattgtttgttttggaaagtttggcattgaactcatttatcaaaatgtcgagatcaaatttaagaattaattttgccaatatttgcaacactttctcaatttcaatgtgtccatttttggcattttgttctgccagaattttaatttctttttcggcacgttcaattggtgaaaaatcagtcaaatatgatggaacttcttcgattaattcgttctaaaaaggggataaaatatagacaaaatgaaaatattcctagcggtggagggtcgtctaaaaaatcaaaaaaaaaaagtatttttat

SEQ ID NO: 41091 - DNA, 650 bp, Heterodera glycines
tcaaaattaataattatgtcaacaaagagagcgattattcacacccatggtcccatttttatagcataaattaagtgtagcttcccaaaatttctccatttcggttttgcgcttaaattattgtgtaaaacttttctaaaattctgaggtgtaggctcaaaacctaaaagtaccaatttcagactttgttggtgacacgcgtctcgctttcctttcctcccctttcccagtggagtaaacaaataaaaatgaggagctaatagccgacaacgctgttgcttaagtataaaaagccttcaggaattaatcaattggttattattgttaggttttcaaggaacgggccgggttcccgaatttttatgcgggattttgcttctgtcccttctcttctcgttttattagtgtatgaaaattggcatttgaacattaccggagaagtgaaaaaggaaaagaaaaaaattttttcgtaagactcaatttacaaatgaaaactgggtgaattgaagaatagatgaagctggtcgatgaaatgaacgggtaaagaccgaggtccaagcggggacaagcaaagcggggggggggggggaatgggggcagggattcacgtgaatgggctgaggatggatttgtgcagcgcaaggtgggag

SEQ ID NO: 41092 - DNA, 914 bp, Heterodera glycines
gggggtcattcagcactaataccctttaattagtcatttgtcgcttacactttgctccaatttctccttttttgcatttttcccatttgcctttttaagaatgtttagtgaattttcagtttgagctgtccccgtgccattctctctctctctctccgtattttccataaatggaagcatttgagccaccaaaagtcaaaggtcatcctttaaatattaaataatttattaagtattaatgcctttaaattggtcaaaggataaacccaacaaaattgatttaataaatatttttgtttaatttatcttccactaaaatggctgcacttcaaaccatttgtggcgtgaagtgctgaaatgtgtgccttccgccacccataaattgttcgaattgcaaatacccaaaaaaggatgagtaaggaaaggcgagggattagtggcgggggtgggcacaatgcgtccgactcatccgtcgtcccctcaaacactcaccgattctcctcccccccccaccctttttcctccaccgccccaccattttaggccaaccgaaacaatccaaaagcgaaagcactgtccaaacaatgaatgaatgagtgcccccaaaaagtgagtgtttttgccaaaggaaagtaaaaatggggcagcgaaaaaggcaaagcaattatttgaattagccgcttaataaagccggggttttggctgatccatttgtttaagatgcaacaaattcggacattcattcattcgttcgaataaagaataagcgaccaattgcaaacgaaacaatgaaaaattcccattccttgccccaatcactgcacactctccccccccccccctcgtacatccgatcgtcaccaaacccgttattatttaatttgtggatgaatgaaaggagggacgggaaagag

SEQ ID NO: 41093 - DNA, 693 bp, Heterodera glycines
actacggcgtgttcggcacaaagaaatcactgatcagccacaggtaatggtgttgccaatgccaacaaacacaccagggtgtgggggtagtttcgtaggacaaaaagcagaaaaatttgctgcattacagaaattccgacaccaaaaagtgtctgtatgtgggttttttaaaaaaaattgattttttgtctaaaaagtttttgaaatttaaaatttttttgtacgaactgccatttaaccctttgtatttggcactgaaacaatcaaaaaaatttttatttttttttgattttttcacccccccccccccctttttccattaaacagaggctgctcatctacgatgttggatcatcaaaaacgctggccactattgttcaatttcggcttgtcaacaatgacacggaagcagcaccaccgctaccagcaacagcaacaaacagcacaacgaccacagcgaagcgaaaagcaaccacaatttatccacaagtgcgtcgcgtgtggtttggcaggcctatagatttcaacaaaaaaaaatcgagggaggcaggttcttttatggtattcccaaaccccgaaaaatctttaaaaaatcattttgtaaaaaaattaggtaaaaatttcgaagttttctaatgcatttcaggaaacctttgaaaaacttcgtaattgaaaaaatcacattttctttta

SEQ ID NO: 41094 - DNA, 1217 bp, Heterodera glycines
aattgtgcaaattttggcaatttaggagcgaccaaatattcaaagaatacgtaccccttctcataaaccttaaggtaatgcccctattatgttatgggatattattttctgaaagattgagcttagcggttttcctgatgggataatcagtgctgagcaccagcagcaatacgcggatgagtacagacggatatacagcgtcaatttgatccttgaacgtgtgcgcaaaaatcccggactacgcttcattgcgaagttaatgctcaacagcctttggttggttcaagactttcttcttttgtaacaatctgattttttttcatcctttaggggtaagtttagcatgcgaaacgaattaggttccaacaaagtgctgaccaggcctcaggagttttacaacctaattctggaccacaaaattgtgagtagctattaaagaatgtttattttaaaaacgcttaacacattataggaattatcggcggtcattcctttgtcggatgtcgctgtacgtgtactttacaagcacaaaaaaaattttgtcactgagcactcatccagcaatatcgtcttaagcttgtggactacaagccgtgcccgcctaaaactacttgattttatgactcaaattgaccgcactgaaggagccaagctgctttacacggtttgtatattaccgtgttaagaattgcaacccaaaaaaaaaaaaataggacaccgacagtgttgctgtactacacaagcgggacgttatacccatacaaaccggcgaatttttgggtcaaatgagtgaagaatacattgactatgaaattaaagcctttgtatgtgggggtaagtatcactaaatatttccgcatgtaaccatctgttcaaggggtcaaagcagtatggctttcggatgcagaataaaaggtctggagcaatagagtatgtacaaaaaatccgaggaatcacattcgatgtgaacaacagtaaagcgctgcagtttgaaacttttcggcaaaaagtgataaattatggtagaaacggcggagaccgtggtaatcatgtttatggaaactatgataacaatgacgacaacgaaggagaaaatgtgccttcaatattcacatacaataaaataacgccaacgcgtgacagccgtgtgatcacccgtgagctgcgcaaaaaataagtgccggtgtgccagaaaggcataattaacgaacagtacg

SEQ ID NO: 41095 - DNA, 1222 bp, Heterodera glycines
ccattggagttacatccattggcacgcctggttcaggctccttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctgttcagtggcgaatggggcatttgcaggcggagaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgagccatggtggaacgtcggggcgcaaaatcacttgtatacaaggtgactactggtcagggggttgttagcagtagagcagct

SEQ ID NO: 41096 - DNA, 1448 bp, Heterodera glycines
ctgacaggaaaccggtctttgccaggggcgggaccggctctatctggaatttgttagaggcacccagaatcattaggacattgtaaattcttcaaaattccttagtttttttggggcccgaaacccagccctgcttgtctcagcccgattgccacctcgaccgctgcccctcgtgcacttcgccgcccgtgtgccgcttgccccggtgctgtgctcccctgccgatgaagccgcccccgcgttggttgtggtacacttggcgatgctgtcccataccaccaccgcccccgcggaaccgacttggccgaacgccttttgaaaatattttgttggttgaattggaaaatgaattttttcaaaaaactatttgcattaattttattatgccttaaaataaaattcaaattagttagactttcgaattgcatgctgggggacgttttcaaaatccctcccgcaaaaatgggcatttttgcgagaattttttttttttaatttcattatacaggagaaaacatttaggactatatatcaaatgataaaattttttgattaattcgagtgcttatattcaaaatatgccaattttagcggattacgaaacacatactagcactaaagaagaaaaaaaacattatttttttttatttttggagaatttaatttaataaaagttacgggaagaagatggacagactgccaaagatcccatggacaaagtgttatgcaaaaatgcgctttgttccaaccttgtttggcacaatgcgccaaatagcgacgaatgtcacggaaccaactcagctccaccttgtagccaagcatttccccctcggggccaaatctgtaacaataaacgacggtcttaggttcaactataatatttgagatgccgggaaatttgaaatttgaaaattaaaaattacttttaacaacttggcatttttgcccaaaattctttaaaaaggcaccatcccctttaaattgcttctttcgcaaacaaaaattctcaaccaaaaattttatattctctaaattccactttatcctatgagcatggaccctaaattttcttctttttttttttgctccactggggccaaaattttccaaatccatgggattaaatttttctgggaatcatatcccgcttctgcctgctctgcaaaataatataggaaatacagtatgcacggtattctcttcccgcctgggtactgtaggcaatcacagtttaatcaattcacgcaccgttccatcgcttcgcgtgcgcacgatttgctctcaaagcggaccgccacatacagcttggtacggtccgggttcaccttgacaaagtcgaaggagcacgtgccaaagtcctccttctcgagaaagtctctgaacatgcaacgaatttaatgggacaagcaaacgtaatttggctaattttgtggccaattatattttat

SEQ ID NO: 41097 - DNA, 1284 bp, Heterodera glycines
  misc_feature (65)..(65): n is a, c, g, or t
  misc_feature (75)..(75): n is a, c, g, or t
gatgcgattgaaatttttcagcttttcttgaaaagtttttcccagaaatttatacagctttccgnacaaattgtntagatattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattatgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataatttcttgcgtaatattttttacattatgttgttgaagaatttgagtctgcttctgatgcaattggaaaagatttcagcttttctcgaaaagttttttcccagaaaacgg

SEQ ID NO: 41098 - DNA, 1037 bp, Heterodera glycines
agcaatcataggcagaaggactccgcgtttgacaatgtcttccctcgattgaagagcatggcatagcgtgtgggggatttcgttgcttcaaatttatgaccgactatttttatgaggtacaaagagaaccctatcaatcataggcagaaggactccgcgtttgacaatgtgtggaatccattgaagagcatggcatagcgtgtgggggatttggagcttcaaattgatgaccgactatttttatgaggtacaaagagaaccctatcaatcataggcagaaggactccgcgtttgacaatgtgtggaatccattgaagagcatggcatagcgtgtggggggtttggagcttcaaatttatgaccgactatttttatgaggtacaaagagaaccctagcaatcaaaggcagaaggactccgcgtttgacaatgtgtggaatccattgaagagcatggcatagcgtgtggggggtttggagcttcaaatttatgaccgactatttttatcaggtacaaagagaaccctagcaatcaaaggcagaaggactccgcgtttgacaatgtgtggaatccattgaagagcatggcatagcgtgtggggggtttggagcttcaaattgatgaccgactatttttatgaggtacaaagagaaccctagcaatcaaaggcagaaggactccgcgtttgacaatgtgtggaatccattgaagagcatggcatagcgtgtgggggatttggagcttcaaattgatgaccgactatttttatgaggtacaaagagaaccctagcaatcaaaggcagaaggactccgcgtttgacaatgtgtggaatccattgaagagcatggcatagcgtgtggggggtttggagcttcaaatttatgaccgactatttttatgagggacaaagagaacccctagcaatcaaaagcagaaggactccgccgtttgaccatggggtggaatccatagaaagagcatggcataaccgtgggggggggttttggagctttcaaatatatgaaccgactattttt

SEQ ID NO: 41099 - DNA, 892 bp, Heterodera glycines
  misc_feature (838)..(838): n is a, c, g, or t
atataaaagggaaatttttctcaaattaaaaaatgtaatttgagaaaataataaaaattaagggataattggtttaaaattgtaattaactcatgtaatttcaaattgtaatcatataattaattaaaggaacctgtaattaattaaaggtacattgatttcttatttatgatggttttttaagtatcgcccaaatttcattatgatggttttttaagtatcgcccattatgatggtttttaagtatcgacccagcaccgaccgaacgactgacggctccggtggttcagctacagaaaacagcggacagcaggtgaacaaaacaccgaacattgtttgttttaatacgatctcggaagaattaatttctttgaaatttaattttagaaagattcatttttagcatcagctccgccacgagcagcaaattgtcgttgcattagttggagtgttgcacgggcgcggaccgggacgaggtgcgcggggcgggcactctcgtggcaatcactgtgcaaagtttgacgctgatcgagaacagcttgggcaatcttaaatattttaataggtcaattaattaagttttgtgcgccattttccattgcaccacgggcagctgcgaattgtctccgtttttgttgctcccgtttatgttagaaacagtggaaaatttatcatttaattatttcataaaattccgtcgtttagtgaatcattggaataatttttaaacatcacaaaacatttgcaattttccatttatccgatttgtaaaaataaaatgcctttctccatatattttttgctgctcagttattatattatctccaatgaaaaagtncttttgctgaaaagggagaaaagaagtttctttgcaaaattaatcacatttaaa

SEQ ID NO: 41100 - DNA, 686 bp, Heterodera glycines
taaataaatggtgcacaaatattgcaacttatttggtttattcttctcctcatgtgagaaatgggagaaacgcctcccattagggggggggtggggggggggggattttcacacacacacgattagcagaataggcacatggaattgctaataagcaaaagaaaatgcaaagtgcccaaatgccaaaggatttatacgggtttattttgtgccgataacataattctcgtcatgtttctcgaaaagaaaaattcaaattaaaaaaaactgtcctttctatgtacaaaaaagccaattatcccctatcacccgtttgagttggttggtaattagtgtgctaattatgtaattaaatttatgttaaacttcataaaattgtgtcaaaatcttctatgaacccgaaaatattttttaaataggtatgtagaatatattttggttttccaaaacgattaatacataaaaatgtattcatttttcgaaagatttttaatatatcttttttaaatagagaatttaaaattaattattggcatgatattcatttgaaaattttaaccttcaggcaaaaacacaaatgttttactcaattaattaattgaaaggggcaatgtcccgatggcattttcaattgtatgtgtgtaagggtcacgctataaatccctgtaattttttaatatgaaaat

SEQ ID NO: 41101 - DNA, 1160 bp, Heterodera glycines
tgcaggtcgtaccaaaaaagataatttataaattcccatgtaaattctcccccaggttcttagggaaatatttttcatttattatttacccttttgttaattctaaaactttcatttaggctatccctaatctttgaaaaagggcatttgttctgatcctaatactggcattttgcctacatttgccatttaaaatgttgtttaattttcattttgactcactgaccccctgggcttaatcccttccatccgctttatctccccattttctattttcgcttttcccccggccccgttccatttttcgtcatttcacatcatcgcatctcatcatcaagctttctcgctttttctagtaaacttcctccttcctcccccctctgttcatttcttccaacccaaaatggcatttcctcccctccccgccgggcgcggcattttctgcctcaggcactttcgcccgctttggcattgccgcggggtattttttatgctttatccccacgctcgcccacccaccacaaacattcccacaaacagcagcaacaggaggacatggaatgtcgtcatttttgttttcccacttttttctcttgtcgtctttccccctactatcttttcccctatttcttttcttttccctttgtcgccccctcattctctctttcttttcacacttcttttctgcctctctcattatcatttaatcttgtttatctcttctttacccacccttttgtttccgcatcagctgttcccattctggcacactttctcttttctttctccctcatttttcagtttatctcttacccgtctctctctctctctctctatctgtctttctctttccctctctcctctcttcctttctctcgttatctttcaccccctactcgtcactctctccgctgcttttcctccgttcccccgcttttaagggatggcatttccgtcccagcagtggcacggcaactgctgctgttccatttcacttaatgagttcattcattcctatttttgtcctccatttttcaatgccatccgccctttccctttacatttatttattcttcgtctatttttttctaatcccgcaaaaatgggtgtgagaaatttcccatgttttgccggaacaaaatggggataaatggagcggg

SEQ ID NO: 41102 - DNA, 1080 bp, Heterodera glycines
aaaaaaaataaaaataggtttagaggagcccatgatcagctgaatcggatgccaagtccccgccgttgctgtacgcctaaacagttggtgagcaatgccggaaaattgcttaaaaaagaaaaccaaaaaaactcatcaattgttagctcccgttgacaaaccgaagggtacattggggcaatggatgttgggctcccgtatcagttattaaaattgttgtttttcaaaaaggatactaaaactgggataacccattcagagacaagtcaaaaaaaataataataggcttggactaccatactaattagaatttttagaatgtgtctgttaaatgcaaaactgttgtgaaaaattgttataactccattcagagaagagatagaaaaaaaaaataaaaataggtttagagagcccatgaacagctgaatcggatgcaagtgccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaattgatgtttttcaaaaaggatactaaaactgggataacccattcagagactagtcaaaaaaaaaaataataggcttggactaccatactaattagaatttttagaatgtgtctgttaaatgcaaaactgttgtgaaaaattgttataactccattcagagaagagatagaaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaaatacggggggagactaccatactaattagaatttatagaatgtgtct

SEQ ID NO: 41103 - DNA, 823 bp, Heterodera glycines
ttcagtttcgcaaatttcgcttttcgcatttcgctttcttcttggcatttggcccatccctgctgttgacccctcatctatttttgcataaatacccctcctctttcctcctttagaaccaaatggaaaataattttcttcaaatttgcatttatacaataagatcgattcaaatagcaaaataacaatggcacttctttgcagtgagtccttcgttgtgtggtgtttttgcatcaaaatggcattagaaacacctctgaaagtgttcaaattaaatcaatttgtatgtttttcgtatttattaatttgagcccccgcccccttcaaagtttggatttaacgtgtcttacgtatggctggatggttgtgtggcgttggcagtccgatgacattgtccaattcatcagtccgggtagagccacggcagccgccctcctgcagtgatttcgcacgtacgcagcgccaatacgtcactgttcgatccgcgtttgtgcaactgcggtagtaaacgtgcccttggaagtgcattttccgtccgccatgggtggtggggacgaagtgtggatgatgtacgccaatcattattaggacagaaagctaaagtaaagaaaaaaatctcgaaatacaacaaaatttggtactttttcactttacgccacataaaaaaatatttttatttttctgggattttcggggtcgctgatcacgaatgtggcattcatttcgaactatttcgaaacccaggaccgaattcgaacaaaaaatctaaagtttaatttttcgaattttcgtctaaaatggtttaaatgatctttattgcatg

SEQ ID NO: 41104 - DNA, 919 bp, Heterodera glycines
  misc_feature (43)..(43): n is a, c, g, or t
ttgatttttaaaattcaaaaatcccatgtcaggagattggacncaggccatgacaagcctggacctttcctggacctggattttcctgaatttttgtcaccaggtccaacattgaatccaggcccaggcttttttttcaagatgtgagctctagattccattccaaaaccatgcacatcaccttcatcggtggtgactggtgctgtgtgtcgatggacagctgggccgaaggcagtttccggttggtgacaagctcacgcgctctgctgatctcctccagtgtacggcttggaaatgtggacggaggaacagatgaagcggatgatgaagcggcggcagcggcggtggctgacaaatgaagcaattgacgatgatgaagttgatgatgatgattatgattgttgttattattatatgatgagacagagtgatgatgatgatgatgctgctgcggtggcggaaacattcgcggcggacgcaaatgaacggacattggggaaagaagcgcggatgatgccggaggcggtgatgagaacaaatggtgggcaaccgcaggcaaaccgagcggattttgaaacatcagtgccaacgctgtgaccgcttggagctggtcctgcgcataattggaacacacagttcagcttaattgtatccgcatatcggtggggggaggtcagttagttccgtctgacaaattaaaagaaaaaaccccataccatttttcgactatttcccatgaaatgatcggactaaaatctttagcacacttaaaatttctgaaaaaaaaaaaattgaaaatcagtaggtaacaatgcaaaagcgtcgactagaaaaaaaagtacgcatttttattagggttcctccccgagcctcggggagcaaaatgtcggggaacggggaggaaattccccgaaagaat

SEQ ID NO: 41105 - DNA, 1001 bp, Heterodera glycines
  misc_feature (954)..(954): n is a, c, g, or t
ttatcaattttttacagtttattttttaattatttctcccacccggggggtttaattgaaatttattaagaaaattttaccttttgaaaaaattttcagaggaaaaatccgaaattatctatttatgtgtaaaaaatatgtcaacaattttgggtgttctcaatcagaaaaacatcgaagcctagcacaagagctttaaagttaactaaactaaaaacagtttttcattcgtattaggcactcactgttaagtgaacccaaaaattagagaacataaaatgtattaataaataccatttacctttttaattttcttaaaattcactaatatttcgactttaactttttatttttaatttaaaaaaatccctaagaaaaaacagaaaaaaacaaagtttcaaaacttttcgatgtttaatttgaagttattaattcaactgttttctcatttgagcttttctcaaggcccccaatttcttctggcagctttcccacgggattttccgcgtccgcgcgttggattgcctcgcgcaaacgcttcgcgcccaattcgggcaaaacgtctccgacccatgcgcccatggcagcctcggaacccgccacgaattttagtttgtccaccgcccgacggggcgacgtaatttggcacattaggcgaatttcatcacgacgaacgtgaacaggggcctgaatttacaaggagaagcgcatttgtaaaatcgaaaccgaataatttgcattactttctctctctctcccgccccacctctctttctctcgcctctgctctccctctttcccttcccctctctctctctcctgctctctctctccccctctcctcctctccctctctctctgtggcacctggtgccacgcggctatgtacggcgtcggagtgccgtcctcataaagcgcgtcaatgccgcgcaacactcgcagataaaaggtggncaactcgtcccgctctgtgtccgatggtgcgggccaatcaacgatgt

SEQ ID NO: 41106 - DNA, 963 bp, Heterodera glycines
gctcggcttagatcacatgcgatttccgcccctctgataattttagcgttcataatgggatgtataaactcgattgtagaaggaattggatgcgctaaaattgtttgagaagctttttgagcgtaattacgatttttacttacaccattttttgctaggcttagatcacatgcgattttcggcactctgataattttagcgttcataatgggatgtataaaggcgattgttgaaggaattggatgcgctaaaattggttgagaagctttttgagcgtagttacgatttttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataatttta

SEQ ID NO: 41107 - DNA, 815 bp, Heterodera glycines
aatattcattggataaatatgaggcatactttggcattgtgcattatctgaaaaagaattggcattgtgacaaaataacagaggaatttgaagaataggaaaggacagaatgccacaaatatcgcaaatatttgtacattttgtacaaatatttgtatagagaatacatcggaattcccacaatgaaaccaaaatttgtatataaaaaacaaaatgaaattgaaggaccactaattattgcggtgaattgtctaatcaaaatttcgaaattttattttaaatcatcttcgaatgaatattatgaagatcaattaaaaagaagtattcgaaggttagttgatccaaaactgttgaatgaagagcgattgaattatgaatttcaattaaaaaacgaatcaaaagtgccaaataatgaacaaaaaatgctaattaatgaaatgattttgcaattaataattgatccatcaaatgaatgccaatcaaataaaagtttagacggaataattcatataatttattgtatttccataatacttaacctgtgaaataattacaattaaacttaaagtcaagaaacaaatttaacaaaaaaaaatgtattagcaaaaaaacaaaaaaaaatagaattattagaattttattaaatatttaatgaaaaatttcagaaaaaacaaaaaatttttataaatttaatcgcattaggtcaattcattgtaaaaatatgctttaattaacaattttaatctaaacatggagacattaatagaaaatttacaacaaaaaaaaactaaaaatttttatatatttttcttaat

SEQ ID NO: 41108 - DNA, 1448 bp, Heterodera glycines
  misc_feature (44)..(44): n is a, c, g, or t
  misc_feature (49)..(50): n is a, c, g, or t
  misc_feature (87)..(87): n is a, c, g, or t
  misc_feature (103)..(103): n is a, c, g, or t
  misc_feature (881)..(881): n is a, c, g, or t
ttatttttgcgtctcctttctcccagagcagcagatcaaacagnacagnnaggacagaccccttgtgggaacaacgctacgaaacgnacaaaaacaatgcggnaagaaatttctactttttaaaagtcattgcacataatgcatttttgaccgacagacaatcgaccaggacaaaaggagcaacattgagcatttgtacaagcaaatggggcgcatggaattggacttggaccaaatggtcaagggaaggcccaatttggtggaggaggaggctgcgtatgggcagcgaaagcgcgagatcactgcctccatcgccaacatgttcgagcagtacatcgactcattggtgagtggattcaaaataaataacagggctcttggaccggtttcttctggtattctcaaaacggcatattttcagtcgcaagaaatactaaataaacaattctgaatcagaaatacagattttttaaacttttttgaatttatcgtttcgaactctacaattgtattaaactgaatataaacgagtatcataaactgaaactaattgtaaaatttcaaaattaagaatcggttgcgccctttgagcgtgaaatgtgtgctggcggatgacgaattgaaaaggctgaaacgacgacggcgcgtgatgggcatggacgacgacgacatcggcgaacagctgaacgctgttaaggtgggaacattcaaataataattattccgaacattgggcaaaggatgaaaggaacttttggctctattgcagttcaaacgaacaaaaaataaatttgacaactttaatacgtcataactttttctagaaatatccgaattaaaccttggtctcattcgatagtctcaatcaagggcgtatccangggggggggggggggaaagaaatttaattatttacctgaatgtgtcgcgaactgcctcaccatattctgccttctcgccgtacaaatgcaccagaccaaggcgtttgaaattcctgtacaggctttgcccgtattggaacatgcagtacttgatcagtgccgtggggaaaaccgcgcgaacggacgccatttcgggtttttcaaagtcacaaagactaacaataaaatttttcaatttattccttttccgtaaatcgaagagttaacctttgcctgagacctctggtgaggtgcgttcacggacaaaattctgtgcttcttcgtagcagcgtcgctgttttccaggcaggagacaccacatgctgatgcacatcctctgatgcactgaagcaccaatgacgaagcactgctcccacatcgctggagcacatttgaaagttccatcgaggtgacacgtgccacattgatgcaaaatgtccagagtctaaaggaatgacaataacaaacagaattttataggctaaaaatgtacctgaacactgccgaaaaataaagacaacgtccttt

SEQ ID NO: 41109 - DNA, 1167 bp, Heterodera glycines
  misc_feature (59)..(59): n is a, c, g, or t
  misc_feature (69)..(70): n is a, c, g, or t
  misc_feature (85)..(85): n is a, c, g, or t
  misc_feature (187)..(187): n is a, c, g, or t
  misc_feature (194)..(194): n is a, c, g, or t
  misc_feature (1141)..(1141): n is a, c, g, or t
ttaccgtagttcatggacatccaaaaaattgtcttctttatggtgcgaaggaaaaagcncagcacccanncagttggtgaattgngggataaagcggtgaaatctgaattttataatgtggtttatctatattttttgagatagataaggacttttatccctgaattaaattgtttggggcattacncaacctntatgattataaattctctaattaccgctttaactgccgaaatgccatctttatatggcacaaaatattcactttggatttcatttccatcattgccggtcatgccaatgcggtaaaccaacaggccataataccacggttgaactttgttgagttcaatgctaaataaaaaattgttgaataattcacgaattgaaacgcattaattaggcatattaacttacaaaattggactaattagagtattcgaatgttgacggttggcaccatacagagaagaaagatttctcaggttctcatcttgggttgaattagccacaacagtgaagcttaaatgcatataaatttttatttgtttaagaataaattatttatttaagttttagtaattttgggccaatgttttttaatggacaaaaaaaaaatggcgagataaaagatggatcaaaaaaccacgaaatttggattaaaaatccgaaaaatgaccaaatgatcatgacaagtttagcaaaaccatggcaaaaaaattaaaattctaataatgacattttgcctacatcactgatgtccaaactctggcattttgtagtgtgttcctgaacgtaacagtgtaacctctgttttggaggtcgtcaaatttttcataaacactttgttctggcattctgaaagcactgccatttttaaaatgcaaacaaataaaaattcaactccgtgaacacatagttgactacgtcgaagctgggcaccaaattcaattcaacctaagcaaacaattaatgataaaataaaaacaaatattttatttaaatatttattaaggattaaattaatttgtaatttttaaagaaaagtatgacttaaatgattcaaaaaaccaggggtttcaatttgttttttgagtaacacccattagagctgctcgagagttgaaattttcatttactncagtaacgagaccgaagaccattgac

SEQ ID NO: 41110 - DNA, 899 bp, Heterodera glycines
aaaaggcaatattatgaataaataaaagataaaaaggaaaaaattacgaatattcaaatattttattatcttttgcccatcgcattttctcccatttttggtcatcgttttgccgtaaattttttactttttggcctataaatatgtgcacaattcagtcactgcaatagaactgaccatcatttgttctttctttttttctaaattcattaaataaattaaaactgaaaattttagatttaaaattaaaatgtcatctttcacaactttttcatctgcggacgaattttctcctctccaacgtaaatactttgcaatcctaaagaatggggatccctattttaacttctttttttcggctcaaaaccagtttattgggttttcaagtgatgacattttaaaaattagtaagtgcaacaaaggatgaacatagagagagcggatttctatgcacaaaaaatgataattaagcacttaattcagcattcaaaaatgctaaataagataggaatgaatgaaaaacttctttggctttttaacaatttttacaaaatgatcataatttcattttctgctttttggattaaaaacaaaaatttcttaaacaaatcttaaatatgagtgttcagaagcccagaaaagccccgagattatttttttttatattagaaaatgtttttacaaaaaaattagggaaaaaccgaaaattttgactttatttgaaatttcatgttataactgcagcaacaacagcagtcaaaaggtgggaacaatttaacgaaaaataaatatttttgtctattatttgataattttcccaatgaatattttaaaaacatttcattataacaaatcaaaatggatttgattttctgatatattataattacattttaatt

SEQ ID NO: 41111 - DNA, 1093 bp, Heterodera glycines
  misc_feature (17)..(18): n is a, c, g, or t
ctctagagtcaacacannagcagaattgggatttggaaatttaaatcgcgctccccctgggtttaatttttatatgtcccacgcattttcaggcataaacttttcacataaagttgaaaaattttccaacggcaccagacacaattccaacagttcaacaaaagcaaacaaagtattaggcaaacaacaatgatattcctgcctagttttaaactatttaaattttttgttgaaaatatcaaaaaaggaagcaattttactgacaaattctttccagaaatttacttggtgaggaaaaataatgttttgagttggtaataaaataaaaccgctcaacaaaaattatgtgaacaatcagtcgtgaaccagaatgtaaattcaggagttgtacattctcacgccgaaacactattcgcaaaatttggctgtgactacgctccaatttgtgatcagccagctcagtaaacacaagcagaattgatttggaaatttaaatcgcgcataataggtgtttaatttttatatgtcccacgcattttcaggaaaaagttttcacataaagttgaaaaattttccaacggcaccagacacaattccaacagttcaacaaaagcaaaaaagtattaggcaaacaacaatgatattcctgcctagttttaaactatttaaattttttgttgaaaatatcaaaaaaggaagcaattttactgacaattctttccagaaatttacttggtgaggaaaaataatgttttgacttggtaataaaataaaaccgctcaacaaaaattatgtgaagaatcagtcgtgaaccagaatgtaaattcaggagttgtacattctcacgccgaaacactattcgcaaaatttggctgtgactacgctccaatttgtgatcagccagctcagtaacatcccctctcatttagatttgaatgctcagtctttaaggtccatcactccaaatcttgcccaaaatcctgacatccgcaacaggggactcactgacagatcaacccctccccttatcaatcaaatcataatttgagaaaaacagcaggatgattcccatgtctgggctgatgaatcctct

SEQ ID NO: 41112 - DNA, 1188 bp, Heterodera glycines
atacctattttagcttgaaagattagtttttgaaaaaccttagttttgccatgacaaagattaggcatatggtacggtatttgaatttttgtagattaatggcaatcaaagaatacagaaccttaattcacaatactcaaaaaaaaaaaaaatcaaaaatagcagatttcacagaaattttttaatttcaagtcgtgactgggacaatccgacagtggacaatccgacagtaaatttctattttaaaaatattttcaagacattagatgcattttactggccaaatgcattttgaggtgtccaatcaaaagtaaacttagttatgccataagtatggatgagatttacagtaactaaaaccgccaaaatcgttagtttttaggttctaaaaaactataaattgcatccctagtcatagaaatagagggtgatcatggacgccaaaatgctctattggagcgtaaaatgcaatggaaaatgccaataaaatacatcagactaaccatctgcaattcggcttaaagcttcaaagctatactcgaacccgtcggccaataaaatttctctgcgctgagttgtttcggaaacaaagaagattttttcatttggttgcagattagcagggggtggtgggatttgtggattgggttggactgcttggatttgtgggacgggttcatgaatttctccttcttctgaggacgacgaatccatttggacgaaaatgaatgaatgatttgaagaggtaaacggaatggtcaagactttggcaaacatttttatcagcaaaaatgctctcatttctcatcactttggttttatgggtcactccacatttacttttgcatatttatttatttatggttgtatggatcactatcattaattattttttattttattgtacttttgttaccagcataccaaactaactttttttaatttggtaacaaatttaagctaaattgatttgattgagatatttttaggaaataatccgttctaatgacttgaaaatattttttaaaatagaaatttactgtcggattggattgtccactgtcggattgtccacttctgtcggattgtcctcactgtcggattgtccaactgtcggattgtccaactgtcggattgtccaactgttggattgtccaactgtcggattgtccactgtcggattgtcca

SEQ ID NO: 41113 - DNA, 1010 bp, Heterodera glycines
aatatccctatagattaattttattcgtttaccactactacgcagaataaaattgtcaatcttttcggctttcacttcagtccttttgtctgttttcgttagagtcttcatcttttcatcaaatttggttttgtactccgaatctttatgcttttcacttttcagatgacaaattaatgatgatatgctcccgtcggaaagcttgaattggtattttggctgttttttggctttgcattctgccagtttgtcgttttccttgctcttctcaaacaacccaattttccaaatagggtgaaatggcgccattaattatgaattattaaaatcttaactaaattggaagaaagaatatcaaaaatttattcctcatgagaaagttgacaagtaaatattaatctgactatttaattttggcaaaatgttttgccaaaaattcaaaaaattccaattcttaccagtgcatttttactctcgtttttttggtaaaatttccgggatcggggagcgggattgggagttcaaaattttccgggacgggagtcccgaacgggaatcccgtaaaaatcccgatcccgtaaaaaatcccgttcaccgaaaaaagcgggagtcgggagcgggaatcccgtaaaatcccgcgggagtcccgatcccgccgggctctagtttatgtatatgattgacaaacaaaagaaatttataaaaagtaattaatttgtgggtgaaaacagctaaccagactaaaccgaccctctgactaaaacggccagactaaaccagggctcggatcgaaaaattttcaaaatcagaacatcgggtccaaaaaatcagattttggggtcgaaaatcagaacattttgcaaaattgcttcaaatcagttatttttacaatttttcgatcaaaaatgtatctaatattatatttttcgtctcccattatcgattttaacaattttggggagaaaattagcaaatcatcaattttagcgcattcggaatcaaaaaatcag

SEQ ID NO: 41114 - DNA, 809 bp, Heterodera glycines
ttgattgggaatgcaaatagatgaacaaattatccgtttccatgcaaataatattttaaaaattcattgaaaaaactcacagaatcctcctgctgttcgttcatctcattgccttctgtttcttcgtcgtttctgcgcattttgagccaaattttgatgattttggcagaaaaaaaggacacgtaaatggtggcgatgacggcgagcgacagaccaaaattggcattgtgaacggaaaatgcctaaaaagggaggcaaatgccattaatccatttacgtacataaaaagccaaattattttcgaaatttagagccataatttaaagaaatttccccactcgggatgattctctcagggactcgattttgatgactcattctttcctcactcatctcttttcctgacttccaattcccgacttagcattaaccacttaattatttattctctccatttataaaattagtacaatttacagtttagttttttctaagcttttttcatttatggattccctctgttggtaagaagcacatccaaaaaggctaaattcgttaggaaatttttggattttttaaaattaccaccccatccctccatctacaaagggtaggaaaatgatgccacacttttggcagcagatggaaggtggcggagccggacaaagaaccaagtgcaaaactgaacatgaagtcggaggaccgatggcacaaacacttcttcagagcggaaataagcagtgcgagcactgaaaatgtttagaatacatagaaagactaatgatcggggcagtcaaaaatatgcacga

SEQ ID NO: 41115 - DNA, 934 bp, Heterodera glycines
  misc_feature (882)..(882): n is a, c, g, or t
aactgaaaaaaaaattgtatagaaaatttttttcacattcttaacagctaattgtaagtcgattcatttttttcctttgctattaggttactgtaaaattaggccccgactaaaattcgctaaaaattaactgttttttttcagattagtcaattttttggtggcggtgagaggagacaaaaaaaaacgtttatgaaaaacaaaattggtatgagatggaattgttgagtaaactcatcattctttctcaccttcaatgacccctctccatcgtccaagccaaacttcgccaaaattgccctcgcccaacttccggtccaacagcaattcatctcgcggaatttcccaatttttggccgtgtcatagctcagatcgggccgaaccggagcaatttttggagccggataagtgagatgataacaaaggccacccgattcttctattgaaaaataaattaatatataaataatcaatcaaaattttattttagattttctattacaaaaaaaatctctcatatttttttataagaaaatttcaaaaaattattttaagccatcagttattgagattacaaataacttatattattacgtttgcgttcaaatttgaaactaactcgaataatattcgatcaaatcccggacggttccgaacgttttccgggcggtgataaagaaacccgagccgttgtcaagcggtcgtattttgtagtgttttacctgtaaagagagaaattaatgaggacggacggataaaggataaatctgattatgtgagatcagaaataaattcattaaagtatttaataaacgggggatttgcattatgaccgcataattgtcggttgtatttccatataatcaaaatttttggcttanataaatgaaataaaaagactaattctgcgcttgtggacgacggtcactactt

SEQ ID NO: 41116 - DNA, 979 bp, Heterodera glycines
tattactagactaatatattggaaaaaatagcgaacactcccaccctagaataatttttaaaatattttttcacaaaaaaattaaataacaatttttttttattaaaatttaaatttaaacaataaaaaaaatctaagtttgaggtgtttcaatggtttgtttagaagaagctttggaaaaaaagtcttccaagctcagcattttggatgaatactaattattttgttttgtatttttttcgaaattattatttttaaacaaattttaattattgcggtaaacttccaatttgatgatgatgtttgtccttgtgcttgcttacttattcgacaataaaaaaacttcaaaatatgacaaatttgagcataaatttttataacatgcacacatcgcccccatcaccaccacactgaaaaactcgtcaaccgatggccctgaaaatataaacatttaatcccatccgcgcggcaaccacagccatagccaacactgacgtggctgtggtggctgtgcggatcgccggagacttaatccgggcgcattttcaaaattcaccaccaccacttttagtacacattttaaactgatgaatggggcttcagccaaatcattttgagcgatttgttaatagccagccaccaaccatttctaattccattgtcagcaaaaaaaatttttcacttttcttaataggggtggctgttgaatgctagaaatcttttgccgattatacaatatggcatttcaaaattttgccgaggattgggtttgagtcatggtcacctatcacttgggctgatcgtgaatggctttgaatcaaaaacgagaatctcgcaaaaaacttatggctatacttggctttttgttaagctttttgtcgagtgcttatcatttggtcctatcatttggcgatcaatggcttgattattcaattgccaaatgaagcacaatttttgatttactattattgttttttat

SEQ ID NO: 41117 - DNA, 1335 bp, Heterodera glycines
  misc_feature (92)..(92): n is a, c, g, or t
ggggggggggtgggggagaggaggtggcgatatctcgctcgctccttctcttttcccctccttcccccggtctcttttattccttcgttctnttcttccactctgttcgacctgcacaaatgtttctcgttcttcacgcagccgtctgatctcctcgtcctgccttttcagttggttcgtacacacgtggttctgcgtctccatctccatcaccttctgccgcatttccttcaactccgccattgtgtccgcctctcgaattttcagtccgatgaattggtcctccaactctctttgactccatccctctaaagcttccgctgtcccaccgttttcggcactcgccaatgaattggcactgctcccaaccgcgcccatcaaagtggcggtcagtttggcaattcgcgctcgcgcactctgtgccgatgggttttggcactgttgcgcatgcgtgttctgctggtttgttgtttgctgtgtcggcgattggcatggctcttgcggtggctcctcctccatggaagaggaaggcggcgactgagcaatgtccaaagagacggacggagaagcggagagttgggcagcagtgactccgcggaggttcatgaacctaagcaaacagaagttgggcacaatgtgaagaccaacacacctcgtccagtgctgctcaacttcggccaacctttggcgcatttccttcaacgacagcgacgcttccgcttctctcattttcacttggattagctcctcctgaatcgccgcaacgcccccatccggcggatattccttaagccttttgttggccgattcgagctcttggactcggttctttaactctcgcgcagtgttctccaaatcagccttgaaatgcgaggttcccatattttttcaggtccaaaaaatgtttgcctttttggtgtgggactcgatcagttcctgctgcaattgatggatatgttcaatcatcgaagtatcatcaatttgtgctccttggtctatctgaatggcaaatgatcattaagatgtccctttttaccatttaaatttgagttcaagccgtaggcataaaattttttttgtagccgttgttcgcaaaaaaaaatttcaaaaaataggggaaatgggggtccagcgtttccgatagtcgccgccgggagtaattttttgaaaattttaatacattgttaagtaaaattaaatctttaaaatgccattttttcttccgacagactttgtccttagtccttttgctgctcagttctctgatcgtctcatatgcgtcctccaaccgtcgataaggtccgaatttatgtctcgaagtgtgctcaattcatg

SEQ ID NO: 41118 - DNA, 898 bp, Heterodera glycines
gtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggcgaaggcccaccacgaggcagcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagggaaataacctgttttatcacattagcttgtcacccgggggttataaaaaattttcaaaattctgagtctcctattattttatttatttttcaaaattttgaagggcgggggggag

SEQ ID NO: 41119 - DNA, 1446 bp, Heterodera glycines
attagtccctaagcatatcggaagttggaattccgtcccaccgcggttggtttgaaattttttaaaaattctaaaattttcttagtttcaaaatagtaaaagttaaatttactttaaatttttaagttttcccaaattcctacctttcggagcttttaacaaactttcataaagaaatttttgccctattttgaaacaattgcaaataaaaatgtattaatgagttttatactttttacactcttaattgaggacaaattaaaaaactatattaattttagaactttttaaagcattttcttaaatgtccaaaattatttccaaaatttttcaatttttttgcacatattttcatcttttttataaatttatcattttcattttaataatttaattttaaaaaataagcatatgatttttaattatgtttttattactttttttgtttctcatcaatttttattttaatcacattttcaaatgcaattccatcggtgcgttaatactgaaaaaataataagttaatatttattgcgtttttattttatttgataatttaattaaaacagaaaaacaaaatgatgtttaattctatttctaaaattccttttattatttttattgctaatcattttttaaatccattttcaaatgctattccattggtgagttaattaattagagaaattaaattaataatccatttgaattaattagggcgaggacaatatgctaattgcaattatgaaggcgatcagcaaattcaaatcagtgaatattcattgcaaaaatatgaggcaaactttggcattgtgttttttatgttcgaaaatggaagttacaaaatttgtgagaaatttgatgctcacttttcggaatttgtcaaaggatttgcgataaattttgacaaatttttaaagatatctaaagaatattcaaattatttatacgatttaaagagaaaagtatggtgatgacctcatgagcacttttgggttattgaaattgagaaaatgatgaagcagatcttggcgttatgcattgatgcgagagaattgacactgtaaaaaaattggaacggaatttaaagaaaaatgccaaaaatattgaaaatatttggatgttttatatgaatactaattcagcttgtatgttgaaggtttgtatgatttttggattaatttaaatttttcatttattaaataataatgattattagggctcggaaaaatatggccttaaaacatggaccaaaaatcgccaaatatggacataaatttttccaaattgagagtgtaatttttcaaaatttcttcaaatgcgctaatgtaaagtaaaactttcaaaatggctaaatatggtattaaaaatcattttagaagaaaaaaacacgataaagctaaaatttactaatttttagcgaaaaatcaacccgaaaagcgaaat

SEQ ID NO: 41120 - DNA, 952 bp, Heterodera glycines
  misc_feature (833)..(833): n is a, c, g, or t
tttaagagattgccttgtagaaaatgaccagtcaaactgtccgagtgacgtgtgaaagtccggaaaaattgcacaaaatgcaaagggcgaagaacggaattcagacgaaaatgacaaaaatgaaattatttggaagggattacaggggaattgatttggagaaataacgaaaaatggggaaatgtacgccaaattgaaatgggtgggggagggaatgccaaaatgaatgagggggggggggcatttgccgaaatgaccgctgtcacagtcactttttacgatcacatttctgctgctaatgttgcctttctgctcccatttaaaagccgtgtcgccctccgtttgcccattttccgtgccattctctctctcccgatgccctgctcgtcctcctcctcctcttccgccgcttcgttttcctccgttttccccgtccctttccccgcttcccatccatggaatcctttcgcttctgccgccccttttgtcatcgcaattggcagtggttctgtgtgcgtcaaaaatggcgaatgtcgccagtacaaccaactgaaacgacaccaccacgagtcagcaccggtcgcagcagaagtgccatcagtcgacgagggaatgaacgcgacggacaaaaggagaaagaaacgcggaccgtcggcactcgcaactctttccgcccttttgctgcttggcgtggcgctaattgtcagtttggcattcgtcgcgtggacaatccatcggatggtaaacgaaaagaaaaggccaaacgatgccagggaaagtgggaaaattgaattgcagaacgaacagcacaaagaatgtgcggaagcgatganaacacaagcggaacgaatcgaagtgttggaaagtgcggtgacaaagcaaaaacggacggaggaaaaggaaacggaagagccaaatgacaatgggaaagaaagccatggtaagggaggga

SEQ ID NO: 41121 - DNA, 1244 bp, Heterodera glycines
ggcggatttgcttttatattcggttttttagggggggggggcgggtccgctataatttttaaatcgaggtttatcaagttttgccatcctacttatacactttcccccccccccccccccctggccagacagctggaatcggtggtatcccgaccgaatcccggtcctgataatcccgaagaatttcgaaaagcgacccggacagataataactgggatcccgatcgaatcccgataccgatctatcccgtagatttttgaaaagcaaccgggacagatacccgggatcccgaccgaatcccgatcaatcccaaatattttttcgggatcacacgggatttgctttgaaactcattttttttctataaaggccagtttttgggattttgagccatatggcgacgaccttttaccgcttttggcgatccttttccaagaacatttggggaacaacacatgggagtccggcagcgccgataggccccgtctggaaaattttagtaatttttaatgcaatctgattttgcccaaaaatttataagaaaaaattttcaaaaaaattttacttataatttttgaaaaatttaaaaaaaatttcgcggggggggggacgacctgctctgtcgtgcagcatgagaactcgaaatgatctgcacaacatgggaccgtgcacatgtggcgacattgccggccttcttttgcgtcaattgccaatccgcatttcatgcaaagcagttcattaaatcttatgccaaaaggaaagtttatcacatgttaaaacccttgaatgtagacttcgttttatttattgttcaccatttgtcactaataaactcattaaccatgaatacttgatcaacgcatttttgatcagtgacactattggcatatacataccaggtttccgatacattcatcaagttgttgatccgtacaagtcgaagattattattccatttttggcattccagtgaactatttctgaatatttttaaacatttatttattatattattctatgcattttattattttcataaacacgaattaaatatgttaggataattatccgacctttcggggtgagaaaaacgaattgttaatttattaaactaagtgaaagacttttaagtcaatgtgatcagattactgaaatgtttcatctttgtccgaccaacttttctttttgacttcattttattaacgaaaaaattctttctttaatttcaaatttaaataataaa

SEQ ID NO: 41122 - DNA, 957 bp, Heterodera glycines
tgccaaccaatttaatttaaaggtcatataaattatctttacgctctttaattagcgcgatcggtccattgtatccgggacatcgttataaggtaataccaagttaattcaaatcattttattcaaaaaatgtaaatggcttttttgaatcttcccactttaaaaaatttttcttttttttcgtctattaccctaattttgttcatttttaggtggtgatcgaggcacgggacaccgatgggcttgttggccatgctgttgtgttggtccaagcattggccgcagaccatctgccatcaaaagctgctttttcctccccctcctcttccgctgctcgcgcttcgctgttcggcagtggccaagttccggtcattgctgatcatcagccatttccgctttcatcgtccgcatttgtgccaccattagcaaaagccgtcggcgtcggcatacccccggcgtcaccaccgtcggcacaaatgtcctcctccctttctcaaaatgtgccaccagctgcgggttcgcagcagatgatgtcatcggcactgattgcgtcctcggccggtgggtattggcagccgattagcaacggcggcaacaacaaagcaaattccaaccaaaagccgaacccattttggcgagttgatccaacaacaacattagcaacaccagcagcagcagtgaagttgaatccgatgcttataccattcgcaactaccacaactgccgtaccaccgccgccaaatcagttcacggtgagtgttcagtgaaattcgggcttaacccggattggcaccgatcgaaaaagacagtctctcgataagaataaggttcaagaaaagtctgcaatttttgggcattgaattcgaaacttggccatgtttcggacagtatgtcaacagatgaagcgatgatgtaaatgctttgcccctcgtatcttcgttttttatagctttttac

SEQ ID NO: 41123 - DNA, 808 bp, Heterodera glycines
ggaaagttgcatagcactttgaagagagagttaaatcccagcgccaaaccgatgaggtggaaacggacagagctggcgtatctgggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgtgtataggggcgaaagactaatcgaaccatctagtagctggttccctcctgagtttcccccaggatagctggagctcggtaagcagttata

SEQ ID NO: 41124 - DNA, 1415 bp, Heterodera glycines
ttagtggccaattagtgaaattgagccattttacacgacaaattagcgacttgttttcggggtaatgcgcacacacccctcaaaaaaggtgcccgtgtaaaagcctttcgccggcgttcggccgtcatggtttttcttcgaacagcacatccacaacggttttggccggttcggcttccatttaaagcgcatttcatggccacactcgcagaaacgccgggtgtgcaacagtttgtgttcctgcagccattgctcaaaatcggcgtcaggcaggagcaacagtttaaacaaatcgcgaagagtaaagtttttaagcgtttccattaattattattgtgcgtacaacttaagcggtcttttttttgaaaactagcggaaccgaatgaaaaaaatgcgtttgttatcactacaaataagcaaaggtaaaagccgctaagcttttaaagtgaaattaaaagccaattttccggaaaagagagattccgatgataatttttataattttttcagaaagggaggcactatgggtcaagcccagtgttagacaaaattgctcataacgccaaatagcgcattttgcgtaactttttgcgcgctatttcaaaatttacactggaaaatgcctttttcgcactatttattttgatctgccataactcgcttcattcccaactaaactgaacaaaattggtatctaaaaaaagattttgaaaaggagaatctttttctaagcaaatgctaagcaatttaactcatatgaaaaaagttgtgggaatttcaaattttcattgcgttataactcaggtccgaggccgctgttttcaaccaaaatgcggaaactaatcacttttttattgattctaaaagtcaaaagtggttttgtactcttctaaccaaaactagtagaatttgcgaatttcgatttttacatgtgctagagacatgaaaatagtacgccaaaaagagagaaaaagaaatgcaaatttttttcatcccatttttgtaatgttcttggccgaaacttttactcaaaacactgaaagtttgttcattttcctttttttttatcagtttgcaaaatttggtgcggatttaacatagagaaaaaaagctagacatagaaaagtgaatgttgttttttacataattaaaatgaagagatagtacgccaaagtgagagaaattacaaagaaaaagagaaacgacgagatagtactaggcttttctctgcacagtgggagttgacccatagcactatgggtacgcgccagtgtcagacaaaattgctcataacgccaaatagcgcatttggcgtaaattttgcgcgttaattcaaagatatactgattactgccttttttgaagaccaattaacattaataaactttattcattgactaaaactcttatttaat

SEQ ID NO: 41125 - DNA, 509 bp, Heterodera glycines
ctcctttcatacattgacataactggaatgaattaaaacccccccctcccgctaaatgttctctattagcttgccaaataaaaacctcgttgtggtgagttttattcattcagttaggtcaattacaaaaggtgctatacccaaaaaaccggcatgggacccattttgagcggggcccattcggcccccacccgagacgaaatgaggtaatacggttgaatgaaacaagggttttactccaaaaaacttattgttagagtaataattttgggaatgaaaaaacaaaccttgataactgaaagggaaacattgcgaaatgtcattgctcaaattaccgcagtaataaatgtccgtcaatccacccaaaccattttaaaagcttttttatcgtatcgagcatggacgatttggtattgtgaattttcggcctttttcccgaccccccccccgaactgatcggaaaaaaagtaaaactctgaaaaccgctaaaaagcgcaatttttcaaatt

SEQ ID NO: 41126 - DNA, 672 bp, Heterodera glycines
  misc_feature (660)..(660): n is a, c, g, or t
cccgttttttaatttttaggggacattcggccgcttcgcggcctcaggacgagcgcttcgcgcccgtcttttaattttgttaagaacatttggccgcttcgtggcctcaggacgggcgcttcgcgcccgtcttttaattttttaggggacattcggccgcttcgcggcctcaggacgggcgcttcgcgcccgtcttttaattttgttaagaacattcggccgctgcgcggcctcaggacgggcgcttcgcgccagttttttaattttttggggggaaattcggccgcttcgcggcctcaggacgggcgcttcgcgcccgtctattaatttttttggggacattcggccgcttcgcggcctcaggacgggcgcttcgcgcccgttttttaataaattaaaaaataataaacacggcctgggtccgaacatgccgccccacccctcagaatccccaataacacggggattctgaggtcttgactatgtcaaaagtaaaatctgatcacgtattcgtgatcagcggcccaaataacccctaaaatcatatttttggaagatttttggtgaaaaaaattttccactcaaaaatcatggtcacacccctgtgttcccaaattacaaaatcacttttatttctataacttttttcaaaaaagtgantaataagctaaa

SEQ ID NO: 41127 - DNA, 752 bp, Heterodera glycines
aaatacacctcataatatgaaaaatggtaattttggctccacgccgtgaaacaaatacaaaaaatgcattttttggtgttcattatttaaattttttaggaaaattaatgtgtccgcgtaaaaattttagagattctccaccccgcgccttcagaattttctatttccacccaccttgttcgagtgacggttacgcacacgttcaacaccatgaccatgttgctgctgctcagagttgttgttggcggtcatcttgcgcaccgctgtcgccgtcttcgaatgttttttgccagctgcacgttgcgtagaagatgcataaaaaatattttaaaaaatgttgtgtgaaaagattttctgaccagctccttcctgcttccattgggcttctgcaaattgaacaaacacagaaacagtggagaggagaagaagcaaaatgaaggtatcattgggaatcatttctgtcgccccaagtggcaaaaaaggtaaaaaaaaatcaacaaaaattttacaaaaaaaacaacaaaaatactcttagtttttacccaaaagataatccaaagccattctttttcaactacaaatttccctctgcttttgattcttctgccaattggcttttctgttttgttgggtccgtaggcctttaaaatacactataaagtcaacacagatgttttcttcgcttctccaaaaagcctaatgatcaagcccatccggcggaagaagaatggagatgaagcgacagctgctgt

SEQ ID NO: 41128 - DNA, 1093 bp, Heterodera glycines
aaaaaattgttttttaggccttacttgaaaaaattttgagaattttgaaaatttaaaatttgaaaaaattgagctcatttagctttacaattagtatgctagccacccttcgctcaggtcaaacccttgcgcggtattcgcgtcgtactgaagtgtacactttgggtaaaaaaaattagccaaggatacagccttgggcgcgcaacgtaggaatttggtcttgatggcaaagttgtcggagatagtctgacttaatatcctatcagcaagatctaagcgatctcggtccaaagaaaaaatttcgtagaagaaaaactgcaagaaaaagtgacaaatcgcttctcgggactcagtcgtccgcgcagaatttttctctatagttttcttggattctcctcaaaaagttgtaagacccttccaccactttcagggcgctctcggccttcggccggtcggaattagtttttgaaacgaaactccttgtcaatataacgtatatagtaatagcgggtgcgtgaaccgtcggttatttagctgggaaaaagcgcttcgcgctttcggagcttcgctacctagactgtgaagcgattcaaattgatcgaattggttggagagattttttgaatttttaaaaaattattagaggtttttagtccacattgaggctcaagacgggcgcttcgcgcccgttttttaaatttgttgaactcatacgggcgtttcgcgcccgttttttagcttgttaggcgcttcgcgcccgtttttcaatttttgttggccttggacgggcgcttcgcgcccgttttttaaatctgttgaacttatacgggcgcttagcgcccgtttaggcacaaaagtgattaaaagaggtacaatagtgattaaaagaggaagaacagtgattgaagaggtacaaatgtgatttaaagaggaagaacagtgattagaagaggtacaactgtgattaaaagaggaagaacagtgattgaagaggtacaaatgtgatttaaagaggaagaacagtgattagaagaggtacaacagtgtgagaagaggtacaacagtgattaaaagaggaagaacagtgataaaa

SEQ ID NO: 41129 - DNA, 1076 bp, Heterodera glycines
acattattaacaaaaaaattaattatttaggtataagctgtatttgcttatatttgtaatatattagtaataatattccaataaattttaaatgacatttttatgtatttgcgagagaaatctctcatgtctacgcctctaaaataagctcatatctattgtgtgatggcaaattgatttgccgagagagaggcaaaatgagaaattcaaataatcttattaaaacattttttaccgattttgtagccaaaaactctcgttatagatagtcttttttgaacttactattttaaatattaaagagattcactatttttgggatgctgaagtgacatttggcctcatattttagagggatcggatttttctctttcgcgtctatttgtccccaagtttttctttaattttaaaaagaaaacggtctgaatctgtgtaaaaaggtttaaaattgattaaaaatagaatttagggcgagcttgcccgctttcaggctggaaaagtgccgggactaaagtgaccaaactcagccgagactcaacagaccatactgaaaagcactcaaaagctcttttaaatgatttttaattttgattcgaccacctctacagtttgtcaaggcctccaatttgttttggtatgatttgtaaatgtgaacatgataataataatcatcacatttattcaattatttaccatttattttgtaatccaaatgtcacattttatatatgtcctaaacaattgtctcccttctagtgggcggttctttgatcaccccctctacctttgattacgcccccggggactttctctcgatcagtcttatattcatcgggcctctcccccggcagtctctgctcccgagaccgaatcgggaagagggcctaagcattgtatccttcccccggaataaaggcgtactgttgcatactgtattaagggggaataaaagaatacaaatggccctacggtgacacataacattcatggaggtcccgccatcgggaaaacagagactcttgtacaattttgtaaattaaataaccattatttttgtgtgcatattatattaattc

SEQ ID NO: 41130 - DNA, 60 bp, Heterodera glycines
ccatttggcccatcagtttatgattgaacatgttttgggaatgtgtgccaaatttttggt

SEQ ID NO: 41131 - DNA, 825 bp, Heterodera glycines
ccgacggaaaaaaagtaaaatttcaaaaagcattttttctagggtaaaaaatgtgcggatcacgaatctgaactatgattttgaaaaaatcattgattttgtctatgacttttcatcaagtactaaattttttcaaatttttatttttttaaagtattttctttccaatgagtttagggtaaaaaaaatgcgctgatcattaagttaggttacaaaatctcgccgggacagcggcgcgctttttccaaaaaatttccgggtacagggcgctccaaaaaaatttggaaatttttgtacaattttttgcacttctgagctcctctctcttgcccaatctctctcctttttcttttcttctctctttcttttctctctcctctttttcctctccctctctctttctataaattactgcaccaagaattaaaataaaaaataattttgtgtttaatttatctaacttcccaattaaaatctgcgagttaactttatttttccttttttataatacattttacaaaagaaataattaattaaatatctgttgttgtaataaaaatggaaaagtgaaggcgaaaagtagaaaaggatatataaattgttaataatttgtcgacgaacgattccaaaagaatgtacgctgtctaaataaaacaaacaaagaagtaacaatgaacagatttcccagatagaaatactctttaaatgtgcagatttggtaggaattgtgagctgaatgaacgaatgaccatttggggatagaaatagagaaagaggcgatacaatttacgtatatatttaatcacgaaatcaaggatgaccaaa

SEQ ID NO: 41132 - DNA, 1160 bp, Heterodera glycines
ggttcactgctatataatttcaagggccgactcagtccacaaggatagaaaaaagaaatagggatttttggaaatatttttcaaattttcacggacaaacccgtactggaaaattccaaggaagtattgggttcactgctatataatttcaagggccgactcagtccacaaggatagaaaaaagaaatagggatttttggaaatatttttcaaattttcacggacaaacccgtactggaaaattccaaggaagtattgggttcactgctatataatttcaagggccgactcagtccacaaggatagaaaaaagaaatagggattttggaaatatttttcaaattttcacggacaaacccgtactggaaaattccaagaaagtattgggttcactgctatataatttcaagggccgactcgatagaaaaaagaaatagggattttggaaatatttttcaaattttcacggacaaacccgtactggaaaattccaagaaagtattgggttcactgctatataatttcaagggccgactcagtccacaaggatagaaaaaagaaatagggattttggaaatatttttcaaattttcacggacaaacccgtactggaaaattccaagaaagtattgggttcactgctatataatttcaagggccgactcagtccacaaggatagaaaaaagaaatagggattttggaaatatttttcaaattttcacggacaaccccgtactggaaaattccaagaaagtgttgagttccctgatatataatttcaagggccgactcagtccacaaggatagaaaaaagaaatagggattttggaaatatttttcaaattttcacggacaaacccgtactggaaaattccaaggaagtattgggttcactgctatataatttcaagggccgactcaatccataaggatagaaaaaagaaatagggatttttggaaatatttttcaaattttcacggacaaacccgtactggaaaattccaatgaagtattgggttcactgctatataatttcaagggccgactcagtccacaaggatagaaaaaagaaatagggattttggaaatatttttcaaattttcacggacaaccccgtactggaaaattccagaaagtagtggggtcactgctatata

SEQ ID NO: 41133 - DNA, 135 bp, Heterodera glycines
cctgcgcacgctgtcgaaggcctttgcgctggccggcctgcgctgcggctttacgctcgccaacgaagatctgatcgccctgctgctgaaagtgatcgcgccttacccgctttcgacgccggtggcggatatagc

SEQ ID NO: 41134 - DNA, 954 bp, Heterodera glycines
tgcctacatgaaaaatgaaggagccgaaaagttgcttgcttaagttactaaaaaaactcagctaaacccaaatcacttaagtcaagggtgtaaccgtacggagtcaatacgtcgccaaccgaaacatctctggacgtatttttagaccataattgaaccaaattaaaatttttggtatagttaaaaagcgctattaatctgcaaattttgaaaaaattttgttcatgtacaaaaaaatcagagcaacatttcgaaaactaagttttgagttcattctggccataacttttttgaaaataataaaaaaaattttaaatttagcagaataataataaacacactaagctatcgaaaaattaccaagaatgcttaatttggttcgtctgggtctggacaactatgaatcaattgacacatcaaaggagttggattatagatggtttgggtggactgtaaactgatgtttggcatatttgttaaatttaaataattgttcattttatgtaaaaacaataaacaaaaaataacaaataaagttttatatgtttgagtttgagggaaggaaatgtgttttctgttgtttaataaagtgggaatgttatgcaatacttacggcttactgggcttgttgtgcagctatgaagtgaaaaaaaagtttgacacaaaaatcttaatctgaatgaaaaatcgactgaaacatgttaaaataaaaaatttcgtacagataacaagttaatttccggttttgtaatattatttttttattataatattatttatttaatctataattaaattttcaattttataaatcaaattacactcattagcataaaatagtttttgcaaaactatgacaatgactcactgtgaaaaggaaaacaaatctgatgctagcccatatagattttagcttgttttatgcataacgcaaataaatttaaaatattactt

SEQ ID NO: 41135 - DNA, 1656 bp, Heterodera glycines
  misc_feature (1380)..(1380): n is a, c, g, or t
  misc_feature (1453)..(1453): n is a, c, g, or t
tttgaatggacattttccccttttttgaccatgctcaactcagcctcaaattggcacttctttcgccctgtttcgatgcgctggtggacaaacattttcaatggcaaaacgaattgacgtaagtttcaattaaaaaaaacataatcataagaaaaattgcaaaattttctaaaaattttcatttttttttgagacttacaaatgaaggcctctattttttcacttctttttgcttttgaacataaattttgtgtttaatccatatcgaaatttttggttaaatttaattcatagaaatgccgacttatcaaaaaattgcaccgaaataaaaattttccaaattcgacatttttttcttgtaaagcggatttttaggcattttgcacatatcatttttagcctttgcgattttataatttttattacttttttcagcaagtgcgcaacgacacttggtggccttttcccatcttttgaccatgctcaactcgggctcaaattggcactgctttcgccccaattcgatgcgctggcggacaaacattttgatggaccaacgaatttttgtataaattcggcaagttttttttgggttttctttttgtttttttggtcatggccccaaaaatcttaaccgccccgaattttcaaaaatttctgaaatttttttttccaatttcatttttttgtaaaagtaaatagtttttttttgtttttttgaacgtttttgtgcacaaaattttaatggcctcaaattatcaaatggctctgaactccaattttcaatatggctcataataaaaaaattttccgaattcggcgtttttttgtaaaatgccgggggttttttaggttttttttctggaatctttttttgtgatttttatttttcataaatttttcagcatgtgacatttgatggacattctcccatcttttgaccatgctcaactcggctcaaattggcactgctttcgctccaattctatgcgctggtggacaaacattttgatggaccaacgaattttttttataaattcggcaagttttttttgggttttctttctgtttttttggccacggcccgaaaaatcataacggcccgaattttcaaaaatttttcagaaattttttttttcaaattccaattttttgtaaaagtgaatttttttgtttttttgaaggattttgtgcacaaaagtttaatggtctcaaatgactctgaaaatacaaaaaagtttactaatccaacagatattttggtaaaattgccgaatacggtaccaactcaaaaaaaaatcctaaaaacatgttttataggttttcttatgtgctgagaatgacagaaaagcttaaaattagatgcggagatgcatttanaaccggtttttgaaccggtttgacgagctaaatctaaaattaattattattttatccatccattatttcttgngaactgaaatgtccattttcacttcgactcagatgtcccagtgctctgatggcatcggccaaactaattctttgatttttagacttagcttgtcaagagtttataatggcctcaaattatcaaaatggctctgaaaaataaaatttttaaaattcacaaacattttatgtattttctttaaagtgcctgggacttaagctttt

SEQ ID NO: 41136 - DNA, 1177 bp, Heterodera glycines
catgaggggccccagcgcccatggcctttgatttcacaatgggccccaacgcccttggtctttgacttcacgatgggccccagcgcccatggccattgacttcatgattggccccagcgcccttggcttttgacttcatgatggcctcagcgcccatggctttgacttcacaatgggccccagcgcccttggcctttgacttcatgatgggccccagcgcccttggccattgacttcacgatgggccccagcgcccatggcctttgacttcatgatgggccccagcgcccttggccattgacttcacgatgggccccagcgcccatggcctttgacttcacaatgggccccagcgcccttggcctttgacttcatgatgggccccagcgcccttggccattgacttcacgatgggccccagcgcccatggcctttgacttcacaatgggccccagcgcccttggcctttgacttcatgatgggccccagcgcccttggccattgacttcacgatgggccccagcgcccttggccattgacttcatgatgggccccagcgcccttggcctttgacttcatgatgggccccagcgcccttggcctttgacttcatgatgggccccagcgcccttggcctttgacttcatgatgggccccagcgcccttggcctttgacttcatgatgggccccagcgcccttggccattgacttcatgatgggccccagcgcccttggctattgacttcatgatgggccccagcgcccatggcctttgacttcacaatgggccccagcgcccttggcctttgacttcacaatgggccccagcgcccttggccattgacttaacgatgggccccagcgcccatggcctttgacttcacaatgggccccagcgcccttggcctttgacttcatgatgggcccagcgcccttggcctttgacttcatgatgggccccagcgcccttggcctttgacttcatgatgggccccagcgcccttggcctttgacttcacgatgggccccagcgcccatggactttgacttcacaatgggccccagcgcccttggcctttgacttcatgatgggccccagcgcccttggccattgacttcatgatgggccccaggcgccttggcctttgacttcatgatgggccccagcgcccttgg

SEQ ID NO: 41137 - DNA, 767 bp, Heterodera glycines
ttttttgcacttacgccgctggttgtggtgcagctgctgaacaatttgctgagcaactcaacttcctggttcacgttgaacaggcccatctgcaggaagggcaccacaaaagtggtggtgccgtcggccccgtccggcactaaatttgggaaaaaatacgacggcaaaaaataattgccggaccaccaattctctcactcggaaataaattcaaaatttagtgcgctttttgacgtaattttgctactaggcacaccaatttaaacatattttttatttataaaaaaacagaggccatccatctcccatcatctgtcccttgccactgctccgcctgccatttcccggtggagcaggacaaaacgtcgccgcaattttttttttttaattttagaaaaaaatctaaaaaaattgccaaaaatttagttagctaacttaatacgaaaaatttttttcaagttttttttcccggaaattcagcaaatttagtttttattaacattagattttcaaaaagctaaaattactttgaagtttcttgaaattttgaaaatgttttattttttttgcggctacgtttcggcggcgacgtttttggggtgtacccattttccggaccaaaattaaaaattttttttctatctaacaataagaaaaataaaattgtttgaaaaaaaagatttttgaaaacacgaaaaaatggggatcttctgttttttgttttaacatttttaagaatttttcgtcgtttttaatttttctttttc

SEQ ID NO: 41138 - DNA, 778 bp, Heterodera glycines
  misc_feature (25)..(25): n is a, c, g, or t
  misc_feature (28)..(28): n is a, c, g, or t
tcatgagtattcattaaaattgttnttntaatattacagattattgttgcatttatatttcattattaaaaagtttacttttacaattattagttgcgggactaatcactttgcaagataagtttttttattggtaatattttcaaattattatcttcgttaataataatcaatcacaaaagactcatattcgtttttaaatgacgtcatgtcatttcaatgttgtcttacgaatttgaattatattttccatgtaacaattaaataataaacattttcaatataatttattcaaattggttcttcgcttagatcaacttaattatctttttggctatgtaataaataccgtgcagctacattcacaatattcagcaaaaaacatttttgttgaacttctttgctttttaaacttatccaaaagatagcttttgttatcgattaatttaactttctaattttatttcacagacttttaaccttttttagttttttcaatatgatgaaattaatacttcttttttttaaatttcgtttaaaatcaaagaaaagaatggttatattccaaaatttaatcaattattacgtggtgagtcgttccacaaaaaagctcagtgattgattggttattttccggaagccgacagcaccattttcggggcaccaaaagtgcctgatccggaatccagacctgtccggttaagaatcattttttgttcagtttttgaagggctatctctcaggccgggtcagattcttgatccattcacttggagcc

SEQ ID NO: 41139 - DNA, 1536 bp, Heterodera glycines
  misc_feature (1484)..(1484): n is a, c, g, or t
ccgtaatttgatgtgtaaaaatatcgatctaaattttctaggttatttattttattaatatccatttcggtcaattcggggcccgccgaactctagttttctgagcttaaaagtgttggaatgaaatacataaatgaaccaaattataaagaaatttactattgaaactaattgtaatgcgagactaacgacaaataaaaggcaaagtttatcggtccatcaatcaaaggaaagtttttcatgattgctcgcatcccgcaatggaagcaccaaactcgacgtctgttcctttttggccgtacgcaaaattggagaggccggcaattgagtgcgaaaagatgaactgaaagagggcgaggcgaagattgtcctttcggggatcacttgcactccctaaaggggaggagggaatgcggggaaagagtggccaaatggtgaatgaatggccatactttgtcgaccattatcggactcttccgctcctttgtgtccgtcgtctgtttttgttcagcgtcaggcagctttttctctcctgaaaataccaaagtcaaatttagcacaaaaacatgttttttgatctgatatgatgttaacaacccattcgggccaattccgaagacccgagaaaactttttcccggaagggaaaatgttattgtttctaaaaattttcagttttttttagaaacttgaactatttaaataatagttctgatgaggagagtttttatcaatcaacggtaaaaaattaaattatagcaatgtaattcctcttttaagcaaggttgcactacttttttttttgtggatttttttttatggacattaacgtagtttcagacccctaaaccactgatagtattaccggaaatcctgaagaatggggcgtttattttttcttttgggtcgagaatggtatatgtatgtgggttagttttccgagatgcgaacaaatccctaacttgaacttgaacatcgaaaattcaattttttcgagtttttgatcgagttcgggttagggactaggaaatggtcagaatttatgttagatttgtatccagcaccccataaaactcccaatgtaccaattttcaaccaaaaaaaagatacattagaaacccccattctgcaggattgccgtgttacataccggcacctgtatcagctgctattgatgcctcatcctttcccgtgtcattgtttggtttctcatataattggaaggcattttcacgcatttcgttgacaaaagacacttcttcttgaccattatcaagctgaatttttccggaaaaatttaaaaaaatttaacgaacgaaccaataattggtaaaactgaagcacattggtcccttcggtcaaacgaacaatggcatattttggacagcgccggggattgttattgatatgaaccagtgatttgctgatgactgccctatttttgtggccactattgtttttgccgttatgcatttttaaaaagcnggtgattaatgatacagtttgtgttaaaaaagaatttaaaaaattataaaat

SEQ ID NO: 41140 - DNA, 875 bp, Heterodera glycines
tcttcattgccattgtcatcatccgtgtgacgggccgtcatttggtttgcatggaatcggctggaagtgccattcgggaaacttacctcgtaaatgacttcttggcattggctgacgattccagcgcgccatgattgctattgacggtgccgtgtgaaaactttgtcaccaagataaaattttcgcggtttcgcaccaaaacggcgattgaactgcttttccatcgcctcgtctctgatcaatggtgccaacggttttgctctcagcaaatccaatgttgttcgcggctttcgcaaaaggaagagttcggcagggctttgccgtcgggcaaagcgtcatttggcgttgtcctgtacgacgtcaaaaatgtgttcacaacattttgcgcgccctccttcttcagtttgcgacatgcccttttaaaggtgttgacaaagcgctccgcttgtccattcgacatcgaattgtatggcgctgagaagaaatggtttattccattttctttgacgaattccttaaattcgttggagctaaactgggttccattgtcggtgaccaaactttccggcagtccaaaacgagcgcaaagcgaacgtaattgttcaattagaaaagagcgaaaagagccttaaaaaataattaataaaaaaaacaaaatttttttatttttgaaaaaatgttttgatagttaaaagtttttttttttttttaatttttttttgaaaaatttctccaacaaaataaaaacctaaaaacaaagccatcgctcgcagttttctcaattatgcagccccgatttggtccccccaactggccgactcaaattggtccatccgcacggagatgccagaactccgcccttgcacaatccagga

SEQ ID NO: 41141 - DNA, 311 bp, Heterodera glycines
cgagaaaagggcgaatagcggagaaaaggcaagaccaactattgaggaagtgaagggaggaatagtctgttggatgagtttggagtgggcggaagaaaaacaatgggcggaagaagagagggagagagagagaaacagagagagagggagggagggagggagagggaggatgagagaatgggtgtacagaggagggaggaaatccgagagattttatccatttatgggataaatgagggaaaaacggaagctaaggatggaaaaaatggtgaaaggaaaaagggcaaagctggaggggggggggggtggaa

SEQ ID NO: 41142 - DNA, 1635 bp, Heterodera glycines
  misc_feature (74)..(74): n is a, c, g, or t
gtcaacacgggcccggaaaccattgcacaattcacccagagtaaacagcactcccccgatccgggtaccagacnccgaaaggctggcctcaagaccgagctcacgcagctactccgagcatctcagcgcactccgcctgcaaatgccccattcgccactgaacagaaggacagcaaaccccagtctggaggctagcagcccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcccgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaagaaaaagctggcggtgcccgagctgacactcattgagtcttaagccacgtgctaggccaagcacgggccctaccacgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccaacacagccgttaggtcgccccacgagcgtgcaccccacattggcgcagcgaaccaaccaagcgaggcagcccgccaccgacacattgccacgcagcagccatacacaggctttaacatgtgcagcactgagcggtataccacagctccaacgtatggaagcaccccaaaagcatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgat

SEQ ID NO: 41143 - DNA, 958 bp, Heterodera glycines
caatgataaattacaaatagtaaataaaaattcgcattttccaatgattaaattacaatagtaaaatacaaatgcgcatttttcaacttaatacgcattttaatcattaactacaactgaaaatacaaatgcgaattttccactgactaaattacaattgaaaatacaaatgcgcattttctaatgataaaattacaatagtaaaatacaaaatacgcattttccacttaatgcgaattttccaatgatgaaattacaatagtaaaatacaaaatacgcattttccacttaatgcgaattttccaatgatgaaattaccatggtaaaatacaaaattcgcattttccaatgattaaattacaatagtaaaataaaaaatactcattttccacttaatgcgaattttcaatcattaactacaactgaaaatacaaatgcgcattttctaatgataaaattacaatagtaaaatacaaaatacgcattttccacttaatgcgaattttccaatgatgaaattacaatagtaaaataaaaaatacgcgtttccacttaatgcgcattttcaatcattaacaacaactgaaaatacaaatgcgcattttctaatgattaaattacaatagtaaaatacaaaatgcgaattttccaatgataaaattacaatagtaaaatacaaaatacgcatttcaacttaatgcgaattttccaatgcttaaattacaattgaaaatacaaatgcgaattttccaatgataaaattacaatagtaaaataaaaaatacgcgtttccacttaatgcgcattttcaatcattaacaacaactgaaaatacaaatgcgcgttttctaatgattaaattacaatagtaaaatacaaaatgcgaattttccaatgataaaattacaatagtaaaataaaaattcgcattttccaatgattaaattacaatagtaaa

SEQ ID NO: 41144 - DNA, 177 bp, Heterodera glycines
ctgctgttgctggacgagccggccgccggcctgcgctacaaggaaaagcaggacctggcgcgcgtgctggaacagttgcgcgccgagggcatgagcattctgctggtggaacacgacatggattttgtgatgcgcctgaccaaccacctggtggtgatggatttcggcaccaagctg

SEQ ID NO: 41145 - DNA, 1014 bp, Heterodera glycines
  misc_feature (857)..(857): n is a, c, g, or t
gagaacaatgaccatttttattcccagggattttcaaaagcttattctacgccagaaaaatggctacctctttttctgagtaattttgtgttcaacaaatgctccaaaaagcgagccaagggccggagagcaatgaccattttaattcacagagaattttcaaatggctattctacgccagaaaatggctatctcttttctgagtaattttgtgttcaacaaatgctccaaaaagcgagtcaagggccggagagcaatgacccttttaattcacagagaattttcaaatggctattctacgccagaaaatggctatctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgtttaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttatttcacagagaattttcaaatggctattctacgccagaaaatggctatctctttttctgagtaattttgtgttcaacaaatgctccaaaaagcgagtcaagggccggagagcaatgaccattttaattcacagagaattttcaaatggctattctacgccagaaaaatggctatctctttttctgagtaattttgtgtttcacaaatgctcncaaaagcgagccaagggccggagagcaatgaccattttaattcacagagaattttcaaatggctattctacgccagaaaaatggctacctctttttctgagtaattttgtgtcaaacaatgctccaaaaagcgagtcaagggccggagagcaatgac

SEQ ID NO: 41146 - DNA, 1145 bp, Heterodera glycines
  misc_feature (52)..(52): n is a, c, g, or t
  misc_feature (114)..(114): n is a, c, g, or t
cgctgtaaagatggaaaattttacgattttaattgtattttgtaaatttttnacgaaattgcatttcgtttttgtatttcgtaattttcttttacgaattatatgaaattggtntaaaaaatagcaaaattcggcgttttttggacaaaatctgttaaaaaattgcactaaaattcaaaaaataggcgtcacaatgaaaaattttcaaaaaattttggtacaaagatagatttgctaaaccgatttttacacttaaaaacaaaagtctctaaaacattttttaattgcccaaaaaatgttttcctcctttttttttgcagatcaatatggcgaactttgccgcttttttcgtgccaaattttgtgtattcatccatcagttgtccgtctcggaatttcagcgcacattgccccgcttggtcactgcaattcgtcagaatggtcagtcgtaaaaaaaccaacaaaaaacgggaacagaacaaaatcatgccgctcaaaatctttaaaaaaaatctaaagaaaaaaaaagttgaaaatttttcagcgatttttttttgaatttaatgataacttaccaagtttttttccaaaattttccaaaatttttttattcttgaaattttcgtataaaaaaattttctaagatttttttcttgaaaaattctaagtttgaaaatttttaaaaaaaattctagcgacgtgatttcggcggcgtgattttggggtgcaccccaaaaaacgaccattttttaaaacgcaaaaaaaaatttttaataaaaaatattaaaatgttttaacagcaaatttttagtggaatttttttccaattttttttttgctgaatttatttatgcgtgattcccatttcaaacttcaaaaaaaaattacaagctttttcgaaaattcccccccccccaaccgaaattaaaattttactagaaaaaatgggcaattttttatttaatttttaagcgattttttgaaaattttcgaataatttcgtaattcaacataaatttttcaaaaattgcttacaaattttcacttgcccgtccttcgtaggtctttttttgcgcgctccgttggctgccgtggtggacaaggtgtccggtcagcccaacaaatggagcgtcgcgtacgccgctt

SEQ ID NO: 41147 - DNA, 1075 bp, Heterodera glycines
  misc_feature (47)..(47): n is a, c, g, or t
  misc_feature (101)..(101): n is a, c, g, or t
tttaaggcattcaccattcacaccagcagataaaaactaacgcgaancgctcacaacatttcattatgatttcgtttttttttgtattaaatgttttcttntgaggccttagaaacggatcaaaacctattctcctccaattttttgttgttgttttactgttactcattcattcataacaaacatttgaataagttgtttaaaggaatggactaattgcttacttttgttctgttgcgatattttgaatgtcataatgaccaattacggtgattaaatttcgaatggtcgcaattccaccctatcaaaaatcaatttgtcgttaatctatacattggggacgccatttgattgctatataaaatcgggttggatacctatttgtggtgggaattgaatttgggggaagatttggctttatgacaataaaagctacaaaaaattggttttctgttttgatcttaggtgaatttttttttcaaccttcgtaacagagaacttttgaggcaattgaatgggcaaaggttagtttactcgatttttctctgtgtttataagggagtttatgaaacaaaaacaacaacagcaattggtcatcgtctcacatgtacaaatttgggttttttctgcttcttcttgtcctctttctcatcgtcgtcaagagtcggtctgaagaaccaagggccgagaatgttcgtccaaagtttgtaaagtgtgaaaaagggaatggacagcagaacgaagaagaagccggtccaaatcagactcagaagctgtgcagacacactcagaatgacgatgtctttgcagtaccttaagggaccgcagttgtggcgaatgttaaagcttttttactctccaaacgcattcggatcgttgaggtccaacccagcatcgaccagctgattacgctcattccgctcggttttcatctgagaaaatgcaaaatttatgacaaagcatcattaaacttgtgcccaaaaatcggtaatccttcggaattggtgtcccgaccaaaaataaaattaaaaaaatttcttacccaaatcactttttctatgggaaaaaaaatgcg

SEQ ID NO: 41148 - DNA, 948 bp, Heterodera glycines
  misc_feature (942)..(942): n is a, c, g, or t
atcaaaaacatgacgcacattattgtgtcacactaaaatcacagaacagacactaatgttttagcaaaaacatgacgcacattattgtaatgtcgacattgttcaaattgtccgtctttttgtcttgccgccattgaattgtcgccacaatttggcatcgctccaacacaaaattaatatgtgtatatacatcataatcatcttctgccttcaatgtcagcttttctttagtccgttcgttcaccaattcaaactgcgcaattgtggtgtaagttttgaattggattatgtaactggcagaagagttggcacggagaaattcctaaaaaatgggaaacgaaaagtaaatggcatttgatccaaaattttacgaaaatattggcacacctttttgaaattgttgaaccattcattgctttctgacgtataatcacaacaactcaattgcttcggcggatgcccattttttgtcggagtgtgcaaccaattggtcaatgcttgacgagaagttgcatttggcccatcatcagcaatagacgcgggcaacaaattatcggagtcaattgaattcaattggttgcaatcggtgaaaattgtcggtgaaatttgacgacgcaaatcgcccaaatgatggccagtcaaatggcgaatgtttggcgcgaaaatgggccaaatttcaccagcaaaaaaattccaaattggctggaaaatgccgttgttgtcataatgcaaatcatccaaatccaaatataaatccatattggtgcctttctcaaaactttgccggttggaatgaagaaattcgatgacggaatggccaatgtatctgaaaaggaaatcatttagctgtatcatttaataattctttgatttactcgattcgaaggttgttaaagcggattttgatggcaacggattgctcttagtaaccacagatagaangttttg

SEQ ID NO: 41149 - DNA, 1341 bp, Heterodera glycines
  misc_feature (1307)..(1307): n is a, c, g, or t
  misc_feature (1326)..(1326): n is a, c, g, or t
aaaatgatagggccataattgttatataataaataaatcattgaattaatgaattacttatttaacatataatatattaatcctctgattttttaattgttttgtaagaaataatgaattagtttttaaatgattcataatcagaattttactcaattttaaaatttttttagtttaaaaattcaattgattactattttcttttttcaaatttgaaaaaaacattgataatttataactaatttttaacaaatatttgtaataaaaaacgcatttctaataaattaattattttatgtacttgtattgttttttttgataattcactgcaattttcgatagaaataatatagaataattagtttgattgaatttgttcatttatcttttcacaccataaattttcaaaaagtcaattttaaattctttacattttattctcatggctcaaagacgaattatttaacattgtattgtttattgcttgatatttcgatttaattaaatttaagtaaattttattaatttattttttaaatttaaatttcatttaaatttatataaaaataatttaattttaaatgcatgtttatatacatacttgatgaatatttcgtcctttttaaaattttctgttatataagcaaaattacttggagtttgattttttctattttttatttaattgcaattaataaaagataatttaataatttatttataattttatatttattcatttaatattgttcaacccatcccaaaagggccatttacttagggtgtaacataagtttccgcactaaattttttctgacaaattcaaaaattcataactccgtaatttctgcagttattttaataattctttttttattttgttctaaagaaagtcttcttttatttcatgccatcgtttcatttttttatttgcttgtcaatttttcagaattttttcccgaccatgccaaagttgaaaattggtccaataatttttctcgaattttttatgatcaatactaaacctgatataacaaagttttctgtaaattttagatcagtaaaatccgaatatgcctttaaacctgatctatattaaccctgagcttgtactactccaactcgatacacgaagttggagctgtattatattcttatagtcctaatttttctctatttactcttgttttctctacctctatatctcttttcattttctttaagtcagccatcaaaatacctagctcgaaaatgaccatttttacattatcaactctaaactccttaagacttttctaatgggattnatctcttgcctgataaatnagcaactcattctca

SEQ ID NO: 41150 - DNA, 792 bp, Heterodera glycines
  misc_feature (311)..(311): n is a, c, g, or t
  misc_feature (320)..(320): n is a, c, g, or t
ttccatttttgaattgtcttctcacttttcccgtccatttgtgtcctcatcttgcgccattcgctgtttttgcgcgtgccgttggctttggtaaatccgtgcaacttcccacgcttcgggcactccttgggcaaattgggcagcgacaacgacaaagacaaggaacagaaacgatactttggtggttgagaatggcatttgaaggcgcaaaagttgacgattgatagcaataacagattgcttaatggatgttcactttactcaaaataaaatgaaaaccacgcccgaaggcacaatttataagggggggnggggagaanggggggagggagggagaaccgcacaaaagcgcgattgctgatcgctttgcattgcgaaaagagaggagaggaagagtaaaggttgcatccaaatgcaaatttttatttacgttgaactatctggatggcttgatggatgcagaagaattagtctactatgaaagaagcagcacaacttgtgaatgggccaacgacccctaaccattcaaatagcaatcgattgggctgactatactccatatttgaaggaatagcaatggaaggtctatcttaaaagactgactagttatgtttcgacaagcatcctgtacaccatatatcgattagctaatgtaatcgaactatataaattcttcataaaatgattcatcttttttatggttagaagatatgtctctagctgtatacaaacggtcaccgagtctgcgaggaactacttatgagagagttgctatcgattattattttgcat

SEQ ID NO: 41151 - DNA, 1164 bp, Heterodera glycines
  misc_feature (55)..(56): n is a, c, g, or t
  misc_feature (61)..(61): n is a, c, g, or t
  misc_feature (63)..(63): n is a, c, g, or t
  misc_feature (66)..(67): n is a, c, g, or t
  misc_feature (79)..(81): n is a, c, g, or t
  misc_feature (85)..(85): n is a, c, g, or t
  misc_feature (94)..(94): n is a, c, g, or t
  misc_feature (98)..(98): n is a, c, g, or t
  misc_feature (101)..(101): n is a, c, g, or t
  misc_feature (103)..(103): n is a, c, g, or t
  misc_feature (105)..(105): n is a, c, g, or t
  misc_feature (115)..(115): n is a, c, g, or t
  misc_feature (119)..(120): n is a, c, g, or t
  misc_feature (130)..(130): n is a, c, g, or t
  misc_feature (136)..(139): n is a, c, g, or t
  misc_feature (152)..(152): n is a, c, g, or t
  misc_feature (159)..(159): n is a, c, g, or t
  misc_feature (168)..(168): n is a, c, g, or t
  misc_feature (172)..(172): n is a, c, g, or t
  misc_feature (200)..(200): n is a, c, g, or t
  misc_feature (203)..(203): n is a, c, g, or t
  misc_feature (206)..(206): n is a, c, g, or t
  misc_feature (215)..(215): n is a, c, g, or t
  misc_feature (222)..(222): n is a, c, g, or t
  misc_feature (229)..(229): n is a, c, g, or t
  misc_feature (310)..(310): n is a, c, g, or t
actaaaaataaaaacctacattttaccctctaccctaggtttcataccctctgtnnaggtngntgnntgacctttaatnnnatgnaatgaaaanaaanggntntnggaattatgngttnnatgatatatnatgaannnnattatctttatanaaatatntgaaaatgngagntgagttttttttggattattgtgttggnatnttngaaataaanggggaanaagttanggtatttattgaaatggaagtaaacttgaactgtccattcacctcatttctgtctacctgtgtaattcctcgtacgacccngatgttgtgcctttctgtcgttacatttggcatttcttgctcggcacttgctgaagtcggctcaaatgaccattttttcttttaaattgaatgattaaaaaatgaagacgataaaaaatccagataatttaattcaatttcacatattgatcaaaaccaatatcaaaatttagtaatccaattttaatctatttcgcccacttaattgtcttgacaagtcataaatgagattggatgtcgcgtttctgtgtcttttccctttcagatgatttttcccattgcgaaaattctgccataatattgcaaattccacaatgtttcatctgcttcaattgggcgtaatccggaagatcaaacaattcgctagcagccaggcaatggcatcaaaattgttgggttttccggcgaaatgtcattgataccaccgtccagataaaaagcgttcgagcgacgtcaattgcaaatggaacgacgtcctcatggaaatgcgaggaagtgttcaaagcgatcgagtagggtaccttaattgaattatatattttatttacaaactttcgcctctccccacgaacttctctgtatttttcccgcgaatgaattcggttgtaaaaccgtttcctttgtgtcttggcgatatcgtcgagtgtggagcttcaccaaatcgactcgtttccttcgaaatcttttgaccgaattccgagatgccattctttttcggtcgattgcgagagagggaaagaaacatctctttgagacccgaatgcgattggagtaatttccgaaatgagattcgagctgattttggtgcggtaagggaaattgaagaagagaatcggcgtaaaaaaccccaaacc

SEQ ID NO: 41152 - DNA, 1630 bp, Heterodera glycines
  misc_feature (14)..(14): n is a, c, g, or t
  misc_feature (964)..(964): n is a, c, g, or t
tgtttgcgattttntaagactttttcccattttctgctaaagctctaagatgcttagggaaaattttaagattctaatgtgatttttaacagattcagaccaaaatgttaaattttgaagaatttctaaaatatatttttaaatcataaaatttcttttctctttttggcaaaatcggctacgaaaatcacttaatattttttatatttttattcattcggtgatttttaaaaatctgttaaaaatttatttgatttaaaaaaaaaattaggaaaagacaattgaagaaattcaagaaaaaatccctgctgtgtgtgggggtcgagcctaataaaagcagtagtaatatcaccacagcaataaaatcatctcgtcaattcgctaatttttgtcccttaacccgccggggataggctgcgggggtccccgtttccggggatacgaaaaacggggtacggcgatgaaaatcccggggatcacctcggctctccccgttacgattttattttgacatttcgccaaaaattaattaataaaattgcaaataaaggaaaaatggaaaaatacagcctgaagcgttgatttcttattttttagtttttggaattttttggggctgggtgttttagttagggccttatctatagcctacataccattgttggcttttttggtgtctaaaagaatttacccaaattatgccgaatttttttttcgaaaaaatgaacaattgattgacggtttcatgaattaatttgcccagtggagcgccctcaaaaacacccacatattttttaagttacctttgcatgtgttttttgcagtttgtgctgtgatgagttgtcagtgagtgcgtttgtgtctttaattatctatcaaacgttattttgtttgtcttttcttctctgccataaacactcttttgaatgcgtccgtccgttagccaatcatcgcttgaatattntaaacgcgtgcgtatgcgtcctttccttttcttctctgccttaaacactcttgagaactcttttccgtccgtcagccaatcatcgtgaggcgtgcgtatgtgtctttttttctttacccaaaacactcttttgaacgcgtgcgtttgtgtcttttacttttcttctctgcccaacactcgtttttgtgcgtcgcacgcgtttcactccgtccgaatgcattttcaatggtacatattagggctgtattttccgagactcgagccgggaatttaccccgaaatgcgagaccgagaccccaaaaaacccgagaattttctcgaagctggagttacaaaatgttgtgatttacataaaaaaataaaattcctccaaatttgttaataaaacatttttgttttttttatgtcaaatgatttaatagttaatgaacgaactaaaattttaaaaattcataattttttaaaatcaaaagcaaattttatttacacacaatcaaaaaggtcaattttgctgtgtatgtttgccgtgattgcgattttcatccaattttttgatgaaaattaaggatttttatgcgcggtagagcgggggaaatttggaattttatgaatttattaaaaaatttgttcaaaattccaatagtttcggccttatttaaattgaat

SEQ ID NO: 41153 - DNA, 1211 bp, Heterodera glycines
  misc_feature (863)..(863): n is a, c, g, or t
  misc_feature (1068)..(1068): n is a, c, g, or t
  misc_feature (1093)..(1093): n is a, c, g, or t
atggtttccggaagtatttggagtctctgatcacaaaccccaccgacacttattttaattcgggtttggggttagaaattgttcaaaacagatgtccgatcaaaagggtccccaattttctggagaaaggtctcgaaaatgtatggcattttaagaataataaatgatcaaacaaatcaatgaccctatctattattatatagcatgttaacagagtttaatgcatttccaattgactagtcacagataatttttcagtttttcacaaaaaaactatcatgtaactcactggaaatacatatgttatagctaaaaataaacaccagattggtgaccaacaccaaaaattagcctaagaaaaattatttaaaaaaatcagggctgacaaaacctacaaatccattcaaaagatatgatttttaacttgcgccgtaattctgtttttttttcatcatttttcacgttattttttttacatttgctgttgttcaatttgattccttgcttcgcgtatctcttctagcagtttagcaatttcatgaattctcctgccataattttcgccaaattgtttaatgctttccaaatgaatttcaaattgctcattaaaaaatacggtccgatacaaaatgagttcatccttcatttggtaaaataaatttttgttgttgttgcgttgaaattccgaattttgtttaacaaaacattcaattacatcaagttttttgggcaaatcattgtcaaacaaatcttttcgcatccgtctgacatctgttaacgtagcctttcgtaggatttcggcattataacaaaactctgaaaaaacggaaaattgcaaaaattttcaaatttgtcagggttanagtggtataaaggaaaattatggagaatctataggaagtgcccgtagctcagtcggttagagcattccacaaaggcagtgggtgggttcgagtctgtgatgccagaaagaagcggagtgtgggagaaagtgagataaaggacatgggagaacctctaaaaggagcgcccgtagctcagttggttagagcacggcacggattgctngggtcgtgggttcgagtcccgccgngcaagttacccttttaggttctacaaaaaatagacggttcgccacttggctagtcaattcagtatacttcccatattaataaaaaagaaacattgaatttttctaaattttattttct

SEQ ID NO: 41154 - DNA, 1672 bp, Heterodera glycines
ttctctctctctctctctctctttctctctctatttccccaccggtctctctctctctctctatctctctctctctctctttctttctctctcactttagtcactcttgccttttgtttttgttgtcacaatacctccgcgtcaaagtgttgtccgttcactgtatgttcacttccgtccccattttgggaccaatgaaatgaaattgggccaacaaatatctgctgcttcccaagccaccgtcggtgatgaacggccgctctggccaagtgtcaaagccgtcaacagccactttgaaaattacttattattatttgcgaatgaatttatattttttaagtgaacgcatttatgttttatttatttttacttagcgcgtgttaaatttttgcttatttcttcaatttttgtatgaaaattacaaaaaagcggcgtctgtcggcactgccggacaaaatcttttttttttttaaattttttttttaaactccaaattgggtctatttctgtgttcttcacctttatgcccatcgttgtgcattttcactgtatgttgtttttcataatttacaaatcgaattggcggagttttgttttcatcaaactaaaaaattattacgtgaaataataagggaaatcattcatgaaaaattgaacaagtttcgtttttggtagtttaaaaaaagagaaattggcaatttttgtgctaaattttaaataaaaaaatcttcaaataaatatgaaattatgtacaagaaaaaatgttaggcaattttgttgaaaaatatcccttttggggaattttaacgtcaatgttaggaatgaattttatttttttttttgtaagcaatttttcaaaaagctaaatatgtataaccataaacattttaatgcagcattagcataaaattccaaactctgaaaaattaagcatgaaaaattttcttattttcagttattaattagttaattaaataattaaaattacccattctttccgaatatcaattggtgattgcctttgccccgtttggcactgccctccccaacgttcgaactcctcataactgaatgtctcctccccactcggcacgtgaattactgtttaattggaaaattggttttagtccacaaataataaaatttaaatttaatattttgattcgttattcaaccgggttatttgtttcagaaaaattctgtattcttttgaaatcaagaaatgcaaaacatatttacgaaatatttataatttaataaatattttttaaagaaattcagattattgatggttttgataaaaaagtgacaaaatgtgaattatttttttgaactaaattctttgacttgtttttgtgattttcctaaatttttcgtctttttgtgccaaatgctgattgtttaagtagtgttgagcgggaccgggaccgagcctgagattctcggtccccccctgtcccggttgggccaccggcggtagggaaaaataagcgctgatcaaaaattcactcattagacaaaaattttttaatttattttttggtcataaattgataaaaaaatagtcctttttttgcattatccgttaataaataactagggatgcaaattttaggtaaaacctaaaaattttagcgcatttaacacgcacagataagcatgaaaagagcat

SEQ ID NO: 41155 - DNA, 350 bp, Heterodera glycines
aactagggttcggaccccgtgggcgggggtggcttttcgcgggggcgggggatggcgggggtcagagtcgcgggggcggggatgggggcacgataattccgcccccgcggggccgggggtttgaattaattccaaaaaatttcacaaaaaattaatttttatgaatggtgtgttggctccacattcctttagtcaatgtttcgcctcgattcaattcctttggcataaattacacagattttgtctaaagaattaccaaatttagggatttttgcgaattttttaagaaaaaataggtttggagggccggcgtgccgataggggcgaattttaaatttatttctaacaga

SEQ ID NO: 41156 - DNA, 1003 bp, Heterodera glycines
aaatgcttgaccccaaattaattataaacaaacaaaccatatatattttttcagctacattgaccacttcgtcatctcatttcttcgttcaaataaacaaattttttgagtgcggcatcaaattgaaattgtatgtgaaaaatacatgtgaaacagaagaagaagatgctaatgtcctgcggatttgggatgttttgctccgacatgttttgcccatttttgtgtcaaatattcgccatttgaaatctgctggcatccaactctacactatgctgcacatttcgccgaccattctctctgatctcagcattaattcaatccattcatattggcctggtcggattaaaaatggtgcaaatcggccaaatttgactgctgaaggacatgcgttgttcgattggttgcacactccgccgaccgccgatggacagccgaagcgactccgtttcgaaatggacagtgcatcacaaacagaaacattgatcaacaagttcaaagaggtcagaaaatagtgaacttttgaaaaagagtcggaattctgggcctgaatcaggcgtgcagacccgtagacaaaaaatttggaagaaatttaaaaaaaaaatttttgtttttcttattttttgggccgaaaattccaagatttttatgatgttacctattttaaaaatttagaatcgggtgaaaagccggaatttgtttccgttgtcgccaaaaaatagtaaaaatttcaaaaattatggtaaaatttgggggtttggcggtgggatgcaccccaaaacgtcgccggaagatttgttagaccataaattcgtccggcgaccctggcaacagcctgaggctgggatagttttacataatcgaaattttatcaggatgttgtttcggtgtatattatggctgggattccggctggaattcgaaatttttccaaaaaaaaaagaaaaattcatttaattccccgacagctaaaaaagttttttgaatcccagtgaaacttgaagaa

SEQ ID NO: 41157 - DNA, 1799 bp, Heterodera glycines
  misc_feature (21)..(21): n is a, c, g, or t
  misc_feature (34)..(34): n is a, c, g, or t
  misc_feature (73)..(73): n is a, c, g, or t
  misc_feature (83)..(83): n is a, c, g, or t
  misc_feature (110)..(110): n is a, c, g, or t
  misc_feature (1687)..(1687): n is a, c, g, or t
  misc_feature (1772)..(1772): n is a, c, g, or t
atgatggcattttttccatcncaatttcatgggntaatggttgatatgtgcaggaagacggagaaaatgcacntaaacaatgnatcaaggaaaaattgtgaatcttagtntaaaaaaatcacaaaaacctaagtgatcagtgccaaaaattaatcagtttgataaatactgaataacctaagtgatcaaagccaaaaattgatcaatgaaaaatgcaattaaaaaatttgatcaaagaaaaattgtaaattagccaaaaaataataataaaaaactagtgatcaaagccaaaaattaaccatttttataagaattcttttgaaatgtaattgaccataatgaattttaaaatgttaatcaactgatattacacctctcagtggtgatgaaatattgtttcctgaatatgttgaagtttgtgaaagtgaacggggagaggccaccggaggcggtgggacaggaattcgtccagtcttcaaagtctaaacagaaatgtaaaacacccttaaatgtcgagaccagacaatcgagtgatgctaattatgccaatctcgagtttcagcgggattgtatgcttttgcgtgattaatcccgcgggatcccgtcccgcaaaaatttttttagctccaatcccgcagcggagtccgcaaacccaccccattgttagtgccgttgaactgcttgaatttgggctccggcacggcactcttccaaatgccttcccgcatttgaaataattgtccatgccgacgttccgctgctggctgaggtgccttacggtgctgttccaccgcctcgtccaccaattttttacagtcacgcaaccgttggtccatcccatcgtcagactcatgagtactgctcgacaaccccgtggacaaccaatccgaaacagtttgcccattactgtcacaaatgtcaagggcgccacctaaaaacgaggggagtatagccaaagctgggggaggctagcctctgccgaaaacgaattttagttaatccactcccttaccgtaatccaacagtatgcgaagtgctgagcactgtccctgacgtatggcaacatgaagcgcagtgccatcggggcccaaatagttcgggtcaaagccatgctccaacaaagcctcctgaaaattcattgtttttaaaattttcggtggcatctatcagtaggggcacagatgaactttaatttttcaataaattgtcaaaattaaatttgttttaccatgcaatcagtgtggccaagtctcgcagcagagtgaagcggatatggaggtgaatgtgattttgacacaggtgttgttgttgttgttagagtggaggaacaacagtccgaggcacactgaattttatttgatttcgaattaaatgcataaatttaatttaaaaaacaatggttacctaattttgtaatttatttaattaaaaaatggattaaaacattttttttgcatttttcaaaaaagtaatttttaattcataaactcgtgtttaaatgcactcttctatgtccaattttcataacccaattttctcaccatcaaattcagttcgggacaattgagcatcaaaagtctgcaaaggttggctttgtcagttcggacggcgatgtccaacgcggtttccatccgggcatttcgcagtcgggcatcggcatggtgctgaatttacggaaaatttttanaaatttttgaaaattttttccaaccctgagcagcaggcgggcagcatttgcgtgaccattaagtgtggccaaatgcaacgcactntctcgtgcattgttaacggcattctga

SEQ ID NO: 41158 - DNA, 1362 bp, Heterodera glycines
  misc_feature (700)..(700): n is a, c, g, or t
ttttttgaaatgtatttctctactatattttttttattatactgtatgtgttgtgttgccaaccagtcaggatatatgtatagcagggatggcattccgaattttcggaaaattccagacctaaattttttgaaaattggaattccgaccccgaaaatgtcggaaaccggaattccgtgccaccctggtatatatgtaggccccaatttaaatacttttgaaaggcatgccacggcattttcaaattcaaaaaaaagttggctaaactccacatggtttacataatctatcatctctacatactatatatatatatattgtctacgcttgcttttctttgcttcttgttctctcttcattaatgcgggtaaaatcccaattatttttgtgtaccccattttggctcgcccattaataacccacacaccactaaattgctaaattaatttctttgtaacccaattttaaacacaatgtcgggcggcattctgatgtcgagcattttttgaaacaattaattcaaaattgaattaatttgttttctgtctgttaatatttagtctcgacaacagaaagggcttttttgggctaattaccgaaaatccaagagaaaaaaaacaagtttgtaatttgattgttttggggtgctcgtgaatcaaaattttcagtaaaaagagacgagaccaagagaatgtgcccnccgaaactctcgagcagccctagcaatttaattaagcacccaacctatctgttatcaatcccgacactgaaattgtcccctttaaaagttgccataggtcatcatttccaccactcaatttttgttgtttttgaatgaatgtgtaaaacgcgttatattatatcccgtcctcacgtggaacctctgaattgcccaccattctattaatgtatccccgtgatttgttgtgtgtgagcaaattttttttttttgaattttcacattgtttttaaatttaaaataatttctcatacagtatataaaattataaagaaaagggtaaagaaagtttaaattcggtataaaaaatgttgtgcgcaaatttggccgaactaaaaactcagtaatgaagtttagacgacaaattataaatatttattttaatatttgatatgattaagtttctattaaaagcgattttttttgtttatcgtacttattgaattagaacccccccccccttcgagggggggttgaaaaatagaaccccccgggtgtattaattcagtaaatacggtatctggacaaaatctccgaagggggtcagcccaaaatgatagaaaatatatgtataagatatgaatgataattacgacgcccatgatctagatcccccggggttt

SEQ ID NO: 41159 - DNA, 1026 bp, Heterodera glycines
cccccccccccctcagagatttgcattatttgtcccatcattctctccccctctcccccctctctctcttttctctttttcctctgactcactttgtgccccttccaatcgctcatcagccgtgaaaacaaccattcacaattccctcgaagggattatcatcgccccactcatttctcgattgatctgtcgaaggattagtgagcgaaacgaaatggagcaatttgggaggagagggggggggagagatcatgacaagaaaagggggggggggttctgataatgggtaaacgaaagaaatgggggaaaggggcgaacggaaggactttttgaacgcaaatttggcaaaacaaacgaacggtcgtcggtacttttcgcttaacggactccccaaattaaaagtaaaacaatttttaacatttaatgaatggaatgcttcaagttcaaagtaagactaaaacactgatttgtaaaacattaataaaaaataaacaaataaatgaatgaatcctcccataattttgtcccattaaaaaaggataaaacagtcaaaagagcgacccttgcaaaattaattttaatcaattttttttttgtttcttttcacaattttgggtcactttgttttggccgtttctctaatcttcactttcctttgacttttgccattgattgaattggcagtttccatgaacataaataatcacttattataataggaaatgaatgttaagggaatcggattatgaccgcgcagaagaaaaatttggtgggggcatcgatcggcaaaacaaaagcgaggccataagcggataaacacggacataatccgcttacgggggcagaggtgattggtggtggtggcagtgggcgggaggtaaattggggaaaggtaaggacgaaaagaaacaaaataatggacagggaaaaggaagagagggacagaatgccaaccgaaagaaaaattcaaaattgggcattttaaacggacagaagaagaaagtgcacttggggggggggggggaa

SEQ ID NO: 41160 - DNA, 1027 bp, Heterodera glycines
  misc_feature (27)..(27): n is a, c, g, or t
tcaatttatcaaaaacagaacaaattntcgaccacataaattaaattttaacacatgttagctaatttacaaattattggcattttgttcaaccatatcaattcaagttttaatacataatttaattgtaatactttttgtcaatctttttcaattgaatccaaatttgaatttcaggcattttttctttctttttcaaattattggcactccgtttaattacatcaatttcaattttgctttcacataaattgttcttaacgcattttcagccaattgctttcaaatttattcaaatcaatgccattctgatcatttaatataaatccctaacatcattaattacataaaatctgtaacaaattttcaatcaaatttcttttttcttttcttcctctccttcaaattactggcattcggttcaatttgttcaaattttaattctaatcatacattttaattatacaatttgcctaaccttttaactcaaagtgaacaaaataatttatgcaatgcctaatttgattttagcatgattgcaacaaaatattcaaagtcaatgacattttgattcaacttttccaaaacacaaaattttgagcaaataaattcaaattaatgcattttcaaccaaaaatattcaaattattggcattttataacattttcgccaatctctcaaacaaaaactgtacagaaataatttatgacatgcctaaatgattttagcacatttttctgcaatacaattcaaacaatgttattttgattcgtcttttccaaaacgacgaaattttgagctcctaaattcaaactaacacattttcgtccaaaatacttaaatttttcaaaaactgttagttaatttggttcaaatttcttactaattcaaaaaacgtttcatcaatttcatttcaaattttcgtcatatttaaaaacaattcgtcagtacattcacattttcgaacatattaaaaaaaacatgcattaagtcgatcacttcttcatacaaatgcgaacactattt

SEQ ID NO: 41161 - DNA, 1249 bp, Heterodera glycines
  misc_feature (13)..(13): n is a, c, g, or t
  misc_feature (27)..(28): n is a, c, g, or t
  misc_feature (70)..(70): n is a, c, g, or t
  misc_feature (98)..(98): n is a, c, g, or t
ggaccccgacatntggggactgacatnntaaggtcaaacagacttttggagacctgacatttggggattntaatgaaaaataaaagtgttgaaatatntaagtattcagccgaaattcgacaaaattgcatctgctttgcccacacagtcccaaaaaacgagagatgaacgaataaatagagagcgcagagaaaaatgcataaaacgttttaatttttagaaaacagttaaaaataatcgtatcgtggagtggactcgaacctccaccctttttgccccactgatgaattacacaagccaattttttcgatacggagcccattttccggacgctgtatgccagagttataaagaagagatgtacttttctctacactctctatttattggttcatctgtcattttttgggtctgtgtgggcaaaagcggacgtaatttgtcgaattttgggcttaattcttaaatatttcaatattttttcattgaatccccaattttcgcgccacttaaaaaaagagtgcaccacggcgctaattggattcgagtctaacctattgagctactttatgcgccatgggggtggagagagtataccaaaaatgagaatggcatgaattcaaaaataggatgccattcgttgaaggattttgctcaaaataacaattttaggatttctaagccgtttttaaatctttcttttatataaaaaatatttaaacaaattttcgacaccttagacattacggcgctagttaaaaagttgtcctttttgaaaattttttaaaaaagtcatgaaaatacatttccgggggctttcggggccgctgatcacgaatatgacattcatttcgaccaatttcgaaccccggacccggattcgaacaaaaagtcgaaaatcgtaaattttcaccaaaatttacacattcatgcaattttaatgtgtattttattagatttaacaagattaatcattaaaattataattaaaatgcaacaaaacattccttcgcatttgttcgtattaacattgaattcagtcccgtttggaagcgtgatgatttttgagaaaccaccaccagttgttttttgtgacgaattagacattttcagatatgcgggccattcgtcactgatgatcaccgtgcctggaagaaccaattgaagcagaagacgaatagaattcatggcaccagcctaaaaatgacataatcatatatgcatgaactaattttccgattgaatgctaggg

SEQ ID NO: 41162 - DNA, 1203 bp, Heterodera glycines
  misc_feature (63)..(63): n is a, c, g, or t
aatccgtcagtggacaattcgtcatcaaatttttttgcgcaatgatcaaaaatcttgcgaaantgattgttaaatttagactgcagcgggaccgggagttttgggcttgaccgggaccttttcgggttgaaaaaccgggaatttttggctgggaaattcgggaaaaaaccgggactagtcccggtcccggtcaaaaccgtgacctcggtactcagttgtccgtgtttaggtaccgcccggtcttgctgcactcttttttaagtgcaaaagtggtgggtgtctgcaaaaaattttcaccgggtttaaaaaatctaggaaaattagtaagcatttgtagtgttccgatacgtatctctgcaaaatttggtgagcccctgatcaattccaaattatttatggacgatcaaattttttgaaatttttttaagtgcaaaagtggtgggtgtctgcaaaaaattttcaccgggtttaaaaaatctaggaaaattagtaagcatttgtagtgttccgatacgtatctctgcaaaatttggtgagcccctgatcaattccaaattatttatggacgatcaaattttttgaaatttttttaagtgcaaaagtggtgggtgtctgcaaaaaattttcaccgggtttaaaaaatctaggaaaattagtaagcatttgtagtgttccgatacgtatctctgcaaaatttggtgagcccctgatcaattccaaattatttatggacgatcaaattttttgaaatttttttaagtgcaaaagtggtgggtgtctgcaaaaaattttcaccgggtttaaaaaatctaggaaaattagtaagcatattgtacgtgttgttgataatgtatatgtgcaaaatcctggtgagacctatagatcacattacataatctatctatcagtcggagcaaattttttcatatatctgtgagggcaaaagtggtgggtgttgtcaaacaagaaatttatggtggtatcatctacatatactactaagcattcgtaatgtttggatactgttctacatgatttagggcgagccagggttgaaagaccacattatcagtgcaagatatgttcatttcaatcttcattatagcagatagtggagaatgtggacaaaaagtgaagatagggcataacaaagttgacgccggactcctttctcttaaaggtctttagaaaaagagcgccgcg

SEQ ID NO: 41163 - DNA, 1167 bp, Heterodera glycines
  misc_feature (1130)..(1130): n is a, c, g, or t
tgttttaaattatttataatcaatgataattagattcccccagtcgttcctaagattaaagcttgaaggtaataaaatttaatttataaatatatagataattcattcattagattaattacctatctacattggcatgtccagcaaaacgcccaaaattgcggattgtgctggtcatttgctaaaaaaaataaataattttatttgtttttttaatcttgttttatatttgggtatgttcacttcaaaattgagagatttcctgtccattattttcggtctcgacttttactgcatcattgtttattgatatattctagattcactcatcaataaattttctggtttccatgtttagtaaatcttatggcatttcgggattttctctgggttcccgctcgcctttttccattttgtcatttcattatccaaaattccgatttattaattttcattttatatttaaaatgattaattccagaaattaccgctgctgtctcatttatatttaaataatttatgtagccgagttcggtgaggagttttttgatgttttgctggtcaacatttgagccacatgagggcgtatcccctagtttttgagcgatttgggtacctaaaaatgcaaaataaacaaacaattaactaatgaatgttttaatttttgtttaattatttataaagaaattttttttaatgtttgtgataataatttaaatattttttattttgtataaggctgtactcgaagccgttccaaattcggcggaagtgcaaccatgcttctcagggcaaccacctttctgtcccataatccatctctcacatcgatctccattgcttgaaactcatggcgagactcaaatcttgcattctgtataaaagaaaagaaaaatatgatttaattataattatatttttaagaataatttaaatattgaataaaaaatttaaataagcaaattttatttttagttttattttaaaaaatttctcaacattttgcgtaaaatatttaattataaatattatttacttcggtaaatatttaaatatttttgttatctgtttttcacataccgcatctctgccatgtgcaaatgcgtgctgatgacatgaacgattgtggnccaatgaaagagatatcagtaaatttatcaatgaatc

SEQ ID NO: 41164 - DNA, 1323 bp, Heterodera glycines
aatgcttgaatatatgataaataatgttcatttgcaattctcactaccactatcagaaaaatataactgtacttttcgcttcataagactagcatttctggttacgaattcgcgcatttttggctttcccggattctgctctataccacaatttccacataagtaagtattccttgtaattagaggttaatcacgaaattatatgttagatcgactctttcatcaaaaccatggtgaagagaaagacatttttaaactttctcaggtagacagctaaaaaccattttattttttacaataatgcataaatgtcacaatgtattcgactcaatttcaacatgtaggaataggatgctacaagaattcctaaatattttaattcctaaaaaatgctagaatatatgataaataatgtttgaattgcaattctcactaacactatcagaaaaatataactgtacttttcgcttcataagactagcatttctggttacgaattcgcgcatttttggctttcccggattctgctctataccacaatttccacataagtattccttgtaatcaaatattgagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaaaattacatttggatgcaacctttatttttcctcgcctctcttttcgaaaagaaaagctattagcaagcgtatttggaccaattctaaaacaaatcggagtaattaatttaatctgactttataagataaatgggaatttaagcgaaggattcatgcagaataataatctatagaaattctcaaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatattgagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaaaattacatttggatgcaacctttatttttcctcgcctctcttttcgaaagaaaagctattagcaagcgtatttggaccaattctaaa

SEQ ID NO: 41165 - DNA, 867 bp, Heterodera glycines
  misc_feature (16)..(16): n is a, c, g, or t
tgaagacttcaaaaancgtttatttcttcggatgtcttcccaaaaagtcagttgctcgtcgagcaattgacttgtgcccacattctgatgagaactacccacgtgtagtagaaattcccttgaaaatagcgacaaaattataatgtattaattagctaataaaattaaaataataaatttaattattacaaacactgatatttttgtcacttcgtcctaggcacaggagagttgttgtcgctcctaatatgcgacagtaaccaagagaccgtccttagtaattaagtctagaggaaccctttctttattaaatttgaacaccaataaagttattggtctttcttcatcgccccgaggctatgataattgtgccctatatatttgagttggtgcaatatcgttataaaaactagagaccggaccgggccgggcccggtaccgggttttcccgggcccggcaacccggcccggcgatttttggagaaatccgggttgaccgggttaaccgggttgaccgggttttgagaggccgggcccggaacccggtcgtttttgaaaatgtaacccggcccggaacccggcatttttgaccgggttttaccgggttatgatataaacaaaatttgttctttttcctacgaaaatctctttggcataatgtttataaatgtttgtttgtcaattttctggttaaaatttccattcggagaattctactttatagaaatgataatttcggtctttttctttttaattttagagaatgagtcttatttggcaaattggcctatttaaaaaaacgtcaaagactacagcaatttgtcttgaatgtcaagcaaatggaaagcttaaatataaataccagct

SEQ ID NO: 41166 - DNA, 1041 bp, Heterodera glycines
aagagacaaattccaaaaacgaattttaggagaagcatttgaagaagaaaaaacaaagcaatgcgtaaaagaaaaagaaagcataaaaggaaacaaaaaaagaaaagaatggactaattaatgggaaaaacggaaggacctcgtgggttttaatgataccctcaattaagaacaattaactgattaattaattattgatgaaggaaaatggaaagctacgccggaaagaaaaccaaatgatttagggattggggaaaatctcaccgaattcgcgcactttcggcatgaaaaaatggatgatggatctgtcccattcagttgttaataaattgcgttcggtgagaaatgaaaccataaaattaattttgaatttgcgtcactcattatttgggattaaaaatgtttggcgatccgtccgtcctcgtctctgcccactttagctgttgcgtctgcttttggttgttatttttgtccatgtcactctcgcgcccctcgccgccctctctttgcgccattgtcttttcactttcttcgcttccctttctttttccactatttttctgctgtccttttccgtttttcagtggcataaatcgcccgtgctgatcgcgtttcgcattgtgtacagtgagcgacaacagatggtgctgatcatcgctttcgagcgcatttggtgagtggtttctgtgtaccgtaaacatttcaattttgttactgtcagtttcactcattttccattctgatcagtttcccttgctggtgtaacacgcctccctttttgctttaaatatcaatgtttcagcttaccccgtcgatgggctgtacgtgtccgacccctggtagcccgagtcgcgtgtggtcttcctcgacaaattgttcggtaaaaacgtgccgttttcgcccggcactgtgccctcctccccctcctccatgccgtcctggtcttcttccgcctcacttcgctctgtgccaaattcgatttcgtccaaatcgctctcaacaaaggaatattgatcaattgggttcactgccagcgaatat

SEQ ID NO: 41167 - DNA, 1209 bp, Heterodera glycines
atgcttaaattttttaaataaacaacagatttttatacatcaagttgttcttttttctttttgaatgatttcttgaaaaagccgggtattctagtctggacccggtcgggtcaaacccatgtaaccctaaataaagttaatgatttttcatattattttctgatagttttttgaagtggaaacttttttctatatataattctgatgataaatatatattctccgtatcaaatataatgcatcgcaatttttcgtgaatttgaacactttccgtgaattaccaagcacagattctttaaaaaaacattaaaataaattcgaaaatataaaagaaaataaataatgaattttttctgtaaatggccccaaattcggcactatctacaattttttagaaaccacttaaaaaattgaaaaaatttgtacgcatatttttttacaatcaaaaattctaatcacaccgaagatgatcagatctttccttcatgaagatcaatatctccaaaatgcgctgaaaccgggaagtttttagggaaaaaaacattcggtccgcatcacgtttcacggaaaattttaacagccaattttttagcctcaatagaatttttttatgaaatctacattttaagccatttaaggaatattgcatttaccatgaaggaatggtctgattttttcgcccgttttaacagctattaaaaatcgaaaaatcgttacaaaggaacatttcgaactgaaactgctcagatcactttaaaaccacttctatcgtgtagagtatagtcgaataattcaccatcagtcgggcggatccgaacccaaggcaaaattgccccaaatttgctgtaacaaaattatacgttcaaaactttgaacacatgtgaatatttttatagggcaaaaaaacctgaaaaaattcatgtaagaataatttttattcaattaaaattccattgcaccactgtaatcagatcactccttcagggtgatcaggattgagcagaatttcagtccctcaggaaattttgatcctctaaaacatttttctagcatagtaaactgcagccaattaacatgaacatcattcatagacatcttacataatttttgtttataaaaagacccaataaatctaacaacatccattacattgaaatttttagtgatcaaaaaccgcaaatgctggggtgaggtggcgaaaaaaattcc

SEQ ID NO: 41168 - DNA, 1201 bp, Heterodera glycines
attcaaggtccatttaatttagaaacttaggcaaatacctttttttatacaggcttattaaatcaaatttcaaaaaaaaaccggtccaggcctaggctctagacccacgttgctggatagacggctgtaatcaagaaaattcaaaatgatgtttttttttctcagaacgttttgccaacaaaaacaaaaattggcacatacaaaaataacataaaaaataatgataaaaaagttaaagttaaaaaaaattaacaacaatttttacttgttttatttatttttgtttaatctttatgtttttgaaattttattttccacttaaaagaaaaaaatcaaaatttttttttaccttttcaacttttttaaagaataaaaaaatacatctgccttttttatatagctttgccctgtaattctcttcttactctcaagtgttgtgtccattttatcaccatattttgaaattccaaaaattgttgctctgttgatttttaattgccaaaaatttggcttcattagtatgcgcttgcatatggttgcaattgcatttaatcgagctcatgcagtgcttttcccattcaattttgcgcaaaaagtcacaaaaaggttaacaaattattaatataattaattttttaaccgaacttattttttctttgtgtttttgatttaaaaaaataaattaatttaaattaattttattaagatttcaacggctctcaattcccgagtcgagaaatttctcgggctttttgggtctcagttctcgtaccgtttctcggggtcatttcccggttctcaattttccgtaaaaaaaaattagcttctcgcagattcccaataaatctcaaacccagtgggttttacaaatttgccctcttcgagtattttttttatccaaaaattcataatatttgtttctaaaaatcagccagcttatattcatgtcatcgggggcaattataatccaattaataattcctttggtatggttcgaagaaagcaaatgataaatctatttgaacttgcaaaactgataaaattttcattccaaaaaaatttgggccgaaaattttccgactttttggtacctatcattagaaaaacttcaaaattttggactatttgaaaatgttttttattagtataaatatttaagcatttatacttatttgcgatttttaagcacctaaaaatggaa

SEQ ID NO: 41169 - DNA, 974 bp, Heterodera glycines
ttcatctccctttttgatagaaaaagtatcagagtgcctatactaacatgtaaataaaatttggtgcgtttcagagcattttctggaaaaaatatttatgaattaattatgcaaaaaataaacaaataatgaactctcttccttaataattttcctgcaccgaaggtactcactcggccgcttcgcggcctcgtggtgggccttccccccccccctcccacgcccttcagaacacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatattaaagcatcagagtgctaaaattaagttgtaaataaaatttggtgcgctttagagcactttctgaaaaaaatatttatgaaacaaaaaaatcgattttttcaagtgtccatttggggtactcaaacatttatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatgggggagcaaaaatccaacgcagaaataaagtacaggctatagggaagctattccccgaaggattcggtctccccataaatctgggcgcatcgcgttcggggggactgccccg

SEQ ID NO: 41170 - DNA, 1718 bp, Heterodera glycines
ctttctccagacggacactttgctatattttgcagaaccgttgaccaccttttccgacgtgcaacaaaagtattgggctccggtcattcaatttgtcaaccatcgcttcggtctttccctgtgccccgtggagagtgccgtcgctcaaccggaattgaccccggacaccttgcaaaacatggaacgacatctgctggggctgcaaaacacttttccgtcactgattggcattttatatgggattgaatcggtcaaaagtctgctgattatgctggccactttggaacactattttgatgtggacacagcggtcagactgagccgacttgaacaaatccaccagacgaaagtgtggggtaacgtggaatgggcgcacgatgttgaacataatgaacagtgtgtacgattggcagcttctgtgctgttcagccgatgcttttcttcttcgtcatcttttgcaaacgcatgaatcccttctgtttcggcatgctcttctgacaatgagtgcccacttttgaattttaaaaattcgcacattttaaaattgattttcgaatcattccgttaataagtcttttatttttggtactttcgtgcgacattcattgtcagttggtccctcatccttttgtttcctttaatagttttgctcataaaaggaaaaacgtacacttttattttcatagaaattgttcgaaatggcaatttggaatatttctctttcctggttactttttccgtcgattgtgagtctgtcattgtctctctgtttgatgcatgacgacggttacatccgttgcaaattgatccacagggccgagaggggcttgaactcgtaagttttcagatacagaatatgctttcacagttatcaaaatacaataccttatgttttaattattcatttttcctaattattagagtcaccggcttataccgaatttggctcccggcgatgtgattcaaattcgttctgcgctttcccacgattatgtggcgttccaatacacgtcggaatgtgctaatgaaagtcgtttcaaagaccgttcaatcgtcgtttgttcaaaggcattcgagaatcggaaagcacagtttccgactcgatacgatgttttggtgcgtcgggttgagaaaaaggatgtgagtttacaaatcgctaatgaattactttacattagcttcaaatagagtttaggttgccttggacaacattgagttgactttcaaggtactctacaaggtttcgccgattttggcttttgccttctatttggatgtcctttaggagtattacatttctcgtgctgacatgtggcgttttcgcaactgtttgatcgattcgtgtgtttacgtggggaagaaggaagaatggctcggcattctttgtactgtcagtgatttgtggcgcgccggtgaaagtgtgagttttcgcttcgtctcatatttggccagttttattaacttgatattcatgaatttggtaattcttgtttcatttccaaggtttggagtggctatgtgtccgaggaaaccaggcgagttcttggagcagttcgttccatcctctccctccggaaaattttttaaaaaattgctttgctgttaaaatttggtaaatggtcgcactttccctgaagagtcgtctttcgctcctcgagttcccaagtgctcattttcaacgaatttggcgaagagatgtgggacattgaccctaaggg

SEQ ID NO: 41171 - DNA, 995 bp, Heterodera glycines
aaaaagactttacaaaataatacccctgggagaagggagtggaaaacatgatttcaaaattttcaattttttctagtctaatctactcaaaccggttcagaattcaataaaaataacattcacggtgcgaaaaatggggtttgaaaagtttattttgaaaaaagactttacaaaataatacccctgggagaagggagtgggaaacatgatttcaaaattttcaatgttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaagactttacaaaataatacccctgggagaagggagtgggaaacatgatttcaaaattttcaatgttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaacttaacatgcacggtgcgaaaaatggggtttgacaagtttattgtagaaagaaagactttacaaaataatacccctgggagaagggag

SEQ ID NO: 41172 - DNA, 170 bp, Heterodera glycines
acctcttctaatcaaaaaaacgggcgcgaagcgcccgtccaaggccaacaaaaattgaaaaaccgggcgaagcgcccgactgaggccgcgaagcggcctaacaagctaaaaaacaggcgcgaagcgcccgtatgagttcaacggatttaaaaaacgggcgcgaaacgccc

SEQ ID NO: 41173 - DNA, 478 bp, Heterodera glycines
aaaaatgaaaaaacacgtcacgttcactccgagtctctgagacgatgtccattccaccaatgtatcgtcggtagcggagtctgagttcagcgttaaagagtgtgctgaagtgccagaaatattcaagtccggcaaaacgagaaatttggttagattctgattttgtttctttgcaggaaattggccgacgatgcctttcaaatattgcctttgcccgacatcgacccgagcgtcacttcgactccggcggtcgtcaacaatttgatcgaggtttggcacttaagttcttggcacttactttcccgtctcttttaggcggtcgagtcgctcgactcgcggatgcctttggcgttccaagagcagcagcaaatcctgaaaatgcagagcgaaatgctgcaactcggcgtcagttgcaaggaacactacaagaagatacatgagcagtccgtgatgcgttacaatctcgaggtgaccggac

SEQ ID NO: 41174 - DNA, 1481 bp, Heterodera glycines
tgatcagcggcccaaataaccactaatgacatgtttcctcccagagtttttggtgaaaaaaattttccactcaaaaatcctcttcacccccctttggtcccgaatccaaaatcacttttatttttgtatctttttttaaaaatgtgataaaaatgccaaataaaatttatttggtagagcaaaaaattgcggatttttgtagtatgttatttttccaaaatgacttttcagaagggagttaagaatttttttctgaaaattcggatttttccagaaattctggaataactttttttcatttgaagatagaaattccaaataaatcccataaaattctcccgatttttttgctatttttaaagctttaattcacttaaattgaccagtcctccattgagttatgaattttcgaatattcgaccaaatttccaaggaccaaaaaaattaaaaatattttggaatttttaaaaaattccaaaaattctgaaacgtaaaacaaacatcatattcgtgctcagcacctcaaaataccccagaaaaatatttttgaccccctttttcaacccaaaaaaaatttttgaaaatttctagggggcctagctcgaaaaattttgaaaattttcgaacatgtagtacaccattcgatagcatttaaaaagctctacaattttgccctaaggagttttttcgataaaaccaacccctgacgagttatgggcccgggactcaaatgtcccgctgaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaatgtcaaaaaatcgagctttcaaatctctacaataagttcgctgaccaccccccgctcagatcaaaccctggcgcggtattcacctggtactgaagtgtactttttgagcacgcttcagttgccattttttgcaggccaggggtttgctcaaaaaaaattttaaaaaataccagcatttagaggacactttggcggagtgccctcacagcgggcactttttgattcgagttttacaaaaaaagttaggggccttcaaatgcaaacaaaagtgacaaatcagtccccggtactcagttggcgctcggatcaaaaaacctatagttttcccggattctcctcaaaaagttgtaagacccttccactactttcagacccgtcccattagccgttaagctcaaattagtttttgaaacgaaactccttgtcaatataacgtatatagtaactagcgggtgcgtgaaccgtcggctatttagctgggaaaaagcgcttcgcgctttgggagcttcgctacctaggctgtgaagcgattcaaat

SEQ ID NO: 41175 - DNA, 924 bp, Heterodera glycines
  misc_feature (799)..(799): n is a, c, g, or t
  misc_feature (916)..(916): n is a, c, g, or t
ctgaaagtcacgattaaatccctaccgtgaattggtccttctttttgtcttttgttgtagcgctgaataaagcactaatagtgtgtttgaaaacgcacgaaaaatagttcttgacaaaaaatggctatctctgaaagtcactattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgtgaattggtcaccaacttttgtcttttgttgtagcgctgaataaagcactaatagtgtgtttgaaaacgcacgaaaaatagttcttgacaaaaaatggctatctctgaaagtcactattaaatccctaccgggaattggacaccaacttttgtcttctgttgtagcgtgaataaagcactaatagtgtgtttgaaaacgcacgaaaaatagttattgaaaaaatggctatctctgaaagtcacgattaaatccctaccgggaattagacaccaacttttgtcttctgttgtagcgctgaataaagcactaatagtgtgtttgaaaacgcacgaaaaatagttattgacaaaaaatggctatctctgaaagtcacgattanatccctaccgggaattggacacaacttttgtcttctgttgtagcgctgaataaagcactaatagtgtgtttgaaaacgcacgaaaaatagttattgacaaaaaatggctatctctgnaagtcact

SEQ ID NO: 41176 - DNA, 616 bp, Heterodera glycines
  misc_feature (590)..(590): n is a, c, g, or t
agggcgcttctcacccgttttttaatattgttgggaacattcggccgcttagcagcctcaggacgggcgcttcgcgcccgtttttaattttttgggggacattcggccgcttcgcggcctcaagacgggcgctttgcgcccgtcttttaattttgttgaggacactgggccgcttcgcggcctcaggacgggcgcttcgcgcccgttttttaattttgtggggaacattcggccgcttcgcggcctcaggacgggcgcttcgcgcccgtttttaattttgttgggaacattcggccgcttcgcggcctcaggacgggcgcttcgcgcccgttttttaattttgtggggaacattcggccgcttcgcggcctcaggacgggcgcttcgcgcccgttttttaggggtacaacagtgattagaagaggtgcaacagtgattcattaaattaaaatgaaaatttttttaacaaatttaattaagaaaatacatgaaatactatcaattaaaaaaataattaatttaaacttttaaaatttattcatcaaaaaaaaattaatttgaatataattttttatttattaactcaacanaaatattttaatttaattaaaatcat

SEQ ID NO: 41177 - DNA, 1416 bp, Heterodera glycines
  misc_feature (1119)..(1119): n is a, c, g, or t
tttgcacttacaaccgaaatttcatagacaatttcctgttcagttaaaacggaaaccgacggcggacgaacggcactttgccatctacggtttttcggaggaggcaattggctaattgctgcttgggaagagaaaacttgtacaaaaaaatctttttattacaataagacaacggcggaaatggcggagaaagtgactcatcgggcaaattcggtcgtaattgaacgggcgcaatttgttgtcgaaacggagaatttggaggagtaactgaagcagaaatgacttttgaagttcaaaagtgagttaacatttggtagcaattggcggtgcttcttggaatggcaattggtcgtattgttctgcttttacgggaagtgccattagtttgggggcttcgtccggcatttggagctggtgaagcgccgatgggtcaaactgccgtgggaactcattgggtagagtggctgatggactgccaaatgggcgagggaatcggtccgaatctgccggaaatgccttaaaagtgccaattaattggtcgttgaatcatgccgatgcacaattcgctctttgggtcccagaattgttggcgtggacagtgctgccgggtgtgacttggacattatcggcgtcgcctcctcctcttcgactacgtcatcaaaggtcaccggcacagaacgagcccgaagtacaaagtcctcgatcataatggcaccttcgtcgccctccaatccgaatgggtcgacgagtttcttcttccaaatgatcacgtcgacgaactcagcaagtaaactctttattttccccccttcggtggtctgcacggagtaatacccatcttggtagtcgccaaagtcctgcaaaagtcgccgaaaggcgacgcggtactgaaacagacagaaacagacaaacagacaatgttaaaagtggtcggaccggcggtccatctccgaatttgctccattggccaaagttttctgactaccttaatagcgcaaagtgggaacggttttggcacaaccaaccttagtcttcttgtccacactcatcacacagtctttgttgacgccgaaaagtctcgggatcagtccttaaccgatcgggggtttttggcacccngcccatttcccccgccctccccctgttaattaattatcgcatttgacccctttccttactgttcccctgcggttccttcacttcgaaaaatatcattccgtaagtcggcaaattcctgcaaatgtcacagtattttcgcttggccgcaaatgcatccgcaaatgagaagttacggtactgctgaagaaggaaaaaaacattgagcagaagcaaacggacggcggagggatggcacggccgacaagcgaaaattgccattcctctgacctcaattatgtttttctcgtgctcccgcga

SEQ ID NO: 41178 - DNA, 1936 bp, Heterodera glycines
  misc_feature (1311)..(1313): n is a, c, g, or t
tttttttttaaatttttttttaaattttttaaatgcgcaaaatttttcattaaaaatttttcgccaaaaaaaatattttttaatttgacagaaatatgtattacatttatgtttaatgcaatttttgatttttatgggaataaattaaaataaatattttgataaagaaataaaatttgataatgaattgctcacaaaaagcaaaaataaaaattacaaaatgaatttacacataggggattcgaacttttgacccaaaaaaaattttgactaacaaattacctctacactaacaatttctttgaagaaaggaaatagttgttccttttctttaattataaaaaactaaaaactttggcacgtcataactcggcactcgtgctcatttggcagaaaataaaaccatttttcttaagaacccattggtgctctatccacctaaccaagtttcattttgaaatcccacaggacacttggagccctctccctctttttttttacagacacgtaaaagagtgatgaagaagctgatgataacgatgcaaattgaatgatttatctaatttaattttactttcgatgtttctttggaattttataaatatttcttttcttttttaggctaaatttcattataattataaatatagtttaaagacaaatcaatttagaatataatatttaatgtatttcgttgtcgaaagatctgttttaggttagtaggcaagatgttgagtaggcgaaatgtccagtaggaaaccgtccgattttgggttaataggcgaaattaaaaaatccaaaatattaaaaaaatcgtcaaaacaattttattagcataaatttggattaatatggtgattggaaaaaacattaataaggattaaaaatgaaaatagaacaatatcaggtgaaattccatttttgcaaagtaatcataaaaatcaaagtgattatagaaacttaattgagttattatttttaattgaattataataaaacatgatttacatttttatttagccagtaattggttattttctttttaaaatatgggactttttttgaatataaaaatatataatattcgattctttgtttaggttttttaattcattgttgtgtagtccaaattacggactgaattatgccgtcaataggtaccacttcataatatggatgcaattataactaaatatatatttgcctataattgcatgatgtattaaaggatatattaaaatttaagctataaataaattatattaaattttatttatgaaattgcatacatataaaaattaaatatcctgnnntaaagttgagtattcatattaattttcaagcttccaggctgcgaaggatttatttttagatttttttcttcttggactatcaagtatctaaaatcaaaattttgtcaaggaaagaaaagacatcaaaaatagggattctaaggtcggataggggcgttaaaacgaagaatttccgaacaataattttttccgtgcatttctcgtcgagttaaagccgcaaaaaaaaaataaataaaaccctaagaaacctcgccatattattaataaataaaattttaatattatgtataattatttactaaattctttatttatttttgataagaacacaaagtattaaatgttattttaaaatgaatagttttttaagcttttataacattaattcttttttatatttttggtattacgtgttttaaaacaccaggaaatttttcttttaatttattttttaaattttttttggctcttttccttggtttaatataattatataattccgctggtgtgaagtttttataaatacgtcagtccctatgaaattgttttttcgggttcaccatgttgacatgcgcttgtcattcgcccatttgacgaaacgcaaaaagactctagaggtcccc

SEQ ID NO: 41179 - DNA, 1277 bp, Heterodera glycines
  misc_feature (67)..(67): n is a, c, g, or t
  misc_feature (980)..(981): n is a, c, g, or t
  misc_feature (983)..(984): n is a, c, g, or t
  misc_feature (995)..(995): n is a, c, g, or t
  misc_feature (1001)..(1001): n is a, c, g, or t
  misc_feature (1003)..(1003): n is a, c, g, or t
  misc_feature (1008)..(1009): n is a, c, g, or t
  misc_feature (1013)..(1013): n is a, c, g, or t
  misc_feature (1015)..(1016): n is a, c, g, or t
  misc_feature (1020)..(1022): n is a, c, g, or t
  misc_feature (1024)..(1024): n is a, c, g, or t
  misc_feature (1026)..(1027): n is a, c, g, or t
  misc_feature (1037)..(1037): n is a, c, g, or t
  misc_feature (1043)..(1043): n is a, c, g, or t
  misc_feature (1048)..(1048): n is a, c, g, or t
  misc_feature (1054)..(1054): n is a, c, g, or t
  misc_feature (1074)..(1074): n is a, c, g, or t
  misc_feature (1105)..(1105): n is a, c, g, or t
  misc_feature (1111)..(1111): n is a, c, g, or t
  misc_feature (1115)..(1115): n is a, c, g, or t
  misc_feature (1122)..(1122): n is a, c, g, or t
  misc_feature (1127)..(1127): n is a, c, g, or t
  misc_feature (1131)..(1131): n is a, c, g, or t
  misc_feature (1133)..(1133): n is a, c, g, or t
  misc_feature (1138)..(1140): n is a, c, g, or t
  misc_feature (1146)..(1146): n is a, c, g, or t
  misc_feature (1148)..(1148): n is a, c, g, or t
  misc_feature (1155)..(1155): n is a, c, g, or t
  misc_feature (1167)..(1167): n is a, c, g, or t
  misc_feature (1173)..(1174): n is a, c, g, or t
  misc_feature (1176)..(1176): n is a, c, g, or t
  misc_feature (1180)..(1180): n is a, c, g, or t
  misc_feature (1182)..(1182): n is a, c, g, or t
  misc_feature (1186)..(1186): n is a, c, g, or t
  misc_feature (1193)..(1194): n is a, c, g, or t
  misc_feature (1202)..(1202): n is a, c, g, or t
  misc_feature (1209)..(1209): n is a, c, g, or t
  misc_feature (1230)..(1230): n is a, c, g, or t
  misc_feature (1240)..(1240): n is a, c, g, or t
  misc_feature (1251)..(1251): n is a, c, g, or t
  misc_feature (1266)..(1266): n is a, c, g, or t
  misc_feature (1273)..(1273): n is a, c, g, or t
caaagcaatgaaagatgcgatgcgtaaataataagatttaatgaaaaaaataaattttctttttttntaatgtagtttaaacattattttgtttttttacaagtcggaaatgctgctacataaataattatcatttaaggccatttccgctatattttattataaaaaaaaattgattaattcatttacgtatgttgtatttcatcaatattaaaaattgtaaaaaaaaattattttattttcttaatatttttaattcgtttaaatttaagttaaaaatatgcaaagcttcaaaattattttgtattttacatttcttttcattaaaattgttttcgcaaatgcttctcctcatgactttgttgaagtttcctcttctgataagggttacataattaaaattctatataaataatattttttattttattttttcaatttaagagagtgttgttatgccaagcattgatgacatggaagttttaattgagcatgcaaaattttgggcacacaaaattggcttgataattcataccaaactttttgacaagtattatagattattcttcattaaaaaaaaaattatttttgaatattatttcaaattgttttaataattaataaggattaaaaattaagcaaaaaaaagtttcaaaataagcagataaatcgaaaaaaaaattaattaaaaaaactaacgggaagatttgaattattcaatttttaatgcaaaaataaatcagaaattatctttttaaataatacaataataatgcacaatatttttaaaattgcctaaattttttcttttcatttactcgggggtagacagaacaatatgttcttcaaattttccaattttttgatgaaaattggaaaattttgatttacttggggagtagaaagagttaataactgaaatttctgggccaaatagcgataattaataataaattaataaaatattttagaaaagatgnngnnaaatttttgtnatttanantgttnntgtnannaatnnngngnngaatttttangaaagnggttnatttanaaaaagtaattaaaaatttnaaaaaaataaataatttaaaaaaaataaaanttaggnattnaatgggntgtantttngngtttnnnaagaananaaatttntgattgaaaagntgaaanngnttgngnattnaaatggnngtgttcgngtttggnttaatattttggaggaagttnaatctgagtngattgttcggnagtcgattacattgnttttggnccga

SEQ ID NO: 41180 - DNA, 867 bp, Heterodera glycines
tcgtaaaagtcgaaaaaaacaaaaatttttctaaaaccttcctggcttagaaaattcatttaaaaacaattttatccgacttgaaaacaagtaatatattcaaaaacaaaaacaaaatgagcaaaaaattttttttaatttattttcagttagaaccccccaaaaattctcgttaatttttgatggcgccaatctatggcgcagtggtatgcgcaagattttcatgtgcgtcgaccggcggttcgactcccatcagaagggcacaaaaaaagtccaccaatttaaaaagcaaaattcgtcaattgaacataagcgaccaccacaccagcagcagcaagcaagcaaataagcaggaaggaaaatcatttgccaccgccgccgccggaaaagcgatgcttctcatttccctgtgccctccgggggcgaagggactcgacccccgcccccgggggcaaaccccgagcctcccgccccacccccggcttcttctctcgggggagtccaatttcaatgcttttgccacccgccccgcctccgtcgtgtcccatgccctcgggcgatttaaacaaagtccaaaaaattttttaagagagaaaattgtgtgtgagagagaagcggatttgtgaagggggggggtggaacagcagaagtaaaaaggaaaatttttgaattttttggaagggtgagaattttctttgtaaatttcgaaggaatagaaaaattttggaaattaaaatttcgggaaatttcggagcagaaactctgtatataaaagctaaaagtaaatcaaaaatttaaaatatcccaagaaacgaattcggatatcagaaaaacataaactaattttttcgaaatgacacgaaattt

SEQ ID NO: 41181 - DNA, 959 bp, Heterodera glycines
gggattctagggcttaacgatgtcaaacgtaaaatcttttcacgtattcatgatcagcggcccaaattacccctaatgacatgtttttggaagatttttgtgaaaaaattttttcaatcaaaaatcctgtccaccccctttggacccgaatcacaaaatcacttttatttttatatctttttttaaaaatgtgataaaaatttaaaataaaatttatattatagagaaaaaaattgcggatttttgtagtattttacttttctcaaatagcttttcagaaggcagttacgaattttttactgaaaaatctaaaatttccagaatttctggaataacttttttcatattgatgttagaaaacctaaataaatcccataaaattctcctgatttttctctatttttaaagctttatttgctcaaaattggtcaacccttttgctagatatgaattttccaatattagcccaaatttccaaggaccaaaaaattgccaaaaaataaagaatttttaaaatattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaaatttcccttcatatagtacaccattcgatagcatttaaaatgctctacaaaaatgttctaaggcaatttttggctaaaaccgatccctgacgagttataggcccgggactcaaatgtcccgctcaggccaaaaattttttctatttccgggaaaaaatcgaaatttttccaaaaaaattaccaatcgatagagctcgaaaaactatgttttggaagtggtcttcgtttctctgggaaaaatcgttaaaaaatcctaaaattcaaaaacccgaaaaccgatttttaggcctaactcg

SEQ ID NO: 41182 - DNA, 1046 bp, Heterodera glycines
ttcaacgccgcatggattggatttttgttccgacatgccggggcactggattcagatgtccgcggccaaggacaatctgatcaacttcagatcagacgaattgactttaaaattgagcggcgacaacgggcagagctttacgaaattgaccatctcattgccccatgcggcgcatgcaaattccccggccaacaatttcatttgtggtaacagattttcttaaaaaaaaagaaagacaatcattgattgtatcgggtgagcagcaagggaaccgcccacttcggcgcggtcatttcggtgcggccacttcggctcgggtttttcggcgcgaggttttttcggcgcgggctttttcggcgcgggctttttcggcgcggccatttcggcgcccctgataaaatgacttttcggcgccctaattagaattcttacaaaaagtgatccgcgtttccaaatttatcttttcgataattttcaaaattaatttgtcgctaacaatacagattcagatgtttaaacaattttccctttattaaggatgacagaaattgcaactattagacaaaaggaaaagatgatgaacgatggattcctctacattttcgacaaatttaatgtagacatcagcatgaaattctggcgatgcgaatacaaggacgaatgtcgagggcgaatacacaccgatttgaacaacaattttgttaaaatagtcactgaacacacacacgaagcgaacattgccaacgtgaaagcaaaaaaaatcgtcacggggatcaagaggcgtgcggcggagtgcatggaattgccttcacaactccgcgcaaatgcaatggtcaacgtttcaacaccggtgcttgctcagttgccaagtgccaatggaattaagaaggtaacgaaaagcagacacatactattattttttgctttgtttttcaagcgcggtgaaggacctgaggaggagcaatatctactatctgactctggcgttttttcacttaatgccgacaattcccaacatcggtattaattaatgtgacatattttta

SEQ ID NO: 41183 - DNA, 1433 bp, Heterodera glycines
  misc_feature (1100)..(1100): n is a, c, g, or t
aggaccgaccacttgaaaattttcaaggttagaacccgcctttccaagacgttttgacaaaagaatttaaattagtctttaagaattgacaaaaaatgaaaaaagccgaaaaatcgaattttctgtaagaaaaactctcttttttaatgctttttagtccccttaattggaattttccgcccctaaataaaaaaccgttttgaatgtaaatgcctaaatgccataattataatttttattcccaccgatgctgcggggtcaaagcaaaatctgacgccgctgggcttgagtttgccgacaaatccaagtaattcgaatatccgtacaacgattgttgctccctttcgctggcatttcttcgggaatttcgtctcgaatttgtcttgtcaacccatgccgcgagcatttgcctcatatttgtcactgttggacttgcgctgggcgacatattctgccatctcaacaaccctttcttcttgtccggaatgggtactgaatttataagctaatgagtctgagttttgagggtggacaaattttatgattaatacctattttacagaaaggcataaaaatgcaaaattttccctttggcggtgactatcacaagaatttttttgaaaaaagcgggcccccaaaaatgtacaaaaagaaagtatcaatattttttaaaatttttaaaccaattttgaggtaaaaaacaatgctatatttggacattattttttttttcaattgaaaataaatttaaaaaaagctttgcctttaatttaaaaaagcataaaaatagaatttaaaacaatcaaattataataaacccacaattgattaccgatttgtccgttttgtacatccttcccgttgccatttcgtcgtgaattttgtctcaaatctgttccttcactaaatgctttgagcttacgcctcatctgtgccacatctgtgcctgcgctgggtgacggcgtttgctcccattttggcaacagtttcttgtcatgttctacgatttggccatcatttggaataccaatcgccaaaatggcactacaacacaatgccaatggaagaagaaaattgaataatggcattttcttaattanaattgattcactgataattatgaattgtatgtcttcgtgattgccgcggcatatttatatttgtgaaggagatacttaatggacagttatatgtctacaagaatcggaaaaaataaattagggtaatctttggtaatacaaaacaggaaaaataaataaaagtctaattttaaatgaataataaaatgaatttttcgggaatttaatgggccttgcatatgaataaatatgaaaaaataaatgatttttttctcataatattcaatgacggaaaaagaattatttaaaataaaaaaaaattatggttgaagttttgcattgaaatttgaaaag

SEQ ID NO: 41184 - DNA, 1103 bp, Heterodera glycines
tttaaatcggaaaaaatccataaaaaatacataaaccctaaaatatccaaataaaagtcccgatttttatacgccaaccttaaaaaagaaaagtgttttcctactatttaaaccatggagaagccaggaaaaaaaaaagccatttgccatgttttttgcagccctgtttattttcaatataaattttggaaaaataataaaaaataaaagtgtccatcagcaacactgaactttttggcgccattcagctgcagaacctttaaaattttgacgacggtccaatttgaaaaatccgctgatccccgtcgattgcaacggtcggttcgaactgcgcggatgggcagggctcgagttgggtcacaaacgatgggtctgtttttaaaaaaagcataaattattttgaaaataagaatgcgacaggaatttttgaaaaagccgggcatagaagtgccgaaaaccaaaaaagtcggcattggcactccgatttttaaacataccctcaatttgctgtcgatattccatgttgtagcggagaatttccatcagactctggtcctgtcgatggcaagtcaagttcggaggagtgggcatataaacgcacttaatcgtctgtccaattggcaccatacagtcgggctcggcggcacaaagcaaagccatgcaattttaatttattttgtttagttgggttgagattttaaccaaataattcttataaaaaatgaagcttatgctatgataagactgcatacttttctattttgtcccccccccccccctccctggatatgaagccgtgttgggacatttcctaaattccgccaatttgtgcaataaataataaattagtccatatttatttactacacatcatatgcctgatggcggatttagggaaggtactagcaccttatgaagaagctacagcattttacgccaaaatgtcttttattgagtgaaaaaatttgatggttcgatttggttaggacattcaaacattacggagtcggaatcataattgtattgcatttctcagcagttcaaattacccctaaaaatctaaatgaaaaaaatccaaggcttgtgacaaaacagaaaagtac

SEQ ID NO: 41185 - DNA, 1012 bp, Heterodera glycines
  misc_feature (22)..(22): n is a, c, g, or t
aaaatgactatctattttcacntattttatacgataatctaaaaatggaatatgccaaagccccatatatccacatgattagacttagctcgattttttaggctatgatgtctaaatttgactcttaattttctgttagcctcaaaaaatgactatctatttttcaactatttttatacgacaaatcgaatatggaatatgccaaagaccctatatccacatgattagacttagctcgattttttcggctacgatgtctaaatttgactcttaattttctgttatcctcaaaaaatgacaatctatttttctactatttttatacgacaaatcgaaaatggaatatgccaaagccccatatatccacatgattagacttagctcgattttttaggatacgatgtctaaatttgactctcaattttctgttagcctcaaaaaatgactatctatttttcaactatttttatacgacaaatcgaaaatggaatatgccaaagcccatatatccacatgattagacttagctcgattttttcggctatgatgtctaaatttgactctcaattttctgttagcctcaaaaaatgactatctatttttcaactatttttaatacgacaaatcgaatatggaatatgccaaagccccatatatccacatgattagacttagctcgattttttcggatacgatgtctaaatttgactctcaattttctgttagcctcaaaaaatgactatctatttttcaactattttaatatgataaatctaaaatggaatatgccaaagcccatatatccacatgattggacttagctcgattttttcggctatgatgtctaaatttgactctcaattttctgttggcctcaaaaaatgactatctatttttcaactatttttatatgataaatctaaaatggaatatgccaaagcccatatatccacatgattggacttagctcgattttttcggatacgatgtctaaatttgactcttaattttc

SEQ ID NO: 41186 - DNA, 1020 bp, Heterodera glycines
tttttccgttttgttgaatccattatcaaatgcttttttttatcagagcattaataaatttcgatttatcatttatataactaaaatatttttaatgattaaaataatattaatttatttatagattctgcacgcgaattaacaccatttttttcaataaaccaccttttcattatccattttctattaagatcacatgaacttcactatttccttaatttttatcgcgtaaatcttataaaagatttaaataatattaattttttaagattctacaccgcgtctgaaaccttcaaatctgtaagtaaaatattttccaaaaagtgctaatttttccgttttgttgaatccattatcaaatgctttttttatcagagcattaataaatttcgatttatcatttatataactaaaatatttttaatgattaaaataatattaatttatttatagattctgcacgcgaattaacaccatttttttcaataaaccacattttcattatccattttctattaagatcacatgaacttcactatttccttaatttttatcgcgtaaatcttataaaagatttaaataatattaatttttaaagattctacaccgcgtctgaaaccttcaaatctgtaagtaaaatattttccacaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttcaataaaccacattttcattatccattttctatcaagatcacatgaactttactatttccttaatttgtatcgcgtaaatcttataaaagatttaaataatattaattttttaagattctacaccgcgtctgaaactttcaaatctgtaagtaaaatattttccaaaaagtgctaatttttccgtttctgttgaatccattatcaaa

SEQ ID NO: 41187 - DNA, 1539 bp, Heterodera glycines
  misc_feature (50)..(50): n is a, c, g, or t
  misc_feature (102)..(102): n is a, c, g, or t
aaaacgggaggcaacgccggagattgggatatatattttttagaatcacnaatgaaatgtgggtatgcatgcccagttaattgcttaattatctatcttttntaaaggtttgccgtccgctgattcgatcaatcgtcgcacttttcgcgcactttttttcattatcactgtgaatgtcggcggttattggttcactactattatgttcttgcttttacttcccataatttcttctccaatcacgccattggttttgccatgtaattatctcaattcctatgaaccattggcgcagcgtcaatcggaccaattttatattttacaaggtctaaaatttattttaaaaatatttaacatttatttgcaattttagtacggattatcggcaggcattccaagcggaatttcccattcgttttcagacgaatttcaaatgtaactcaagttattccactgcagaatacacaatcatgagaatttctttgaaaaattaaatgaaatttaaatcttactgatattaatagccactttttaaaagtttgaaatgacatcagtttgtctaattgttgtcaataagtattaaaattacaactaattaatgaatttacatataactcttttgttgaaattatgaaaatttcactgaaaaatttttaaataatttttctttgtccatcattaatttatagataaaaggtaaatttataaattcgaaaataaaggaattaccgataaattttttaaatcctaaataaataaatttaacatttaatgaaaaccttgctaagaaaaagaaaatgttgttaaaatatgttgccaagcatttactgacggacggaacaatttatcgcaggcattttattattgacaaaatgtggcacgataatttctttaatgaactaaaaattattgcttactataattgtttgaacaatggggaatatgcgctcgacagactccgcgcattttaattgtcagaattcgtcccgaaaagtacacttacgtaaagggctttcaaataacttgacaaattgattagggtttttactttttaatttaagtttttgtttttgtgaattccaagaaaattaattaattgaatataaattccttcattttatttttaattaacttcttggtcaaatcatttgcattgggaattagtatgtaattaaagaaaatttagaattattcctgattaacctgaaaatcaattaatctttagcttttttaccatacaaattctatatgaccaataaattaaaattaattaattgtgaaataaatttggatttttatcatcaaaaaaagccgcagaaaaatggtattttttcataaattggagtatattttcgaaacgtcaaatacctactgagtaaaatttagatttttccaatgcttcgtcaattgcttcggtagcaggagtgccaagtgtcaactcattggcacaaaattcccaaaatcaaccagcagggtaattaaaaaaagaatcttttttttaatattaaattcattaacaatccattaattaggcaagag

SEQ ID NO: 41188 - DNA, 1235 bp, Heterodera glycines
  misc_feature (1196)..(1196): n is a, c, g, or t
tttatctgcattaataatgaaaatgtaaatgcttttatataagctgagactcattaatccactcccgattgggatatcctataaatttaacaagcatctcggttgatccatcatctcttttcctctttctgaacaccttctcgatacggtagcttgtctctgcatcctttcttacgcgcgccagctcctgctcatagaagctttctttgaatttctcgccatgctcatccagtagtttgtaccgaattgggtgcaccgcttccagcacctcatcaatctccagtatttcatccccgtaattttgtaaatatcccttctctaattgccctttatctctgctcatgcgtacaaatttatctttatggaagcggggagtttttctgtcaaatgattgcggtcggtacattcgcttctacacctgagcatttgaaatattggacgcatcccgtgaacacgcgagggcgagctgttaattccgtccacaattttctgtactgtatccacccaattcagtgtctccttttccgcaaaatacctatacaatctctgcttcacattccggattgctcgctccgcaattgatgctttaactgtcgaatggacgggttcgtgcttctcaatttcccgctcctcaaaaaaatccttgagcaatctgttcttgaactcggtgcccttgtcggagaaaactcggtggggcgccatgggcatttgatcgatgagttgcttgaatgcctccaacatctcctcggctctcttgtttctcagcggtacaacaaacagacgtttggataggacatcaaccgcaacgacaggtaccgatgaccccgattgtggcgcgaaagagcttgaaaatctgccaaatccacttgaacatcggtcatgaatcccgctgcaatagttttggctcttgaaagcgtaccctgcggggacgcatcagagtgtaggtgcggtgcccatccaaataatgttgcacgtcctttttccgtaaatgcttaatcttttttcgcgcctctttccacagtgcgctaacacccgcgaacgctgctggggaagatggattattgtacaatttgtcaagagtggtgtttatcagctccatttttcgggcgaaattccttcttgattgcccgtgccgtccgggtggttttgctctgtgatggtctctttggtggagctgtccatgaatacaaaattgngtcctgtctaagtctctcctccaataggtccgctcctgg

SEQ ID NO: 41189 - DNA, 1765 bp, Heterodera glycines
  misc_feature (919)..(919): n is a, c, g, or t
tgctcattttcaaggacgtccttgcatataaggacattttttattttcaagaaagagggcccatttcaaaaggacgtccttgccattcaaggacggataccatccctgtgttaatccgttattatcatttaactttatatttattaattagcatattatcaataaataattaaaatttataataattccatgaaactattcattgagacttttctaagaaagttaaatttagttattttttgaaagaattacaataataaaacatttcatacatgaaaattgtatcagcaaataacttgactgatttgcagccattgatagattttgttgaattttagtggtgattaaattttaaaaataaaatgaacattaaatgattaaattgctaaatattattaaaaatattttttaaaaattaattcttcctttttaatattataatctcgagtggcctatttaattattccaaagggattagccaccggtatacacttagctcacatttttttaatgtttttatttttttgatgtcattttttatgtcttagttttgctattttctaaattttttcaatatttctttttgaaaaaaataaattatcaaaataaatgcatattaaagtgagccacttttgttgcaaaatttgttttcaaataaacaaatttacaacatataggttcttttatattaatttattactattttaaagaaaataagaaaatccttcttttttaatatatcaatttatttcagattgtagaaaattttattcgtataatcgcagtttattttcatatatttaatttctagattataaagtttataaaaaatataacttttttctaatgcatctaaagcttagcatttgctataaaacatcttcataaaatggaattattcaaaatttaaatcattacnaaaaatagttttaaataggtagcaagtacaacaaattggttttatgttcaattttccaggcttttttatttatgcttagaattatattttttcgaattgtatttgacattcagtgattaaagcttataaagtttttttaataaaaaaaactattatttttaattttgcggtgtgcagctctaatatatttttcgcgctttataaatttaaattctattttttcaaatacgaatttaagttctattttcttgacttttcttttttataaatttcaattgtttaataaattgaatatttttattttatttatcgttttatataaataacatgaatacatcgctcctcttttttaaaattgtcaaattaattttttaggctttaataatcttttcagagaaatataattttacacttaatttttaacatttatttttcaaaagattttaattatcagatgttgatttcattctgatcaaaataaattattaatttaattttagttttagtttttttcgtatgaatttattttaaatgaattattacatttcaaattttcatgttgttcaattatagggagcaattaatcccatcatcagtttaaatgccatagttaaaatattattttaatatttatcataattgttcaaattgctgtttaaattttcagtttattttttttatttttaggttaataattaattaggtcttaaattagtacaatttttattacatatttttattagttcagcagttttttaatttaattataaaattaattttttttaatatttttatttataaatttagaaaatttttactatagatacattaattttctacatttag

SEQ ID NO: 41190 - DNA, 1472 bp, Heterodera glycines
gaaaaaagtgatctttgcgtgcctcaactcgttttgtgttgctgtttgaacttctgccacgtcgattcaattgtatttgtatgttgaccagtgacgggatccttgaattccattaatctaaaaacaattcagacaaaaaaaattgaaaaaatttgaacaaaaattgtggatacaaacgcaaggagtaccaaaaattctttattataacgtcaattcttcactatgaatcattattttggacttttctaaataactatggttaaataagtcacttttgaaacgaaatcctagacaagattctggatttttcaaataactaaatattttatgtttttttgtgatgaaaaagacaaaatttatgaaatcgtctaataaatggaccattgataaactttttttctgattgaacatttcctaaggcatgatagcaatgattaactgcttcacaataaacaaagtattgcatatgatgaaaacaattatattttttaattaatagggtccgatttttccaaggtaacaattgggaaaatcaaacattaaaatacaaaataatctgggtaaaattgcacatcatttatttatttgaatattcgataaatacaaagataattaagtgacaaatttgtcacaaataattaaatatgaaaattaaaatttttgaatcatcaaagaattgaaaaatcgaatttgaaattgggcccaaagttcgcctcgattctatcatcaaagctgaacaatgaaataaatggaaccaacggaagatcaaaaacagaagaggaagaagaagacgacgaagcaggaggaggaggaggaacgaacaatttggaagaagctaaaaaaagaaaaaaaaggaaaattaaaaaaaacattaatttaaatagtcattcagtcgtagcaaatgttaagaatcgcaataattcatacaaattgagaaatacagaattaaaaatttcaaaactatataaaatgttgtaatatgtctaattttatgtactttatatattcttaagcaaactaaatgtaaaatgctcgaaacactccttgaaaattgataattgaaaatggaaatacttattttccaccaacccaaaaggtgtccatttttggtgaagaaaatttgtcgaatggccaaattgacgccgcatccgacaatatcaccgacaccaaaagagtacttggcatttgattttctcgatgatccgctaatccaaagataaccgccgcttgcatattcgtaaatcgccgtgccgcaatgaattgtttcgtcaaacgaaatttggtgctgcttttcagccaacccgatgaaggcaatactaaaaataacacaatgaaatttaaagaaagattggcaaaatcaattgaaaaaaataataataatttttatgactcactgtttcatagatttgaccaaaacttcaaagtagaaaatgccagataaagctgattccggaaagagcgaatgtctagcg

SEQ ID NO: 41191 - DNA, 1782 bp, Heterodera glycines
  misc_feature (1726)..(1726): n is a, c, g, or t
aaattattttaattcacttgttgcctttctgcacacttctcatgaataaataatataagaattattaaactaatttttccatttataaaaataactaatattgtatattttatcattattcactgatattttttgtgaagaatattttagaaaaaaaaaattcaaattttgaacaatttatatgattgaaaatattttaaaattatttctttttatgtatcatatattttttataaaattttttaaaaattcagttaccttttttaataaatttgtttcaaaataggcccaaacttaatttagggacgaaaattaaaaaatagggattttcaaggtcgaacacccaaaataggagaggtataggggtttatatgtaataccaaaatattaaaaaagtattttattgatttatatttattttttgaacgaaaaaattcaaaattatataaattattgtttttagccacttttacttttgtttttgatttttgtaaaattatgtgattccaatgatgattaagagtttttaattgttttttaaatgtatcgttaaattattatcaaaccaaattacatatttgtttaataggttaaaatgtttaaaatttcacattttatattggtattttattttttctatagtaaattttcatctaatcgaattatgccaagattactattgataaatttttaatattctattaagaatgaatgccttaacgtacgttgcttctttaagcattttgaagcataaaaaaagagaaaaatagacaggaatataaacaatgaaaaaataaattagaaaaaaatcaataatgattttttacaatcttctaaataaaaagaagcagatgataaaaaatgttatttaatatttttagataaatataaaactgagaattgcattttttaatattacagtaaataaattaaatttttttggtttggaaagaacaaagaataaatcattccttttagcacccataaaatatagtttaatttttcatttctttacatttttattaaaaaaaaatttataattataatttataaattggttatttgtaaagttacaattatgttcatacagcttaatttagagtaattaaacttaaaaatttgacatttaaataatgtaaatcattttgaatctcttgtaaagtggctgaattaaatcaaatatggaaaagtgatttattattattatttaattattatttagtcaaagctcaatttcatctatttattatttatttttgaatttttaattaaatcaaaagaataaaaatttaagaacttttaaaactattaataaattttcaaaaagcttttattagaaatttttggtttaaattaaaaaaatttatttactcttcaaaaacagcgttatttaatgaggcaattgttttgtgtccttcacttttaatacttaattaatgatttcattttcatggtttttgaatttatttttgataaaaaattaatttatatatttgttaatttttactttatcaactttttcaataaaaaatatcgtagcttatttttgaagtggataattgacagtatctttttgaatgtttatttgtaattcaagtggaaaaatttgaagtttttttcattttttaaacaggttttcaccaaaaaaatgtttaatttctggcgttttggaaaaattagcgaaatttttggaaaatatgggtgatggaggtctgtaccaccccgngaccgtccctagtcagtttagaactgtttaaggactgtctctaacttaattatttt

SEQ ID NO: 41192 - DNA, 1108 bp, Heterodera glycines
tttttcgtgggggggggggggggaactacctgctccgtgcaaaaaatttatgtaaaaatagcaatctgccaaaaaaaaatatcacaacttttaatctgtctcaaaaattcatggaatattttgtttaacgttataacttaaacggacatttgatgtacaaaatttagaacctgggttggaattgaagcaggcaattggatgaaaggaggaattgggttggacattagcggactcgtatttgcagtgacaacagccgaacttgtattgagatcctttgactttggaataaatggggcggcagcggggttcattttgaacttctctctgaaattagacgaaagtggaaggtgtgaaatgctaaatgctttacttttgttgctcgccattctcacttccctccttcacttttattttctcctcaataatcagtgccgtttcctccttctggttgttttcagtcccttctgatcctttctcacttttgacttcttttcccatgatttccggatcgggtggaatttgttgtggggtttgctgttcctccctgtgcaattggacttgctgagatgggcaaccgctgttcgctgcaacaactggttcagcgaatggttttgcgattggtcccgacggtgtagtcactctcggctcattggttacgtcggatttgtttctatcagagataaaatatgattgacttcactaatgtcgaattaaagtgcttacttcatgttatgggaagcattcgcttcgtagttcgaggctctactgccagtgtttttgtatggagtttggttgttgttgttgtattgattctgatatggtcgggactgttgatgttggctgtacccagatgacgaccgatgcggtttattgttgaagtgaccccgctggtggtggtgttgtgacgtttgagggtttggactcctccaattcgcggtcgattgttctgcgttcctttccccggagggctgtcctttgtcaatccaacgcttgccactgatcatgctggtgcttccactgaccctccgagaggccgtcccttccctcaccaccctttgctgtctttgctgctgttgaggctgttgcaatctttccgccggccgatggt

SEQ ID NO: 41193 - DNA, 887 bp, Heterodera glycines
  misc_feature (46)..(46): n is a, c, g, or t
  misc_feature (56)..(56): n is a, c, g, or t
tgtccgtttggggtactcaaacatttatggggagcaaaaatccacngcagaattanagtacagactatagggaagctattcccgaaggattcggtctccccataaatctgggcgcatcggttcagggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaaagacgtgtaaataaaatttggtgcgtttcagaacccttctctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgctgcctcgtggtgggccttcgcccccccccccctcccacgcccttcagagcacgacaaatatttcaacaaaaattttgaaaaattgactagagcaatcgaacgctaacggacgacctactggaaaataaatccccgaaggagagaatttaattagatccattcctccgggggaccgtg

SEQ ID NO: 41194 - DNA, 1403 bp, Heterodera glycines
ctcatttaaaaatattattttttaaatttaattttgctttgataatgataaatctatgggatttggtttttttttagcaattttaaagtccatgaaacttggccaagaaattcgagacctcgctttcagctgcttccaacgcgacttaacgccggcgcaagcggccaatgaaatcaatgaaatgagaggggagggaagcgtgtcaaaacgcaccatgcaatattggtatcggaagcttgaaaggggagaagcggaggtgttcctgatggagaggccaaaacggcgaagccaccacaaaaggtgccaattttgggggaaaaaaattagggatggcaaaaaaagcgaccagcagagacgataattttgaaaaaaaggaacaaaattaattttttgggcgcaaatatctgttttttgttttcgggggcaaatgcccgaggcacaaaagtcagggcgaaagtgcccgaagcgcaaatgtccggggcgcaaaagtctgggcgcaagtacttgaggcgcaaaagtcttggcgcaattacccgaggcgcaaaagtcttggcgcaagtgcccgaagcgcaaatgtccggggcgcaaatgccagattttcgcttatggtgcaaatgtcgggtaatctaaaagccagtgggcccaactcatttgcattttaattatataattaatagcaataattgctcgagagtcttgccctcgagtgatctaatctcgggctcggatcatcagaaatttctcgagcattaatcctcatatttgtgggatttaattttagaaagaggactttgtccccttccgctgctctgtccggctgttctcaatcgttctcaaatgctctcgaaaatgaaaatggtggcaccacttttgtgccattgccgtcggatgaagcgccgcagcagtggcagcagcacaacatggcaccgaaacgaactaagatggagacaacaacgacaaaagcagcaactacagcagcaccggcagcaatggtgccatctttgcagacaaaaagtcggagtttcgttttatgtcggcttttcttctcggctgttcattaatttaccgaaaaatgccgcggaaattgtaactattccctccccccccccccacctcaacagcattcgacggtttgttctgtgtgtgcaactcgtttttctcatattttgggctgtgagaggaaattgggggaggcatttgataaggaaatgatagtacaaagcacagcgacaggaagagaactgctgacaatgaggaccaacatattagccttatattaaaactcttcatttttaatgaatattttttaaatttgaaaaataaaataaatttacgttttatgatcctctttctctgttagtttttatcaagtatttgaaaattttatgatataaaaaatattt

SEQ ID NO: 41195 - DNA, 1006 bp, Heterodera glycines
tgaattacactgctttggacgctggtacaatgagaacagtcaacaaattcgattcataagaaattacttccatcaattgtgttatgacgaggccaaaatgccttggtttttaatattttatcaagtgggctttttaaataataaacaaattgaaaataataattaaagcggattaatttcgtttttttaaattccaccttcaaattgaatgccatttaactgctggattaattttcacattatttaagactgaaattgtttccatcaaagggtgccgacaatatttaatccctttcaaaatgtgaaccccaaaataatttagccctattaataattcatttaccaaatttatatatttaattcgcgctccctcttctgagtttatccatctgtcatctgtgttttgcttgaagccaatcaaaaattgtctatttaaagagacaaaatttaagtaaatattcatttttatttataaattgcaaaaagaaattacaaagcattgaccgtatgatgctccgttcaatcataccgtacacccagaactgttcccaattatatgtccttttgccataaatgcaaccgctttttttgattttatatttaaaaaattattatttattccttaacacaaaaacccaattatttccaatatttttaaaattaaatatttacattaaactattaattaattaagccgaaataatttcaattgaatttgctaaacatttcgcagcagagatggaaaagcagcagcagccaaaaagtgatgatcaccagcaaagtgatcagaagcagcagcagcagaaaaaggccgtcgctgttgtggtgccgcgaatcgtgcggaaggaaaacggtgggaattttgtaattatgtacagtatcactcgggcattttctaagacataaaaaatataaataattcaaattaattgctaagggaattcaactgccaaatatttttttttactaaatagcatttaaaaaacaaaatgaaaagaaataattt

SEQ ID NO: 41196 - DNA, 1738 bp, Heterodera glycines
  misc_feature (7)..(8): n is a, c, g, or t
  misc_feature (10)..(10): n is a, c, g, or t
aatgacnngncagcagggaaagtcattcagcactaattgaaagagatcatgaaatatgtggacactttgcctgaaggcacaaaatcggctgccaaaaacattttccattgaatttttcatggaaaaggaggagaggaaagaagtggaaaaagcagcatggattaatgaaagcaaggctaaacaatatttattaaatattttattttttggtaaaatatttccaatttttcatttccaataaatatttttgctttgttcttttcttccaatttacgcttaagcatgcacataaaaagtgaaaaatataaattgtgtctcaaaatatcttcaaattcgttaaatttaagctaaacatctcgaaaagctaattatgtatgaaaatcattttggaagaaaaaacaaattgaatcgaaaatttattaatttaagaaaaacccgaaatttccattttggactgatttttggcacatatttacaatgaaagttacagtttgattaattttatcgagaaaataaaaataattttgcacttaaaaaataattaaatcgcgaaaaatacaaaatatgcatgtggaacttggtcctagaagcttgaatcaagctaaaaaatatttttcatgcatttaagcctcaaacagtcgaggaaaaaatatacatataatttgccgccctaataatcacttttagaaagtgaggaaaattcacttcattagcaggtaggtcatttggaaattttatcagcctttttggaatttcacttaaaaaacgaatattgaaaaatatttttccatgaatttttcgtccgtttttattttcgtcgtcgcattcgatcattgcgcggttgtgcgacggagaatgagaaaagatgcagttcattagctaattcttgcgcactaacacagaatccttccaggcaaaacagcttgtccgggcagtgaatgtgccgtttgcattcggctgaaaagaaatattaattatttaaatagtaatttaatttacactcacttccatgaatgttttgcattgccaaaatggacgagtcacgaagcgcaacagaaaaaatacagaagaaaattgcaaaaatgattgagattctcataattttgctaaatcagtaaagcgaagagaacacagtcttttttatattaatgtcagatttgtaaagaattacatttttgagaaataaacaacttaaaaatgcaaatttaggctaaaaattgtgtaaagcttagaaaaatcttttgccaattaaaagacattgaatttttggaaaataaattgaattatgtattttctaattttcggttttcaattaatttagccccataaacacgcgaaatgctcatcaatttctatcgtgcgatgggttggaccacactgtccccccacccaatttgacgccgtcccagaatgaaaaagcactccgacgtcgtccgacttttaattttacaataataattatttttgtttatttacttattttttactcgcaaaaagtgtttaaagctgccgcattttgcttctggcgcaaaatgtgtgcatcattaattcgtaattagcggcagtaaaatgtttaaaatgggagcacaacattcattggtggtgatggcccagacgagcacaatttgaccggtttttgctcatcagcagcggggagaagggagggaacaaagccaaatacaaagtgaaattttaaacattgaatgcttacccctggggcgatgaaaaataggcaata

SEQ ID NO: 41197 - DNA, 899 bp, Heterodera glycines
ttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaacgaatttctttctgggcgagtttgattttgaaaattttggaaaaacgcctatctctttttctgctcaacactctagacaattccaaccccatttacggaatgatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaataatagcgccaaccctaatttttccggaatttctttctgggcgagtttga

SEQ ID NO: 41198 - DNA, 699 bp, Heterodera glycines
ttttgcagcatttgctgaattttttggtctcttgctgtgttctaataagcatttataacttgattttaggcttctaggtccaacctttttatgctgatttttgcttaaattggtattttcatgcttaatgctgatcatgtaatttttgtgcttaattgacattttttgtaaaattttgactaaaacaccgtctcaacaataaaaatgaagaatacacccctaaatccctaaaaaaaaaaatttttttttcttgacaaaatttgatttaaaaatgtcaattttgctaagaaaattttaaattgtcagtgcgaaataaaaaattgagaatttattgttactaataaaatttttgcctaaaaatcaccaatttttatgttttttcgatctttgtgcttattttgccattctcatgcttatttcgtgcttaatataacaatttttggtgctgttaatgcttaattatcattttttgttctgaaatatccggtcactaataatatcaaaacacagaaaaatataagatgcaaaaaaatggctgaaaatttgcctgtactctgtacacaggaaaaacacaggcatgtatataccggtaatagttcagtttgtcccccccttttttcgaaaaatttttttgttttcaaaagtcatgaaaacatgtttccaaggcttttcgggatcgctgatcacgaatccggcgcc

SEQ ID NO: 41199 - DNA, 923 bp, Heterodera glycines
  misc_feature (39)..(39): n is a, c, g, or t
  misc_feature (50)..(50): n is a, c, g, or t
  misc_feature (84)..(84): n is a, c, g, or t
attgatcaaaacattttaatattcattttttctctttgnaataaagtttntgatcaatcaaattctctcgtccatttataattntaattttattcctattgacgaataattttttggcaatttttctttcaactttatgccattcttttggtgaatatttatttcctaatttcttcattttttctctattttaagaaaattttccaaaattataaataacgaattatttaaaaatttcaccttttagaatgttctatttggtgccaattttttaggcccatatttcaattggctatagccttgtccaaaatttgttttatctttgtataaaattattttcattccttagcgaaagttttcctttttccacaaattcatttcttattttaaaatatttttcaacaaccctaggaattttttttccaaagttttcccaatttctgtgccattttaagtttttcagaccaccctgaaggagtgatctgattacttgatgcaagtgacttttttgatcagtacccaaagatattctttgctgaattttttcaattttttatgtagcgcagaaaaaaaatgcatgccttcaaattttgaatgttaatttttcaacgcttcgaaacatgttaagctttcgaatgataccaacaatcttagatttggatgccaaagaaaaaagttatagcgaaaaaaataaaaatttttgaaaatctgcccacagataacacacaagtacctaaaatttgtcaggaatcgaccgttttaaaaatccgccgaataagtcaggagttatgcctgaccatttttttgatgttgcaattggttatgacaaattgtagcttgttttacatacatacataatcatttcttctgataaaattgcgaaactcggaaataatgcttttcgactttatgagatctaaacc

SEQ ID NO: 41200 - DNA, 730 bp, Heterodera glycines
gaaacagccaattcctacgcggatagaccaggaagtactgggattttaccgtgatgttctgacatcaggcgggacttcgggcgcgaccaatttccaaatttgtgcccaacgcgatgaatggtcaaataaatttaaaattaaaatgaaatggaatttggaagagaataaattttaatcaaaaataaaatagaaattatttaattatcgttattccgacaaattttcttccattttttcgactttattaaaatttagccgaatttcgccgtcaaaaacaatttgagaaaacgaagcaaaagcatctgaaaaacagaaaataaacattcaaaaagtgagtggattttgtggtcaaaccgacgatcgcctcaataaaccgccgataaaacgaaaaacgaaggagaagcgaccgcttccgcaacagaacggaataggaaaacaaagcaaccgcgagcatggcgagcccaacggaggaagaggagaaactgcgcaataccgtaaccgaaaccaaagcgagacaaaacgccagaaaaaggagcggaaaaacgagtggaattcgaagggcctacgaattttttgaaggaaaacacaaattcagcggattgtccgttaaaaacctccgaatggacggacaaacggcgaagtcgaatgttcagaaggacggccatttgtgaaaaagcgttggagccacctgccaaatgaaagaatgagcaaagcatgggaacgcttttca

SEQ ID NO: 41201 - DNA, 1287 bp, Heterodera glycines
  misc_feature (166)..(166): n is a, c, g, or t
aaaaagcatagaaaacaagagaagctaagtgattcgcgcagactggcgcaatttccaagtataaaaggatacggtatccatgatggaagtaataatggaggaaacagtattccaacaaaatctggtagttcgacacctatacacaaatcatcaggcaacaatagcncaaaaaaaagtcatagtccaaaccagcacagtccaagcaactcactaaaatacagtagcccaaaaaaggcggcctacagtacagtaaatttacctgtgaatccaccacacaaaaacaacacaaattataatagcctaacaagcgaacaaagaggtcgaaatcttcataacgcaaacaacggagggcatcatagtcataaaaatgaaggttatggtagcccagctggaagtacgaatatgaattcgctgtccaaaagtcgttctgccaacaatagtccaaaagaggcggcctacagtaaccctacatcaaatatacatatgaacaccagtcataaaagcccaaaaagcgagcaaaaaggccgaaatcttcataatccaaacaactcagggcacagtaatcacaacaatgaagggtacattagccctgctatgaaaaaaaatgttaatttaattccaaaatttttctttgccaacaatagccaagaaaaggcggataacagtaaacctgcagcaaatatacctgtaaactcaatgtccaaaagtttatcagcaaacaatagcccgaaaaaggcggcctacagtaaccctgcagcaaatatacctgtgaactcgaagtccaaaagtttatcagcaaacaatagcccgaaaaagacggcctacagtaaccctgcagaaaatatacctgtgaacttgaagtccaaaagtttatctgcaaacaatagcccgaaaaaggcggcctacagtaaccctgcagcaaatatacctgtgaacttgaagtccaaaagtttatcagcaaacaatagcccgaaaaaggcggcctacagtaaccctgcagcaaatatacctgtgaacttgaagtccaaaagtttatcagcaaacaatagcccgaaaaaggcggcctacagtaaccctgcagcaaatatacctgtgaacttgaagtccaaaagtttatctgcaaacaatagccagaaaaaaacggcctacagtaaccctgcagaaaatatacctgtgaactcaatgtccaaaagtttatcagcaaacaatagcccgaaaaaaatggcctacagtaaccctgcagaaaatatacctgtgaactcaatgtcgaaaagtttatctgcaaac

SEQ ID NO: 41202 - DNA, 900 bp, Heterodera glycines
  misc_feature (851)..(851): n is a, c, g, or t
ctaatggccgaggcctccgccttgtggggcattgtttctaagcaaattgactccacaaaagccgctctccaagtatcaccgatttcccactgccacacttccattgtttttgcaggtcgctgctgcttccactctgctcaacttggcgcgcattctcctgcaaaagtccaaggacggtgccgtcgttgaactcggccctcgcgaggacgccgtccacgcgatcatcgcctcgctgcgttcggtgcactctttcggcgaccattctccgctggctttggtccgtctccttcagactctcatcattctgttgggccaatttgcggtcacaaattgcttgactgtgggcgagattcaagcactgaatgatgcaacgcgtcgcatcaaagacgcggtgtcggatgacgacgtgaaggcattggttcgtgaattgtcgcagaagatcggagcaatttgagtgaagcgaacgatgaacctttcacgacttttctcatttaattgtccattcgtttgattttgacatatattcggatatactttgtgggttaaattcgcgttcgcggattttcgttttattcggtttaaattattataaaataataaatagctgatctgttttacaatgtgtaaagcaaatagggatgaatttcttccatctgctgaaggatcacattcctccacttccttggatttgctgcattcccatcggtaggaccttgaaaaaataaccaatgtatgtatacatgaatgaatttgcctgcagttgcgggtttggctgtttttgctgttggtgttggccctccagcaaagcgcgaatgcacggccaaatgcagcaggtgcgtcgctgctgctgntttggaaggggtccgcgacggactgttgccggcacaattcgccctgtcc

SEQ ID NO: 41203 - DNA, 1336 bp, Heterodera glycines
cccgacaaatttcgggataattaaacgaaaaaagtgactcttaaatggaaagaaaattaaagaagaaaaatttaaggcttcttcaattcaataaattcaatttcaatagaaatgggtggaaagataagttcaaataaaacgggaaaaaaggattttggaaatttaaatttaaaaagttttctccccgacaatctgttcaattgtaattttgccttttcttccacttccgcttaacttttttacaaaatgattatcccctcttccccccccccttcgcttttcccactttcgccgtccgtcccttctcaattttcaacgaattctttcccccaccctaaaaaaaactgggcgtgagaagcggctgatattatttcattagcaaacaaaaaaaagacttcctcgttgcgaaaaaagggaggattctcccccccccccccctcatttttcgtgtcacttttccctcggaaaatttcgaatgaatgaattaacaattaattgcttataaaaacagctcttttcacgcgcttcccccccccccaaccgttcaaataattttttttttttacaatttgagtaatttgaccaaacaaccgaccgaaaaaacaaaagaaaaagtattcctttgtgttgtgtttggtaaggggtacggtagtaaaacctttttgatacggtgcgatttgttaaaattcgatctcaaaaaaggataaatagcgaacataatacgccgtgggttccagcagtccccctttttcacagtggtattttccgtttttacatcttatgattttcctccccatttcctttctcacgcggaactaccgatcactgatcactaaatgattactaatcggtcacttccctcgagttttttatctgttattgtttttttgggtttttttattccttccttttttatgttcgcgaaaatttaagtgcagaaaaagcaaagcaaaaaaacaaaacaaaaaatattaaaaataaaatttacaataatagagagcaaaaagaaatatataaaacaaaaacggaattgggcagattaaaaccaaaaaccaaatacaaatttaatttcactaacttttttcccaaaatttgtttccgttttcgaatgcccttcagggaataatgccgattttacatgtgcttgtcatatttgcaaatcggcactctcctcgcatcgcatcgcatcatgtgccgtccccccccccccgttactatgggagtggaaattcacttcctcattcgttcgtctcctccccccccccgtcccatcactttccaccacgtaataccgccattcgaaagaaaaacttcagcagaatttgtaccatactac

SEQ ID NO: 41204 - DNA, 906 bp, Heterodera glycines
  misc_feature (799)..(799): n is a, c, g, or t
gcccgtataagcccaacaaaattaaaaaaacgggcgcgaagcgcccgttcgagtccgcgaagcggcctaaaagtcccagataatttttttaaaatccaaaatctccacaaccatagcttatctaggtagcgaagctcccaaagcgcgaagcgctttttcccagctaaatagccgacggttcacgcacccgctagttatatatatgttatatcgattaggcaactcatcttcaaaaacaaaatctcgggaacggctaagcgtacagggctgaaattttgcaccgaggggtagctcgagacggcgcatctgggaaaactataggttttttggtccgaggcccaactgagtaccagggacttttttcctatttttgcgtgcgtttgaacgcccataacttttttcctaaaacctgaaccaaaaaatgtctgctggtaggaacctaagttgaagtgttttctaaaaaacaaaaaaaaatccaggcctctacctataataggaaagcttgtagacttggctagaaattcagtaccaactttgtccacttcagtaccgggcgaataactcgccagggtttgaactgagcggggggtggccagcggacttattgtagagttttgtaagcccgattttttcaaattttaaaatttcgaaaattttctaaatttctcgagctaggccccctaagaggttttggggtttttgaattttatgattttttgccgatttttccggggaaaacggagaccactttcaaacaaccgtttttcgagctctatcgattggtgggatttttggaaanatttcggttttttttccggaaatagaaaatttttttggcctaagcgggacatttgagtcccgggccataactcgtcagggggtcggttttagcaaaaaattgcctta

SEQ ID NO: 41205 - DNA, 1378 bp, Heterodera glycines
cctaatgtccctccacaatttgttgcctttctcttcccctcgtaatatttcaaattgaacggcgacgcgtacaccgcccttcgcttcagcagcaaatcccaacgcgcgacttcggcggacactttgacaatgtcaaacttttcgccaaggtctatagtttaatacaaagttttcgtatatgtatttccgaaataccttttatatcctcaagaagaaaaagttcgaccggcggcggtggtttttcaaattcgggatccgccatgaaatcgtatttctaaaatcgcttctatagttggtgcaatttttaaaatgggtgaactattttcccagctggaaaaaatttttaaaactaaattttcgtttcccatttttttaatttcaagaaaaatttaaattttagaaaaattcacagtcggtatttatcggcaccgccggatgacttaattccgtagaatattaagtttttgataaaaaagccatttttgtagaaaacttacaaaaatgttagattttgggaaattaagcgacagcaaaggtaaaaaataaacagaaaaaagacaatttttaggtttcaattgtcaaatgccaccacagaagggaagtgattgttcgcccgtactcaccataaagtccgggtgttcggacggtttgcgctgcggctgtccgtccggcgtccgttccggcaaataaacatgggaaaacagaagcggaccgggctgaatggcatttacccagattaaggaaatagaaagcatttgataagtgaaccaaaaaccaccggaattgtcttcgcaaaagtcgtcctttggagagagagccatcgaattgaatcgacacaatgctttttggagacgaatctttttgctggtgtcagcggaagcattggtgaacaaaaaatagaaatggaatcagtcagcaaatttatttaagaaatcaaagaaaatcgccaaaatttcgatgaggacattgtatccaaaagcacaaacaattgtttttatcatttttaaagaacaaatcaaatcagtggcgcctaaaagtccgatcgaaaagtctgtccaattcgtcctcctctctaatatttccacaggtcggcatttgggtcccagcgtaagatttcttcacggcgttctctccacattttgctgtgtcccttcatcattccaatcttccattgaccatgtttatagtaggaatattctaaacatggccgtttttgaaacaaaagggggggggacccttttgttttgcaaaaattttttaagataaaaaaccatgataatttgttatccggggttttaaaggtcgctaatcacgaatctgacatgtattttgactaatttctaatgcctaacccgaactcgaataaaaatcgaaattt

SEQ ID NO: 41206 - DNA, 1054 bp, Heterodera glycines
tttatagaaaatttcaattcaaatttcctaaataaaacatttgtcaaattaaattttagcgcttacacatttccctctctctgctctctgttgttagcacaacacaattccaattcgtctagctttttctctaatcgacgagatgacttcttcaagatcggtgatcactttccctccccccctccattttcatgcgctttttcccggactcgatcagttgggccccggggcacgtttgggccctggactataactgttttcatgttcaatcaaatcaaacattgatggtatcatttgatagcgctaagtgtcgtctattagcctgcaaaattgcaaaaaatttcgttaagggacaaaaaagttatggccaaaaatgactgaaaacccctggtttctgatgtacctttttttggcgtcataagtttgttgaaaattgacgaagtttttttgcaattttgtaggctaatagagcacacttagggatatcgaatgataccaaacaattgttggatttggtagacagagaaagaaaattatagcccaaaaacatgctgggggcccaacttccgcttttgcggcgacgacgaatgccaccaacaatgcgacccatgggaatgcgaccagaagcccctcaagcagcgacagtgactgaatgacgtgacgcctggtcggatgtcaaatggtacaacaataacaacaacggcatggagaaaaatggcaaacgaaatggacgagaatttttgcagaggatactaattaaatcacggataattgtgcaatgaaattgatcccccgtcaaatccatccgatttgtttgtatatgtataatttcacccataatgccatcatgtgatgttaccaatgtctgaatatatgccatctgtgtattgttactgtactaatttatgtattccgttgtttcaatcgctgtaaggagagatttgatgaaccagtttaataaaattaggcacttatccccaaattaaaaaaaactgaaggggattagggattttattgtacagcagcaggataaggattcgaccgatggggaaaa

SEQ ID NO: 41207 - DNA, 1608 bp, Heterodera glycines
aaaatctaaaattttaaaaattctcaatttcgttagctctctagagaatgaattattttaattgttagaatagttttagtctaaatttttcatgttttattcatttaggaacaaaattgagattttttgaaaattttagattttcgactttttgttcgagttcgggtccgggattcgaaattggtcaaatgaatgtcagattcgtgttcagcgaccctgaaaacccttggaaaaatattttcagtgacttttaaagttaaaatatttttttcaaaaaggggtcctaccatcggtagtattaccaaaattttttcgcataatattaatgtaaataaatgcttttacttttgtttgtttgtacataagtgatcaaataatacgtaaatcaaaagttagaattttatcttttattggcattttttgcctttttatgcttttgtaagacaaaatgaaagaaagaggaaacagaaaagagaaacaaaaataggtaaattaatattcagtcgcatcggctggcgtcaaatgggcaaaaccaaagtggacgactgacgcgcacaaaaggccacttttgccattcggcccatccatttgaggccgttttccccacccgggacataggaaagaagaaacctaaaaaggggagaaagggaaggaatgggggagaaaaagttaggaataaaaccaattaaaacatggaaaatgcaataaaaaactgaccaaatgaggccaaaagtttgaagggcggcagtgattacggtgagaagggaactttgaagccacagagaagtgtaaagagtggccaaaacactgagcaaataaacggcggtgaccacgcgacggggctcggagaacagaaattgacaatacgccaaaggaccccacagaaagccaaaactaaaagggaaacaaacggatcaaaagggaggggaagggagagagagagtgtggagagataacgaaaaagatggatacagagggagaaaaggaacggggtgagagtggcggagagaaacggagaaatggagagggacggagggaaagagaggaaggaacgacgtgggagggggaaaagactaatgaatggggcgcaacgaacagaaatgtgacaaaaaggtatatttttttaggaaaaaaaataactggttctggtcttaaatttaaaaatgtaaattttcgaaaaacgtcggtataaatttttgtgaaaggagtgggtacaaacgccgatattaatgcctttttttgtttttcaaacccgtttttttgcgaagcgctttttcataaaacttttttggcaaatggggttccggcggttaccgataggcgccgctggggaaaattattttaggtttttaacgaattttatttagaaattagtctaatttttcagaaatttccctcttttcccttcgctacgaccccccccccccctttcatatggtgaccaatgatcaccgaatttgaaaaaccccgtattggtctcctaattttgaaaaaatggaaggacaaaatgcattttaaatgggttttgggagtttcgccttaccaacctgacaatgaaaaagaggggtcgcgagggtattcagagcagcgaatttgcgcgttggagga

SEQ ID NO: 41208 - DNA, 1689 bp, Heterodera glycines
aataaaataatggtttgaaactcacatcgcgaatgtactgttccaccaatttgtccagtcggaattgttcttcagcttcgaagagacaaatctaaaggacaatttaaaaaagtgccggtataattttaagcttataattttttgccaccgcactttccgacaataatttctttttaaataaaaatttcatttataataccccccagtccttcgttggtccccccccccaaattggcatccaactcggtcgttgacgccgcattcgtcgatttcgggcactctgctgattttgcgatggtaatacggcatcttgtgcttgtcgtgcagccgctccacaatgttctcacggaaccaagtgaccggccaatccaaaaaacggtttgtgtaataagagtatttgccgacgaatgaattctgagcaaaacagaaatgatcagtgaagaggacacagaagcaacgcctttcaattggtcccccaaactgaccaacctccacctccttccatcgaatattccaataggctgcccattcctttctgtcctgctcacgtcgtcctttaactgccgacataaactcgcgccccggctcttctttaaccgtttcagcggatgtcatagcacagaaagaaaatgtttttgctaaaatttgatgaacacgcagctaacataaaaaatggaatgaaaatgatgatggatcgttttagcattttgggtcattcactggcagacaaacattacgccaaattaaatttttatgaattcaaaataaacataaacaacacacaatagataccccggttgcaaactgtcgtaatttgctcggttgaaccgatatcaaatctttttaaatttattcaattcaaaaataaaaaaatgaacaaacaaaaacaaagactatttggtcatcattcgcggtgcgatagacatggacatgagttcctggaacaacagcttacacgcgtaaggaattcgaacagctgacacttgcgttttattttgacatgcctaaataaattcgtaattaaaaagcatgaatactcgattaggaaggcaaatgctgctcactttgcactcgaaagtgttcgtccgttgattgaaaatcaccaccaatccgcattgattgcacacataaactgtgtatggatcggacacctcaaaaagtctctcccgtaaaaattgagcagcgccgtgtgaaatttgacaatctctttccatttcaccaaatcgcagtccaccgtcacttaaggcattgaagtgttcatggttttgtttaacacttcttaccgtgccctgccttccattggctgtcggttcatcccctgaacaggccctcgggcgcgtgagtgaattttgtcctcgaccatgtgcttaagccgttggtagtaagttgggcccagaaacacctgttatcatgaggaaatggattaaccacagatcacaaacattcgcattgtttttctgggacctgtgtgctcaacttttgcccggtaaatccgttgtacattatttcattgccacgcaattggtagccgtagccctcaagcaaagcacttattttctgcacattgactgtgtcgttgaaaggggtggcgtcgccaatttcgcctttgtttgcagaaagctttaacaacaataataataatgcattcaaatggatttcaatatgtaatccgacctttccttggaggca

SEQ ID NO: 41209 - DNA, 1157 bp, Heterodera glycines
tgagccctacaaaatgtcgggttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaatggctatctctttttttctacaccgttgtacatgtggggtttccccaaaaacgcattactatctgcggttgagccctacaaaatgtcgggttgaaaattgctttctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaatggctatctctttttttctacaccgttgtacatgtggggtttccccaaaaacgcattactatctgcggttgagccctacaaaaggtcggtttgaaaattgctgtctcagaagaatagatattctcagaaaatggctatctctttttttctacaccgttgtacatgtggggtttccccaaaaacgcattactatctgcggttgagccctacaaaaggtcggtttgaaaaatgctgtctcagaagatagatattctcagaaaatggctatctcttttttctacaccgtgtacatgtggggtttccc

SEQ ID NO: 41210 - DNA, 1124 bp, Heterodera glycines
  misc_feature (97)..(97): n is a, c, g, or t
tgttgggtgctattgaccaggggactcaaagcagtcgtttctcatcttcgatcccaaaaatggcaatttggtcgccagccaccaagtaaataatatntaaccttccgatcacatacttttgctaaaatactaaattgacaccttccaacagttggaagtgcagcagcaattcccgaatcccggctttgtggagatgtgtcccgagcaaatatttaagacgacagtccgatgcatcaaaagcacttgcgaggaactgaacagacgcggcattgatccgaagaaagaaatcaaagccatcggcataaccaatcaaaggggtgaggcgagaaatataccgatggcaaaaagagtgaaaaacttatcaaaaccaatggcatggccaaataaatgaaaaaatgtgatcaaatggaccaaagctaaaggaatagccaaattggtgatcgtttccgtcttcagaaacaacaatcgtttgggaccgagagacggggtgccatctgagtaatgccatcgtttggttggactgccgaacgcatgagctttgtgacgaatacattcagaggacgtcgacacggtgaatcagtgaaaataactgaaataaattcggaaattttagggacaaaaaccatttcaaagcgaagaccggcctgccaattcacccgtacttttgtgccctcaaacttcgttggcttctcaacaatgtgccagaagtaaagaaatcgctacaaaatggtagaactttggatcattttgctgacgcatttaaattatttgaaaatttagggactttgatgttcggtacggtcgattcgtggcttatgtggaaattaattggggtaattaatggctaatctcccaaaatgcttctctccatccttctcaaacagatccatgccaccgacgtgaccaacgcgagtcgcactttgttgatggatttgcagaaccgcaaatggtctacagaaatgtgcaccttttttgacattccgatcaatgttctgccggaaattcgaagttccgcagagatttacgggtaccttcagaaaggtcgtgttggaatatttggtcaaattagctaatctttaggacctttggaaggcattcctttggccggctgtctcggagatcag

SEQ ID NO: 41211 - DNA, 1097 bp, Heterodera glycines
  misc_feature (10)..(10): n is a, c, g, or t
  misc_feature (51)..(51): n is a, c, g, or t
attcagactncccttctgaaaagtcattctgtaaaagtaaaatactacaanaatccgcaattttttcctctataatataaattttattttacatttttatcaaatttttaaaataagatataaaaataaaagtgattttgggattcgggaccaaaggggggtgaccaggatttttgagtggaaaattttttttcacaaaattcttccaaaaatatgtctttaggggttatttgggccgctgatcacgaatacgtgatcagatttcaattattacatcgttaagccctcagaatccctgtgtgattggggattctgaggcatcattttgaggggggggggaagttcgaatccgggcggtgtacattatttttctttgtatttttgggttatttttaatgttttaattaatttcaagatttttataaattatttaattaatttatttaatttcattatttattttttgaatttataaaaaatgaatttcatttcaaaataaatattcaattattaattttcaaaattatatttaatgaatagaaagagtattttattataaaaaaatttaaattaaaatgcaatcgatttttataaaaacttttcattatttatttaattttaaaccatgttgtacctcttctaatcacttttgtacctcttctaatcacttttgtatcttttatcacttttgtacctcttttaatcacagttgtacctcttctaatcactgttcttcctcttttaatcactattgtacctcttttaatcacagttgtacctcttttaatcactgttgtacctcttctaatcactgttcttcctcttttaatcactgttgtacctcttctaatcacttttgtacctcttttaatcactgttgtacctcttttaatcacttttgtacctcttctaatcactgttgtacctcttttaatcactgttgtacctcttttaatcacttttgtacctcttttaatcacttttgtacctcttctaatcactgttgtacctcttttaatcactgttgtacctcttttaatcactgttgtacctcttaaaatcacttttgtacctcttctaatcactgttgtacctct

SEQ ID NO: 41212 - DNA, 1351 bp, Heterodera glycines
tttcagggatagagttacgaagtcataaaaaaattaaaatttcggttcaatccaaaaaaagacgaaattccgcgccatttctgattctttccccattgttttttcaaagtgaaaaggaaatgggactaaagaaagttgaaattcaaatttgtgtgctttagcacgctgagaatgcgctgaaccccttggctatggtcgggctcattgacttccgaaaatttgacgactttccatggcccgatttgcgtgcttcgaaatctctcgggaggaccgtggagaacgacctcacaccattcgaagtattccttgtccaatttgcactttatcaacgtgtacttcactataacaattggccatttgcacggcagcaacgaattcaaacgcttttccatccaacggactgtcaatggaccaaaaaaggccatttgaacaaacagaaatgaaatggcgacgatctccaatggatttactgcaaaattgccggacttttaaattgctattcatttgctcgttcttctgctgttttgctgtcgtctctcctctctaatcctcaactcgtccatctcagaatgtgttctgttctgtctgtctctgttttggatcattttattcattccaccaaatcattttgggtatactattgtcaacccccagaaaaaatgtcacaaatgatataccaatcgttaaaaacttaatgatagaattcggcacttttagcgtttttaaatgatcaaaaccttgacaaatttggtatcatttgaaagctctttttttgtcaattaaataaaattgcgattttttgtgttccaattggtcttttccttcacttcccatcccttttaatttaagcattcctctcaatttgcttgttttcccttttccgcacttttcctttctttggtccctttaagaaatttatggcgaattgaggcggaaattgccttcctttgcgcatcgctttgaattatgcgccccagcaaagagaaggatcattagcatttatgtgtttgttgttatttatatgtgcgccagtggtcaattgttccgttcgttctttgcttttcgcccccccccccccctcaaaaaaaacgtgggatttttgggccaaatgattgtctgatgggtgttcactgatcacccgtcgatttcttttgacccttcaaatcccctaaacggcggcggtattgtgccgttgcacaaaggccaaaaaaggggggggaatgagtgcccaaaagggaaaggcgatccgatttcatctcgtcataatatcctttcttggtttgtgcataaaaataaactgtgaaggaggatggtttatgctttgccaccgtatcaatttctttgtttgaac

SEQ ID NO: 41213 - DNA, 437 bp, Heterodera glycines
acgaattacgggaaattacgtggtttttggacccccatcattacggattacggaattccgtaactgagaaaataaccctaattacggattacggattccgtaattgaaaatccagctacgcccagccctgataccaacattttcattatacacaggttatcttataatcatttttaattagaaaaaaaatgcaaatctggcaatactctattacattgaaagtttttgtgacgaattacagtaaataaagtattaggtaccggaaaaaaaccctatgtgtggaaatttttcctgtctatgaaatagagggacaaaaaaagagcaaaatttgttatggaatgcaaaagatcccaacgtgtctttatgacttcttcccatataggtagtcgtaggtagaatattcgctattggcactttttttctctgtaccgggtttt

SEQ ID NO: 41214 - DNA, 923 bp, Heterodera glycines
tctaatctactcaaaccgggttcagaattcaataaatctttcattccggtgcgaaaaatggggtatgaaacgtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggctcagaattcgataaaaataacattcacggtgcgaaaaatggggtttgaaaagtttattgtggaaaaaaaaattcaaaaataatacccctgggagaaggagtgggaa

SEQ ID NO: 41215 - DNA, 803 bp, Heterodera glycines
tgcaagcacataattccaacccatttccttatttctcctaatcggattgactctctgagcccatccatcgcggtaatccgcccaaccccccgccacaatccgtccattccttttcgggggtcgtcgccctcgccctatacccccccccccccggcttcgcccaacggttcattgtgtggcaatggcaaaaaatgaggcagcagaatcgaccgactcacacaactgacaacaccacgcgatggatgggttgggtggcggcctttgtgcaccaccgaagaatgaaaggacgccaagggaaagaagagaaaatggggggagaaaatggaggggggaaaggggggggcgatgacagcgacgacacaaattaatattcgtcacgggctgtgcgccagcggcgattgaaaatttacctccccatggaagagagagctgaatgtgatgggaaggcacgaaattaggggtgggcagaggatgaatgggtgaactgttccgttgtttgctggagggcgaaaactcccctcaacatttgacgagtggggcgaagtgtggaggagagagtggcgggggggagagacaaacagagaatgaattacggtattgccaggaatgaccgccgcccctcccccgccgttgccatcccacggagtgatggatggttgagcaactggtaaagccgaaaccgataagctaacccccggccttttcccgatgctctgctgattttgtccttcttcgccatttcccatgggagaggaaaaacggagagtcgtcgacctatcgcagcagaaatctctgctaagaaa

SEQ ID NO: 41216 - DNA, 983 bp, Heterodera glycines
  misc_feature (12)..(13): n is a, c, g, or t
tctagagtcaannattttttggaaaattctcaaatagacgagcatatactaaaaatatttcttaacacttttgtccatgatgacttgaggatttgtgtcataagtgcacaaaaaggtaataaattttgaaattcaaaaaagcaaacactttttatcaacgtaattttttgtgcttatttcattttgcatctgtccaaacaatccacttcattgctcatcatcactttcgcttaagtgagcaaacaaagtagtggaaaaatttggaaaatttaggcaattcactcaaaacgaagagaaatcatttatttgccaaaattttaaaatttcttcaaaagctgaaataacaaaaaaactatgtgatttagttgaatatgacagaatttatgggcaaaaaaaaatcatgaatagtttagcataaaatactaaacccatttcacactttgactcattaaagaaaaatttcgataaaaacacaattaactcataatttgtccataattgcatcataaataatcataatttataggctaacaattgaaatgcaatcgtttctccttctcgtaaatattttgctttgttcaattgtgttgctacatttattgtcaaatgaaaatggattggtcaatgccatgccggtaaatatttttataaatttgatgggatggattttttttgattaattcctcaatgaggaaaaaatacataaaaatagaaacaataaaataccgaaaaaatcggaaaagaatttgacataataaaagatcgttaatattatcaataatgccggtcttcttggtcaattctacggctatatttgtcgtttatttttctagcaatatttttttctcaaatcattttataaaacatagcctttttctttagctttaaatttaaaaatttaagatttttttttaatttagaataatttatttgcatttttttaaattttatatgcagtgaaaatttttattcatataattttt

SEQ ID NO: 41217 - DNA, 1033 bp, Heterodera glycines
ttttttttttttggttttccaaatttcggtaaagtttttttgatggggccaaccaagaaaagccacttttggttcccaatttgcgggtaaaaaaaagggaaaaaaggaatagacattttttgggcaagaatttttttgtttgcgtttcaaatatgtaaagattgtttgatagggccagccaaaagaaggcaactgttgttccaagtttgcggtaaaaaaaaggaaaaaaaaaataaccattttttggtcaaaaattttttttttttgcgtttcaaatatcgtaaggattgtttgatgggcccagacaagagaagccaccttgtggtcccatttttggggtaaaaaaatgaaaaaaaagaaatacccttttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaatagatagccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaagtttgcggtaaaaaaatgagaaaaaagggagtattttttggtcaagagtttttttttgttgcgtttcaa

SEQ ID NO: 41218 - DNA, 943 bp, Heterodera glycines
tccacctcctccctctcctccttcctccgccagcgggcggtacccattcggttacctcgggcagtacgccccgctggcggcgttgctcaatcaattcgtccaacgctctttccacctcttcccattctcttgctgaaaattcgttttaaaaacattaaatggtttagtttttaatcttggtggaatagaagtaaaaaattgactggatgcaaaaaaagtcgattggactcataaactgtatttgagccaaagaatgtgctgattatgaatctgctgagtttttgtaaaatcattgattttgtcactgatttttcatcaagtatcactaaaaataaagcgcaaccaagcgggcttgaccaataacaataatttccttaaaactttggaaaatcatagacaaaaaaaaattggctctagtccagtttatgcgtcccatcaatttttatgcgttcaatcaattgttatcagctaagtgaaagctgactttttttctccgttcgttggcaaaaggaaatctgcaattaaaaacccgtacaggaatagaagttgttattattttgtggtaaaacctcgtcagattacagataaaagtcgggaacattggtcccataaaaaaggggcaaaaatgctcgttttgagcgattgtgccatacactcagggttttcggggtaactgatcacgaatctgacattcatttgggtacttttccgttttgaggcaaagtttgaatttttttttaaatcaactgcgggcgcgtagaattgctaaagctacgcgccaatcggaggcataaatgccacaatttgagctaatatctcttcggatgggtctgcgccaggggtgtagcgcgaccgcgatgtgcgaaccgcgattcgcggcgtttttttttgcgcgatccgcggccgcggcaaattgaatgcacgatgtgcgaccgcgggattt

SEQ ID NO: 41219 - DNA, 492 bp, Heterodera glycines
ccaaacagccagaaatctgaaaaattgacccgacactttgttctgaaaaataaaataaacgggttttttgaaccggtcggcccggccaattgtctaaagtccgagacaagaaggcccacccaacaacttcaaaattgtgaaatacgtacttctcttcatttccgtccggagactcttctttgttaacaagggcattcgttggaattgatgatgcatctcttttgtcgttgtcgttggacatttgaacacaaaattattaattctcaaattttaaagaaactgatacatacaataaattatggcgcaatctgaaattgttgtatttaacctgagcaaccaattccgaatccttacataaatttgaaaaccgaattaaaaaaatgaatttcgagtttttgttcgatatctattagctaaagaaaatgagtgtttaacccgtcatgttgtgatctgtgcaaagatatacgccatgtacgatatgccgatttttga

SEQ ID NO: 41220 - DNA, 373 bp, Heterodera glycines
tctcaatttaagcgtaaaaattgagaaactcttctgaattttatattttttattaggtttataaatgccgaaaattcaaaaagttaggcttggatttctggaaatatttatttttttattaaaatggacatagctccctcaccaatacatgcgtatagcctttggctcatgtattcctagaacgggctgtcggtctccctacaccggtgaccgactgacatctgcggaaaagaaaattttaattgaaatgtgaaaatgacaactttggccacgccttcgtcccatcctttgatcacttcgcccttcccaatcttaaaataagattcggtagaataataatcttagaaattacagtgaattcaaatggttttcc

SEQ ID NO: 41221 - DNA, 949 bp, Heterodera glycines
  misc_feature (13)..(13): n is a, c, g, or t
  misc_feature (912)..(912): n is a, c, g, or t
  misc_feature (915)..(915): n is a, c, g, or t
  misc_feature (937)..(937): n is a, c, g, or t
tttaggaatgacnttggaggaagaaaaaatctttctgtggccgaatgaaattgatttaaatggccgttaatttttataaaatgcaaggattaaaaggtgaaaataaattttcataagagggaatcgaaccttcgagggcaaaaagggaaggccggagcacaacctccgcaccaccaagcagcacaaaacaatgcaaatatttatttaatttattgcgataaaaaaagtttttcacgtcatatctcggcactcagactcatttcgcagaaaataaaaacacttcttaagaacccatgggtgctctatccacccaccaaatttcattcggaaatcccacggacacccggggaccttcctttgtaaatcccttccggtggattttcggcatatctgctcacgaatattggcactttcatttgtgagcaatgggagagaggggtgcaccacccccccccccaaaattttttttttaattttcgatttttttttggaaatttctttgatcaacgatatgggggaaacggcggggcggggtggggatgaatgagctgctccctgggagagagacttggaaaaatcggtatcttacaacggtttaacatgaagcgttcgacatttgacaccagtggtggaatttttaggtcatcgagaaacgtgacccgaccgaactcgtcggccatgtttgcagccaacgaaaagctccatccttaatcagtgtcagcttctcatttgtcacttcgttcatcaattcaaatggcgcaattggcattggtttcacacgaaaaataattcgaacagtgtaactgccgaagaggtggcacggagaaatgtctaaacaaaattgggaaaaacaaaaacaatttgagaaaaatggcgagacacctcctttgaaattgttgctccaatcaattnttnggtggatcccaataatcactgncaacaatctctt

SEQ ID NO: 41222 - DNA, 996 bp, Heterodera glycines
  misc_feature (6)..(6): n is a, c, g, or t
tttccncatatggcagcaaaatggctgcacacccctctgatgccgtagcaagcactttgtaggtgtatggggcctttcgcaagcgcctaataatttggccaaacaggaatgtctttcctgtgcctccatcgccgtatatgaagaaacggcgggggacagtcgaatccctagggttcgactgtattgccaacaaaacagcatcaaagaccttctgttggtcgctgttaagtggcggaggggtatttggctgtggacgaggatttggttgccctggaggcaaattcaaatcatcatcgccaaagaaaaactcttcaattgccgcgtcagtatttttggcaattgaagttggcgggtctggcaggctaaaatgcacacagcttaagttaaagcagctgtgcagccgccaatcaatgtcggctagggcttcaagctctgctactttatgctgtgccagagtaataatgccttgcggattgtacatttggtctttgtacttgttccacaattctatggcattactcggctggccatagaccaggatgctcacaaaaagccatctcatctgatctggccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatatagcgcgaacctttccgggtccgatgggggtacaggaacaattcggccgataggtggccttttaatttgctgccttttgtacaggacccatttgtcctttgcccatcggaaccgctctgggactttttcgaaaagaatgtccttaaactttggatcattcttccactcattttgccattgtttccataggctgaacactgcgtttctggcagttcgccttgctggatttgttgagctttgctcaccagctggaatgccctatatac

SEQ ID NO: 41223 - DNA, 676 bp, Heterodera glycines
  misc_feature (84)..(84): n is a, c, g, or t
gagagagagagtgagcgaaagaaagaaaggagatacttttgagagagggcagagaaaagaagacataaatggacgaactaaagngatttacaccttaacctttttgccttaaataagtgtatggcaaaaaactctgtgccctattttgtgaaaacgtaatttcaaaaatttcccagctgcgcctccggatcatttgtggtcccgaaattcatggcccaaattttttttaaattaaagcattgtccactgcgtttggcgaactgttttgcatgaaatgtgacgactttgtatacgaccggcgcattgagaaggtgcgcgaggagcagcagaacgcgcgccgtcgcaaactcgggctgagcctgaagcaccggtggaacccgtgccgaacagaggtcggcacggggtcaatgagcaattaaagcgccacatttttacaggtaaagctgtgccggcgcagttcattgtacgtgctgcaaatgaacgctgggcaaaacccactcgggctgcgcggcctggtcaacctgggcaacacgtgcttcatgaattgtaaaaattcccatatatatatatatatacatgcatacatattttgtttgcttttttaaaatcatttcgaatcacattgtaataccgtatcccgggggatcaatgtggataccatacattttttaggggg

SEQ ID NO: 41224 - DNA, 1012 bp, Heterodera glycines
  misc_feature (943)..(943): n is a, c, g, or t
aaaacttctgattaacataattaataaattgttaattccatattagttattaattagcgtcactaatatccctaattaattaattgtttctaattaataaactaccatgtgtcgcctggggaatgatcagcggcatgccagctgtgatgatcatcggcggtgacggcgtgtcgtcgtccagcagcaactgttcgcgcgacgactgttgatggtgccagtgcggtacggtgcgcagtgcgcgtgcactgtgcgctggcctacgttgcgggtgtgctgcagcagtgcctcctgcatgttgctgcaattgttgttgaaattgcacgccaagcccgctgcttgttgcactgccaatgctgctggcttaaaaattttgattaaatgatttcttttttgtaattaacctagagctctgaattctgagctttgtcctcattttgtggcatttatttttggtcgaagagaatttttttttaaataagaatttacggatttttgtttttacagaactttaagagaaattttgaccaaatccttaaaattggtataagttggataaaattctgttttaataaaaagcgcataaaacgctaatttttagggctcgctcaaggaaaaaaccaaattttttttttctttataatcctaaaaattttcgccagtgaattttccaaaaatctaagcgacgctggagaaatatagcaagcattaagaatacttctaattttgagtatttagagcagagttcccaagtgtccttatttctaagatttgtccttatttggaggggccggatcttagaaaatgaaaatgtccttatttctaagatttatcttatttttgactcgacgtgcatatttcgttcttattttggatttgcaaataggggatctacaaaattgaataactttacttatttttttattgaagcgaatatttttaattnaattcgatttttcaataaattatatttttacttcgttttctttgagtgtgaatgccccaagatgccccc

SEQ ID NO: 41225 - DNA, 1040 bp, Heterodera glycines
agatgtccggggctgcacgcgcgctacactggcaaaatcagcgtgcttgtcctccccgaaaaggggttgtaaaccggtgaaaattgccgtgatgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcga

SEQ ID NO: 41226 - DNA, 1043 bp, Heterodera glycines
  misc_feature (38)..(38): n is a, c, g, or t
  misc_feature (146)..(146): n is a, c, g, or t
  misc_feature (184)..(184): n is a, c, g, or t
  misc_feature (984)..(984): n is a, c, g, or t
ggggattgacgtgttcaaatgctaatttataagtgatntatttcactttgcgttttcttagtattttttggcattttgactctaatcctattttgagcgttggactgtagagtcccggcagcaattggacactccagacccggatntcgtcaccttcgggacggagtccatcgcctgcagttcncaacggaacagcgggtcgtccgagtcgggcgccagactgagttggacggcgcacgacacgtgggcaccggcctgctgcacgtaggcggaaccctgtggggacatgaggacttatgcatacaaaacgggagcagctcatttccttcccccgccccccgtatcaagctgactgtcgccaaactcaaaatttgtgccaaaaagttctgaatcggacaaaatacgctggaaatatgtgttgtgggctcctgcgttttaccgcgctgaaaagacttcggcacgggaaaaagtcccggcagaatttggccacttcattccggcacttatccgagtgaaaaagacgacaaatggacgacgattacgctcattgcattggaccgctcattaaagctttagcttgtgattttctgtattaaagaggaatttccgctggagccgaaaagaaaacgcgaattcccgctccaaaaagtgccaatggaagggtcggcatggaattaatgggtcacgcgcctgatggcccccggtggccccgccgcattggatgatggtcggccggtgtttggcaatgtcgcgcccgtccgggtagcagccctcgaccagaaattgctcgtagaattgggcgggctcgagccgcttcagcaacgcaatgttgtcagctgtgctgctgatggtggcactcattttgcgagtgtacaattaaaatttgagcgattctctaattgtcttaaattggtaaacaaaattagaggagagagtgcttaatgcaataactaagcaaaaatgtcgcaatcaagacgaaaatanaattaaaatgttgtattaaatggcggttttagctaccatcttacaataatttatcattt

SEQ ID NO: 41227 - DNA, 944 bp, Heterodera glycines
  misc_feature (879)..(879): n is a, c, g, or t
  misc_feature (904)..(904): n is a, c, g, or t
  misc_feature (925)..(925): n is a, c, g, or t
cttatgggcttatcgacaacactaccgggacgagccatctcccggcagcgggctcgaattggcgccacccgtgtggcacttagggactttcgcgacctgccgactgcacaggctccctggaagtttcgaaccaaccacacgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtggngatggtaacccactttcctttcggncaccggatggaccaactgcgncagcacagaaaagtcgtca

SEQ ID NO: 41228 - DNA, 1000 bp, Heterodera glycines
  misc_feature (920)..(920): n is a, c, g, or t
  misc_feature (932)..(932): n is a, c, g, or t
  misc_feature (955)..(955): n is a, c, g, or t
cattcttagcattgctcggaagcacttaaaaactctattaacctgaaatttttaaaatttatattccatgtacaaaaaaaaccagggaaaacaaaaactcgaaaaatttgagttacttccggtcatctttttttgaatttaacgaaatttttttgtaaaagaataataacaaacgcatagagaatattgaacaaaaccaacaatgcttaatttgattgagaagaacataattatggtccaaaaaccttcaggcgacattttggggcgcactcgcctcaggactcatacagtctctgctctcagttcaccatgattagttagttatttcaaatttatttaaaacgcttagaaatcgaataaaatggttagttttattaaaaaaaattatggatgaagaataaactatgaccttggagatacattacgaacaaatagtcgtacaaaattcgtgcatattcaccgaatttttgacattgcctcaattcgtcgttcctctccttcaaaaaagcgacgggtgaccgcctcagtgagggacagtgccatttccatcgcagcacatagacaatgccaagaaaaaaaaaaatttcccagcgcctatcggcaccaccggaccccctgctgctttccccaaaagtttttttggaaaaagcgctgcaaaaagaaaaaaagggggtattaaattatggctggcttcttttttattatacttttctgtttaaaaagccaattagcaagcaaacctcagatgttaattttttcttgacttccgccgttaatatttgtttgcctttcatttccaaataaaaatgctcatttgctgagagagtttggacaaatgcaagaaattttccatcagaagcattgtcttgagcacactaattgacaattgacaaaaaaaaggggagccgagtattgtgagnatatattatttnttagatattaaaatattaataanttttagaaataaaataattcgaatatatttttacgaaaaaacaag

SEQ ID NO: 41229 - DNA, 1487 bp, Heterodera glycines
tgtaagaatatagtggaaaaaatcatacgataaaaaaccttacaagtttaaaagaattatgctcagaaaatgagtttatttattatttaaaaaaatatctttttgctggaaacttggttttttatacttattttatggtttaaaaaagtagtgtaattattaaaaattaaccaaatttttttgattcacattttctcttatattattgtcaatatttaaacgtcaaaatcaattaaaatgagaaaaataaatgttttcgtcaaaatttaatggaaaataattaagaaaaatgccaatttttaatgactagccatccaagcagcccactgtctgtcgtcgtcgtcatttttaacactcgtcattgttgttgtactgctcgccgtcgtcgttttggtctttttgttgttgaacttcttgaagttgttgttcctccgctttttctttgacgatgatggttgtcatcttcgtcttcgtcagtgctgagctcagcgccggtgacccatccacccctcccttttttctggggttggcaattggtaaacgggaggggtggatgaccagtacatgactttcttgaagccttgaagccgtgcattttgcgccattttgtgaaggactcgggtacacaaattttaaaaatatttcaaaaacatttttgaaactttttctgcaattttttcaatatttttgcacccttgggttagtgtcaaccctactctatagtgacaaattaaagtagaaattagtctaaaatcgaacacaattttatttgacttatttcgagtggtaaaagcaattagttttaaaataccttctgctctttttgtggctgttgattagggctgtgcgagaagtgatttttaccggcaaccgaaccgaaaaatgaccccgggaaacgatacgagaaccgagaaatgaccccgagaaacgatacgagaaccgagaaatgaccccgggaaacgatacgaaaaccgagaaatgaccccgggaaacgatacgaaaaccgagaaatgaccccgggaaacgatacgaaaaccgagaaatgaccccgggaaacgatacgaaaaccgagaaatgaccccgggaaacgatacgaaaaccgagaaatgaccccgggaaacgatacgagaaccgaaaaatgaccccgggaaacgatacgaaaaccgagaaatgaccccgggaaacgatacgagaaccgaaaaatgaccccgggaaacgatacgagaaccgagaaatgaccccgagaaacgatacgagaaccgagaaatgaccccgggaaacgatacgagaaccgggaaatgaccccgagaaacgatacgagaaccgagaaatgacccgggaaacgatacgagaaccgagaaatgaccccgggaaacgaaacgagaaccgagaaatgacccgggaaacgatacgagaaccgagaaatgaccccgggaaacgatacgagaaccgggaaatgaccccgagaaacgatacgagaaccgaga

SEQ ID NO: 41230 - DNA, 399 bp, Heterodera glycines
tagggttccaatttttaggcaaaagcctattttttcctgagctgcccgtggcctgaaacgcacgaaaaacatgtttattttggctgttgttaagctacttttcgagttatttgtgcctgttttctaggcttttatttttagagcgtaaaaagcctaaaaaattttgaaagagactatttttgcctatttttgctttttgcccaaaatttgttaacagaaatgcaataaaaacgaaaaatacacccctaagaatcgattttttgggaattttaaaaatacacccctaagaatcgacccaaaaatttctaaaaataaaccccctaagaaatgaaaaattttccaaaaattcatctccaaaatgtatttattttcttgacaagaatttatcctttaaaaaat

SEQ ID NO: 41231 - DNA, 1233 bp, Heterodera glycines
  misc_feature (856)..(856): n is a, c, g, or t
tccaccaaatagtatcacttagtcatccctgttcacatttagcaccggtttctaaaggacgatgagtccccgcattgtgaatcagtaaattcccgacccatcttttgtttgtaccactctcgagacacgaaagtgtaagcgatccctcacatctttccccattaactcactctcgactgcaaaattcccgagagagtctcgacaaagagactgatcctcccgatttcattgggctgcttacaccggggcttttctattttagctccattaaatccttttttgctttgctaacttataaatttttttcttgttttgatcactgtcaaaacatctttcgagaatcgctctccgccaattttcgagagtctgatcaataatcaatgtattaattgccttaacccattaattttttatttttcgctataataaaattcctttctgcctatgcttcatcctccattaatctgtttgctccgttttgccctttttttctcttcgctttcaccgatcgatgctttctcttcccttccgttctttcgttcgttcgttccctctccaaaaagcacaagcggatgattgtattatgtaagcgatccccgtccaccggtcggtctcgaggcatctccgttttgtcttgagaaattaacagttggggacggatcccccccccccaaaaatgccaccgctttctctagagaatgactctctcgcgactcactctcgactgaatgaatcgagaatttccaagggatgtatttccggaattaatcgccaagtgattaacaaaaaataatcgactattgtaaaagagcacataaatccacattttcctttcatcttgctgagttcttctccnaaattagacatcggaaaattggaaaaaaaatgtcttaagataaaaaatatataatatatattttttttggcactttctcaggaaattgattgctacaaaaaactagtcattttaataagccacacattttgatcataattttgaaatttttttttcgaatattcatctctcgaaaaaggccaaaggtttgccctggcatttgtaaattatgaatttttcggtaatggtgagggtcaactgggccttgggccaggttttggggtataactccgtccataattgaccgacaaaaaattttcaggcaaaatttaaacatagggcactcgaatgatatcaaattcatttaattcggacatcaatcatttggttggggctca

SEQ ID NO: 41232 - DNA, 596 bp, Heterodera glycines
attcatttcatttcaattaattcattcatttgtttcctttctcctctgctgctaatttgagcttcaccgggtaattctctaattaattatgaccaattaaactctcctttttttgttttagaacattcctctggaaataattggtaaaactttgtaatgaaaagagagggcgggcaatttgaagaagaagatcaattcacttcacttcgattccattcacattaatccatcattcttaactatgtacgtataattttgcttgttattgttattgaccattcgtttttatcaaaacgattaattcccccgggggcgtaaataattttatttgacacccaaaacaaaagtgtccgtccgtccgtcccttttccctttgcttttgcccttttgcactttttgttttcctccgattgtttgccctttcccttcgctttttctgtttctgtttttgtttcactttcattttcactgtttttgccattcattcgttcgttcctttcatttcatttccattcacattttttcactcttttttctcatttctctctttctttcgtccgttctttcgttcgtttgttacactctctccccccccc

SEQ ID NO: 41233 - DNA, 827 bp, Heterodera glycines
tgttttggaagtggtctccgtttctctgggaaaaatcgttaaaaaatcctaaaattcaaaaacccgaaaacctacttttaggcctagctcgaaaagtttcgaaaattttcgaaattttaaaatttggaaaaatcgagctcattaaactctacaataagttcgctggcaccccctccctcagaccaaaccctgacgtggtattcacctggtactgaagtgggaaaaaaaattaactgagtctccgtgtctgtacgggtccgggatttggtctgatcaaaaaataaaaaatactggattatagaggacacttctgcggagtgccctcacagcgggaattttttgatccgagtttcagaaaaaaagttatgggccgtcaaacgcacgaaaaaatgagaaatccgtccctgggactcagtcgtccgcgctgattttttctctatagttttcccggatgcgcctcaaaaagttgtaagacccttccactactttcagggcgctcccggccttcggccgggagattttgtttttgcagacgaaactccttgtcaatataacatatatagtaactagcgggtgcgtgaaccgtcggctatttcgctggataaagcgcttcgcgcttcttgagcttcgctacctagattagctctggttgtggagatttggattttttaaaaaattatctgggacttttaggccgcttcgcggcctcgaacgggcgcttcgcacccgtttttttaaattttgttgggctaatacgtgcgcttcgcgcccgttttttaaattttgttgggcttatacggacgcttcgcgcccgttttttaaatttt

SEQ ID NO: 41234 - DNA, 1015 bp, Heterodera glycines
  misc_feature (782)..(782): n is a, c, g, or t
  misc_feature (950)..(950): n is a, c, g, or t
ccattgggacttaaaaggggttacggtgtacaatcaacatttttcggtctcccagaggaaaattatttattgacctttatgcacaattttaatcataaattaggatttaattgtacctcattactaggacgctaaggttctaaaaccaacaaaatcacttttctagtgtcgaattgccacaaatgccggcgaaatatttcgaaatgtttgcgtaaggctagaaaaacaaatctatttgattctttagtggttaaaatattgcgagtttttactccaagacgttagagggcaatttgaataacgaactcataatctaattgcgaatgctatctaattaaaggtagcgattagcagcagaaaaggttcgtaaatactgataggctaattttgccaaggattatcgtcctattttggccattggacttaaaagggttacggtgtacaatcaaaaaatttcggtctcccacatgaaaattatttattgaactttatgcacaattttaatcataaattaggatttaattgtacctcattactcggacgctaaggttctaaaaccaacaaaatcacttttctagtgtcgaattgccacaaatgccggcgaaatatttcgaaatgtttgcgtaaggctagaaaaacaaatctatttgattctttagtggttaaaatattgcgagtttttactccaagacgttagagggcaatttgaataacgaactcataatctaattgcgaatgctatctaattaaaggtagcgattagcagcagaaaaggttcgtanatactgataggctaattttgccaaggattatcgtcctattttggccattggacttaaagggttacggtgtacaatcaaaaaaattcggtctcccagagggaaaatatttattgacctttatgcgcaattttaatcataaattaggatttaattgtacctcattactangacgctaaaggtctaaaaccacaaaatcacttttctagtgtcgaattgccacaaatgccggcgaa

SEQ ID NO: 41235 - DNA, 626 bp, Heterodera glycines
ccccgcccctcctccttcatcacccatatataaatgcgctctgccgccaagaccagcatcagaccccattcttccctccgctcactccccgcccaatccacacattttccaaccttccacatttgcgcccatctcatccgatctcatacacaaaattctgttaatataaaagagttggtacattttataaatagatttaaatattagcttggagttgataaagacattcttcgaattcatcaaaagagaaaagtaattattaatattttacagaaatatcccgtccagaaaatatttattcgattggggggaaaaagaggggggggggggaatccaaaaggtttcattatcatcagcagaactcgttaaaggatggaagaagagagggaaaaggcgaacaacgaaaatggcgaggggggggggagagcccggccacccaacaccacccaatattcatttccttgccaagaaagctcgtcaagaccacccggacgggaagcggcgctaggcgatggccaacaagcggacgcgcgttgggccaaagtaacaacacacctcccctccccaccccaccgccccccaccaacgccaacatcccatgtcttttgctccttcaacatcactta

SEQ ID NO: 41236 - DNA, 1348 bp, Heterodera glycines
caaaaataattcaaaaacccacttcgggtttcgactaccaaaaaaaatggtcaatttccccttgggttactgtaattttcggaaatcggtcctccattgaaggaagccgtagacacttgggattgtttgaatttttgtaggaatattgtataactctttctgtccgtcattttttctgcaaaaaaaattttccagcatttctacgaattctaaaaaatagttaaattcaagatcgattagacgagaagaatatgagaaatggcaaaatttggtcgtcattaatttattaatcccaaaaactacagtgttctaagggaaaattgaccatttttggtggtagtcggataaaattatcacttaattttaaaatgatattgccaaaaatggcgttttatagcaaaaaaaaaaattaaatttaaaaattaaatttggatttttgtctgagacggagttggcccattatatacgaagacggagttggcgagacgaaattggctcattttcagatgaaattaacccagacgcagttgatccctacgaaattgtatgtcaataaaaaaaatcgttgcaaaaaaaaaattttaaaaaatttctgacataatttttaaatttaattatcattaattttaaatttaccggcgtaattgtgcccgaatccctggtcagggggcaccaccctgtagaacaggggcccatattgtgccaacaccgatgccgcggccagcgcccaccaattcccgatgctgccctgccgaacatccccagcgatgggcccttggttgatgaactgcggatgttcagcaagttcaccaggccggcgccatcggaccgccactggctctccagtgaagtacaattgaatggactccaccggaaactccgggtcttcaaagagaccatctctctacaatattaacaaaataattatttattacttattttaaattttatcaatttttattgcctggagccaatagtctctaagcagctcaaatgattgggacggtgtctcacccgacaccgggatgaacccctcaacctaatgaaggaataaaatattaaatttcaaattatcattttttgcaattcacggtacatctctttcaaactcattattttggatgcgttccaaaatttcttcgccaacaacgtcaaggacattttccatatttaaaaattaattctaaatttagtttatcgccatatacataggattgcattttaattggaaatgaaaaataacaaattaaaaggcaataaaataatataaataatgcattaaatttttgtgagattagtgagaataggcatactgtacatcacaaaatacggtagggatagggaaaaa

SEQ ID NO: 41237 - DNA, 939 bp, Heterodera glycines
aatggctatctctttttaggaaattttctatctcccattccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaagacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaagacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaattcgttccggagagcctcttcaaaattttttccattaccctaagagctgcagaaattgtgaattaattctcagaaaaatggctatctctttttaggacaattttctatctcgtaaccccgatgctaat

SEQ ID NO: 41238 - DNA, 777 bp, Heterodera glycines
aaagcttaaatgggaatcattttaaaaagcagaatctttcattaataatctaaattattggaaaagttcgccatttagctattttttcgacaaatatggcataatttgcttaaatgcaacaaaaaattttacattgttcgatagccaaaaatttttctctattaggcctgcaaaatttcaataaaagattattgtatttaatataagttatggctaatagtacgtattttcatcgactttttcgaaaattgccaaattgaaattttgcagactaatagagaaaaatatggtctatcgtaccataccaagaatgcaaaatttgactgcttttgagaaatgttattccatattttgtcgaaaaaaatgcctaaactggcagatttacgaaacaatccagcacgaaatcgttctaattatacatatttaaaattatttttaattaagtattttaattgtaaatccattttttaagcacctgagtgaataataacgggaatagcagtgcgccaaattcaaccgagatcagtaggccaacaagtgtagaaaactgctcgttttttctgcctccaaataaaatttttcattgaattttgtaacaacaaaatgccaaaaaattgcctgtcattttgtcatgaaaattgcaccattgtaccaacactgtgggccaaaacagtgccaatgatgcgccaaataatgtgacagcaacggtacgcaaggacggcacattcagcgcgcaaaaggcaagtccggagccgaactaattggaattttaatttt

SEQ ID NO: 41239 - DNA, 850 bp, Heterodera glycines
attaaacggtctatcatttttttgatatgtccctccgccctcccattgccttccatccaaacaccccccccccccgagcccaatactccgattttgagcggataaataatgaaaggggaaaagaaaaataatcaaaaaagaggggaaaagggtaaaaattattctaaaggccaaaagggagagaaagaagcagctgatgccggaaaagcaaagcagcaaaaaaaaaacaattgttgttttgtgaccattacgattattggtgtttaaacgattattttggacactgttacaaaaacattcgctacacaaaaggacggagaaaatggggggggggggaggaaataaataacggacggatgggaaatcaaagggcgagccgactttggaaaatagtacaaaggataaagagagggggaaagaaatgagaggaaggagagagagaagggtgggagagaaaaagagcataaattaaaaccaaaagcaacggaaggggaaaaagggggggaaagggcgacgaatgcgcggcgtttcaaatacctattgttaaatggtgggcccattctgtgcaaccgcagtaacccactcagaaatcactttaacacattacaaaaagatctccaaaaggaaaaaatgggaggaagagcgaataaccttctattatgctatcggtatatataataaaaatgctctagcccagaaaaaagcgactctcttttgacgctcaatgttctactgatccgacagctcactgccatgataggaagaggaattgctgcacatagacctcttagctgtcagggaattttgacttctacactctattccacaaaaatgtatatctcttattctg

SEQ ID NO: 41240 - DNA, 706 bp, Heterodera glycines
gcttcatcgaacgaggcattctcgaaagcggccgtcttgtcgatgatgcgctccattgaattcgcgacgagggccacatgaccactacgacgtctgctgttcgaccactcccgccgccctccagcccctacctcgtggcgctgacggggctgttcgcgctgttcaactcagtgcgggtactggcctacctgcctaccctacacgcgatcttcactagcggcgacagcagccagcattcgttgttgacctggctgacctgggtgggagcgaatgcaacgatggccgcctggctctacgagcagaacgggcgaagtatgaaccgcgccattgtcgtcaatgcctgcaactcgctcatgtgccttgcgacgtcgatcctcatcgtggcctaccgcttatgaggctctgcgctagtagcagatgcggtgatgctgaagtgtcgccaggcgcttgccaacaacgactatttcagcagcgtcgacgactggaatggtttgatctgaagcggtcgcgcggctgcaaagccgtcactggctttgcgcgcgcacacgccgcaccgaacgccccggtccagggctgaagctgccggccagcgtgcaacagcttgaatgaccgctcttggaaatagctgccactgaatcccaaacggcgaacgaccgagatcagcctgaagctgacgtccgcatgcgaacgtcgactttgcgcggat

SEQ ID NO: 41241 - DNA, 612 bp, Heterodera glycines
tcaaaaaatacactcctaagactgacctaaaattaaaaaaaaacttaaaaattggggcaatggtaaagttttgtggtttcttcgaaaaattatttaaaaatttaagactggaaaatgtgctgatcacgaatctaagctcgaattttgcaaaataattgattttatctatgattttttatcaagtactagattttttccaaaattttttagtcgggcgtaaaaaaacgcacaggatgttgtagagctcaaaaagtgctttcgaatgagctatagaatgtatggagaagtcatgtttttagttatttacgattttttgaaatttaattactagcccttaagggtcatatgagacgggggtctggggttcgagcccgcttggctgtgtttattaaatttttaaacttatttttcgaagaaaccacaaaacttattgccaaaattggtaaatttctcaaaaattcatcctcaaattttttttcttaacaaaattatgtcactattcgtcattattttggacttttcgccattattttggcattttttagcatttttactatgtttttcgaaaaaaatggtttgaaaaaatccagacgggggggattatttttcaaa

SEQ ID NO: 41242 - DNA, 1130 bp, Heterodera glycines
tctaatctactcaaaacggttcagaattcaataaaaacattattcacggtgcgaaaaatggggtatgaaaagtttattgggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattgggggaaaaaaagactttacaaaataatacccccggggaaaagggagtgggaaacatgatttcaaaatttttaatttttttctagtctaatctactcaaaacggttcaaaattcaaaaaaaaaacattcccggggcgaaaaagggggtttaaaaaagtttattggggaaaaaaagacttttaacaaaaaaatacccccgggggggaaaggggggggggaaaaattgaatttcaaaaattttcaattttttt

SEQ ID NO: 41243 - DNA, 1528 bp, Heterodera glycines
  misc_feature (496)..(496): n is a, c, g, or t
  misc_feature (514)..(514): n is a, c, g, or t
  misc_feature (531)..(531): n is a, c, g, or t
  misc_feature (540)..(540): n is a, c, g, or t
  misc_feature (544)..(544): n is a, c, g, or t
  misc_feature (547)..(548): n is a, c, g, or t
  misc_feature (626)..(626): n is a, c, g, or t
  misc_feature (630)..(630): n is a, c, g, or t
  misc_feature (635)..(635): n is a, c, g, or t
  misc_feature (638)..(638): n is a, c, g, or t
  misc_feature (655)..(655): n is a, c, g, or t
  misc_feature (657)..(657): n is a, c, g, or t
  misc_feature (663)..(663): n is a, c, g, or t
  misc_feature (668)..(668): n is a, c, g, or t
  misc_feature (681)..(681): n is a, c, g, or t
  misc_feature (698)..(698): n is a, c, g, or t
  misc_feature (707)..(707): n is a, c, g, or t
  misc_feature (711)..(711): n is a, c, g, or t
  misc_feature (714)..(714): n is a, c, g, or t
  misc_feature (744)..(744): n is a, c, g, or t
  misc_feature (1091)..(1091): n is a, c, g, or t
  misc_feature (1096)..(1096): n is a, c, g, or t
  misc_feature (1149)..(1149): n is a, c, g, or t
  misc_feature (1176)..(1176): n is a, c, g, or t
  misc_feature (1179)..(1179): n is a, c, g, or t
  misc_feature (1283)..(1286): n is a, c, g, or t
  misc_feature (1304)..(1304): n is a, c, g, or t
  misc_feature (1312)..(1312): n is a, c, g, or t
  misc_feature (1317)..(1318): n is a, c, g, or t
  misc_feature (1324)..(1326): n is a, c, g, or t
  misc_feature (1329)..(1329): n is a, c, g, or t
  misc_feature (1338)..(1338): n is a, c, g, or t
  misc_feature (1341)..(1342): n is a, c, g, or t
  misc_feature (1347)..(1348): n is a, c, g, or t
  misc_feature (1364)..(1366): n is a, c, g, or t
  misc_feature (1373)..(1374): n is a, c, g, or t
  misc_feature (1378)..(1383): n is a, c, g, or t
  misc_feature (1387)..(1387): n is a, c, g, or t
  misc_feature (1392)..(1392): n is a, c, g, or t
  misc_feature (1409)..(1409): n is a, c, g, or t
  misc_feature (1420)..(1420): n is a, c, g, or t
  misc_feature (1422)..(1422): n is a, c, g, or t
  misc_feature (1426)..(1426): n is a, c, g, or t
  misc_feature (1430)..(1433): n is a, c, g, or t
  misc_feature (1449)..(1452): n is a, c, g, or t
  misc_feature (1454)..(1454): n is a, c, g, or t
  misc_feature (1467)..(1467): n is a, c, g, or t
  misc_feature (1470)..(1470): n is a, c, g, or t
  misc_feature (1478)..(1478): n is a, c, g, or t
  misc_feature (1483)..(1484): n is a, c, g, or t
  misc_feature (1490)..(1492): n is a, c, g, or t
  misc_feature (1504)..(1504): n is a, c, g, or t
  misc_feature (1507)..(1508): n is a, c, g, or t
  misc_feature (1513)..(1514): n is a, c, g, or t
ttttccccccccccccccccccccccccttttttttttttttttttttttttttttttttttttttttctttttttttccccccccacctttttttttgtgcctttttccaaaaagctccccccaaatttttgccgggggaaacttggtggggaacccctcacaaaatttttttttaattttttttttaaaattttttttccctggggggaaccaccgttttttcacccctttccccccccagcccttattttttttttaattttttttttccattttttccccccacgtttctgggctgatccgaaggccccccaatttttgcagggaactgctggagaccccttcaaatgcttataattttttttagattttttgcctggaggacccagttcttcacactacccccccagcattatttttttaatttattttttcattttatcacacaacgttctagactgatcagaagctcaccaaatttagcagggaaactncttaaaaccctacaaatncttataaattttcttanaattttttncctnaannaacacacttcttcacacttaccacaccaccattatttttttttaattatttttttcattttatcacccaactttctanactnatcanaanctcaccaaattttccananaaactnctaanaacccttcaaatncttataaattttcttanaattttttncctnaanaaacacatttcttcacacttaccacgccancgttatttttttttaattatttttttcattttatcacccaactttctaaactaatcataacctcaccaaattttccaaaaaaactcctaaaaaccctacaaattcttataaattttcttaaaatttttttcctaaaataacacatttcttcacacttaccacaccaacattatttttttttaattattttttccatttcatcacccaactttctaaactaatcacaatctcaccaaattttccaaacaaacttctaacaacccttcaaatccttataaattttcttaaaattttttccctcaacaaacacatttcttcacacttaccacacaaccttaaaatttttnccctntttaaaaactaattaaaaatttttttaaatttattcatctccctttttaatanaaaaatcatcacaatcctaaaattaanttntaaataaaattttatactctttagaaaactttctcaaaaaaatatttatgaaacaaaaaaatccattttttcaagtgtccgtttggggtactcaaacaattatnnnnaccaaaaatccaacccanaattaaantacannctatannnaanctattcccnaannattcnntctccccataaatctnnncccatcnnttcnnnnnnactnccccnaaaacaaaaataaatcnattttttcaantntccntttnnnntactcaaacaattatnnnnancaaaaatccaacncanaattaaantacannctatannnaaactattcccnaannattcnntctccccataaatc

SEQ ID NO: 41244 - DNA, 1288 bp, Heterodera glycines
cgctaactgtgcaggcactttccccgtccggactttcctttgacaaatgcgcacattttgagccgtttgctcatttccaattgcactcacccttaagcacgtccaccaccaaactgtcactggaacagtcgctgccttcgccccccgtctgaatccctcgcgccccgaaagtcggcccgttcccattcagtcccatcagtcccgagctggtcgtggtggcgtcggtcgacttcgtccacaggtcaattcgcagtgccgtgccctcctcgtcctcctcctcccgctcgccccctccgtcttcgctctcttcctccgctttcatcgcgccttccgccgctgcgttcagtcgcccgacctttcgaattgtctcttccaccgctgtcgaggccatcttcatccgcgctcgcttgtggccccgttcgaaagtgttttgcagacgctggttggactcttcgatggtcagaggcgagcagaagtgatcggacgcgtcggggaagtcggggtcattgatcagcaggtcgtttttgaccgcgatgcacggcacctgcagctttacaggggaacggaaatggtcagagtgttcaattgagcagtcggactaattattgataaaacccaattaagataccaattgattgcccacaataaataaatgttttagagcgaattcctttgactgattgataaatttttgaaataaaaaaaattaattctcaccgctggcagtttgtccttcggaaacacacgttggagctgaaatcgcaattatgtaagagaagagttcgcattcccattttacccggtgtctgagggcacggcacgccatgcaccggtaataaacggtggtaagccccggattgggttggtgaaacgcgtcttgtaggcgaactcgcgtctgcgtccggggtgtgagcgcgagtcgtagaccaaaatctgtcggccatggccactgggcgcgtagctgggcttaatcggtgtaaaaggaagctgccttcgctggtagacgccgggcggagcaagcgaagcggcagagatcggcttcatgtcgactatggaagcggcggagtgcggaggcgaagggctcgctgtatgggctccgtttgtgcttaccggactttcaatctgacaaaatcacaaataaagcctcgcttccgtttcttgctgggctttctaaccgaatttggtgatgtcgccgtggaactggtcaaaggcattgccaaagtcgccgtcgaagtccgcaacatgtcaccgttgtggcaacaggcgccacagcagcagcggacgaagc

SEQ ID NO: 41245 - DNA, 983 bp, Heterodera glycines
  misc_feature (830)..(830): n is a, c, g, or t
ttcatccataatggggccaaaaatcataggttaagaccaatagagggattttagtttcagccggaatttctataaaaatgttcgtgtgtaacctatctttgtctattcggataagtatgaaattgaaatattcgtattacttttcctcccttaaagctttataatgaaagcgtcgttgtatatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgttcaattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaattcagcctcttttaaatcttaattttctgaaacccgaatttagaaagtatgaatgtatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattacttttcctcccttanagctttataatgaaagcgtcgttgtctatttaggatttgccgtcgcaattctgtaattccactttggatccaaaggaatttgattcgcttttacaaaatagacagtgccgaaatttgtagatcggctaaacctaaactgaacataccatagca

SEQ ID NO: 41246 - DNA, 926 bp, Heterodera glycines
ccctcataaacaggaaaacacgtttttacctccattagtttctccgttatcaatcgggccgataaaaagggatttcccaagaaaaacctcgctaataacgatggattagctatcgacaaagttaaggcttggtctgccattatttgcatgcttgtgcaaattttacgaattgtctccgtaaacagccgctgagaccggtacggcaaatgcttggtccgacacaattaattcgcctggctcgggatagcatacgggctgactatgagacgaagtgttttcaaaactcaatgcaaaagtcaccactttccgtcgtccatatcagacttgcatattcaccagaccattttgacaaccaaacaaaagagcaaagttgggtcttgtcgggggtccaaatcagactaatttttacgcattggcatttgcctgatttataaaagcaattagagcactctccgattggtgtattcaacccctccattccatgacgtgtaaaaacaattgtcttatacacataacaattatcaatttcttccgttctccaaaacaaatttgatggccattttccccacccaatttctagggaattatttgttgccattagcttttcgtcattaacgtataattcgcctgctggagagtccttatcaactgccattttcctgcaaattgcagtaggcaactaccaaatgaaaggcacttatttcttcatatgttccaccaaaaaatcctctcctccttgaaatgcgcgttaaaatgcagctgcaggctgtagcttcggttttttatttgtacagtgtttggtcgatatatatttaatgcaaaaggaaacggggacctgcgttggaacccaattagggaaaatagggtcgacaggcaatgaccaaatactggtgggaagatcccggaaggatatcatgggctttgcc

SEQ ID NO: 41247 - DNA, 68 bp, Heterodera glycines
agagatcgtaaattgtgtgcgcgaatggaagggaatggtgagagacgggggggggggagacaaaatcc

SEQ ID NO: 41248 - DNA, 954 bp, Heterodera glycines
tagatttcgattttcagcgatgaaattttggatttctcatcgattaaattttggattttgagtgaaaaattttggtttttcagagattaacttttgaatttttagcgattaaattttgaattttgagcgatatatttaggatttacaacgattaaatttttattagcgattaagttttggatttttagtttaaatttattaaaccattttttccatagatttaaatttattttttatgtgtaaaaaacatgagtgtcaaaaatacgccacgctcaagaccatgaaattttggcatttgaaaaaaatcgcttttatataaaaatttatttgtaaaaaaatttataatataaattccgccgcttcaaatatttcataacaaaataacggaaagtggaaaaaattgttaagattttaaatttattcttatttttttgtgaaaatggagcaaaataagggtcagcttcttcgtgtgccatcattttgtgctggaagaggttggccaacagaagcttcccgggaaggcgcataattttgcatttgtcgatttgaattttggaccaattcgtcggccactgaattgaaattttaaatatgttcaaaattttattactatttgctatttgctaattttaatttaaaaatattttattcaattttaattgccaatgatatttttctttaaagacagacatttccgacctaaaaataaatcggcttcttattgatttgtttatttaaattaaaatgatcaaattgaaattaaaataaataagcgatttttacattgttcttcgcgctccaattccttgaccaattcgctcatattttcggtgatcgcatcagccgcctatttaatgttcaaattaattaaattaaatctatttaaattaaaatttatttatttaaaataatttattgagtccccaaaaaatgcctgcaaaaggtcgccctgca

SEQ ID NO: 41249 - DNA, 1093 bp, Heterodera glycines
  misc_feature (893)..(893): n is a, c, g, or t
  misc_feature (975)..(975): n is a, c, g, or t
gtttgagtaccccaaacggacacttgaaaaaatccatttttttgtttcataaatatttttttcagaaagtgctctaaagcgcaccaaattttatttacaacttaattttagaactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtccagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtngtcctccattgaaaaatcgattttttatttcataaatattttttcagaaatgctctgaacgcaccaaattttatttacatgntagtttaggcactctgatgcttttctatcgaaaagggagatgaataaatttttaaaaatttttatttccttttttaaacaggccaaaaagtttaggccttaactttttttttcaaaaa

SEQ ID NO: 41250 - DNA, 1009 bp, Heterodera glycines
atagcgtagaaaacagcttcgatatcaagaaaccaacgttaagtccagaaaggaatattttataacgatttcgttttgttttggcattatgataccgaataactttcggaaattatggaaacaaaattggagaaattcgaataattttttgactgcaaatttttttccttttttgaattgggttcataaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaaaatgtggagtgaaatgtgaaatattgttttcaccacaagg

SEQ ID NO: 41251 - DNA, 1001 bp, Heterodera glycines
  misc_feature (956)..(956): n is a, c, g, or t
aaattatttttttcatttgatcacccaacattatagactgatcgaatgctcaccaaattttgcagggaaaacgccgagaaccctacaaacgcttataaattttcatagaatttttcgcccggagggaacacagttattcacacttaccacacaagtattattttttcgataattatttttttcatttatcacccaacgttctagactgatcagaagctcaccaaattttgcagggaaactgctgagaaccctacaaatgcttataaattttcttagaattttttgcctggaggaacacagttcttcacacttaccacaccagcattattttttttaaattattttttttattttatcacccaacgttctagactgatcagaagctcaccaaattttgcagggaaactgctgagaacccttcaaatgcttataaattttcttagaattttttgcctggaggaacacagttcttcacacttaccaaacaagcattatttttcgaaaattatttttttcattttatcacccaacgttctagactgatcagaagctcaccaaattttgcagggaaactgctgagaaccctacaaatgcttataaattttcttagaattttttgcctggaggaacacagttcttcacacttaccaaaccagcattatttttttaaaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattattttttgtaaattatttttttcattttatcacccaacattctagactgatcggaagctcaccaaattttgcagggaaactgctgagaacccttcaatgctttataaatttcttaaaattttttgctgnaggaacacagttcttcacacttacccacaccagcattattttttt

SEQ ID NO: 41252 - DNA, 908 bp, Heterodera glycines
gcaacgaatgactgagagaatgaatgaatggtgcgtttaagcctcccccggggggggggggaattttgatggggacaggggacacttttgactgcatggatatgggggaggatgagaataagcttcctctcctgcctctggcgctgcgggcactttgacgacgtctctgtgccgccgtcgccgtaagaaaatgggcgtggcacaaacacaaaagccgcggcgccggcggggaggcaaaagccatgcttttttgtgcggtggctttaagcgggcggcggcggaaggcaaacggcttttccttttccccatcccacaattagagaagctttgccccagcttctcactcctttccctttttaccctttcggcagagcaattctaattgtttctgctttttgtgcactctctcttttcctcctcctctctttcttttcctacgtatctttttttctcttcctcattttcgtttcttcattattccttctttagattcatcttccttttgtctttcacaacttttcttctttctgtcccttgttttctctcttctatctttactggactctctctcctttttctccaccttcccctctctctgtccatcctctctctctctctccccctttttctctgcctcctttctctctcctcttcttcattcactcccattatccctcattactttccctctttttctttcactttattttttatatccatccttctcttttatctgccctctttcttcatcacttttttcttttctcctttatctctcttccattccattcttctctttatttttcttctccatttccatctctaactttctcatttcttttcctttcttttccgccttcctcttctcttccttccattctttgctctttccatttttgctcttcttt

SEQ ID NO: 41253 - DNA, 293 bp, Heterodera glycines
gagcaaaagagaggagacgaaagtgaactgaaaatatatttttatactttgtgggatcagttccaaatgcacaaaaatttggtttctaaattcaaaaaaaaactgaacaaatgtttcagctgtgacctcgagcgttaccaatggacgcagacactcggcgaattggaagtgcgcgttcccttcccttcgcttggctttccgctcaaagtataaatgctgcccaatcggaggacagagaaaattattatttgaaaactttcactttttgacaaatggtcatttatcgaacagaa

SEQ ID NO: 41254 - DNA, 1100 bp, Heterodera glycines
aaaatcgtcaccgattacgagtgggtgcccaaaacatttggcattaaaaacagtcgaaaatcgtcaccgattacgagtgggtgcccaaaataaatggcattaaaaacagtcgaaaatcgtcaccgattacgagtgggtgcccaacaaaatggcattaaaaacagtcgaaaatcgtcaccgattacgagtgggtggccaaaaatggcattaaaaacagtcgaaaatcgtcaccgattacgagtgggtgcccaacaaaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaacaaaatggcattaaaaacagtcgaaaatcgtcaccgattacgagtgggtggccaaaaatggcattaaaaacagtcgaaaatcgtcaccgattacgagtgggtgcccaacaaaatggcattaaaaacagtcgaaaatcgtcaccgattacgagtgggtgcccaacaaaatggcattaaaaacagtcgaaaatcgtcaccgattacgagtgggtggccaaaaatggcattaaaaacagtcgaaaatcgtcaccgattacgagtgggtggccaaaaatggcattaaaaacagtcgaaaatcgtcaccgattacgagtgggtggccaaaaatggcattaaaaacagtcgaaaatcgtcaccgattacgagtgggtgcccaacaaaatggcattcttcatttttcagcaatttcagaccacagaacacagccaaaaaatcaatgttttctcccgaaaaacaatgaaattcacaaattttcagtctgacaaaccaaaaaaaaggggggttttttttttt

SEQ ID NO: 41255 - DNA, 853 bp, Heterodera glycines
ataagtataatattttattagtgtttttcttctcgaactatactatatgattacctctttttggttgggtgaatttttccttttctttctgtgtaatctactcttgatcgcatttacttccatatttttaacattcttttctcatgactggagtgttgacaattttatcttcatattttaaattattttttataatacccctgttataaagaatggatgattatgatttcgaaattctcttttttttctaatcgtaatctactctgaatccgccataattcatccgcaaccgcattcatttttctgaccaacgcctatgagaattgttatttttgcattttgacttaaaattttttttttcctgggcgacagaaatggcacacaagattgatattctatgattattttactaggttacctactcaatcatagtaaaattacttttatgctttaattttttgttatcctaatgcttgaaaatttcgttcttgaacactgcttaattatacaaaatgaatgccttccgactcgccatttccaacagtttataacattgtaccttctttactatgataatcgacactcttgaatttataactttatcgtatttgttattggtaagaagagttatgattaattaaaaactcattttaataaatagatatttacgttacctactacctggtgcccttaaatacaattactctatctaattatgcacttttatgaagtgacaaacattcgttatatcccatgatattcctaaattacattaacgaccgcaaagcatgaaaataaactgaagtatctgtcttcttgactctatgtactagtgcgccaagctcatgccgac

SEQ ID NO: 41256 - DNA, 871 bp, Heterodera glycines
tattttttagttggtctgtcgcccgccacaaccgaaccttggccgtttaatggtttttgtgaaaagaaatgaagaattttttataaaaatctcattataatttattggaatattattttcattttacctatggacgattttaaaaaaccttacaacttcagaggataaacatatttaaaagctcaaggaatggcatcggcaaattgtgcagttttcttttggaaaccaaatgataactgagaaagtttaatttttctttcactggagaaaatttgaaggaattcagctgcagatagagattaaattatcaggatatcatggtataaggtcggcaattttatttatttaattcgaaatgaataccaaacggccaagttataaaaaaatccgtattctgattggcatttgatatttatatttacgtaaaatcttaataaatttatttttaattaaattcttatttcatttttactttataaaattaaatttgtcttccattccttcattttctggggcgatctttggttattattattaaattgtttttatcccctatagtatccaatttttgggcggtttccatttttctcgtatccaatgtatgctatataatataaatttttgcagttattacattacttttttatataattttattcaatatttacttttttctataatttctgcattgttcaatttttatattcatttgggtgaatcaattttatccatagccatggatatggcaaaaatatatttccatcgctcatggattaggggctataagagggataagaataaaaaatataggtattaaacaaattttgtagaatcctcagtctttaacattaacgccccccccccccccttc

SEQ ID NO: 41257 - DNA, 963 bp, Heterodera glycines
aattgaataactttgtttaacgatatgcaaaatttcatttcggatttataacagagagagagagagagagaagaaattgcacgccaatatgagagatgtatttttctctgtactctcaatttattggttcatctctcgatttttgggtggtggtacagacagctcacatatatccttcaattggaagcgcaggctagtagccaggggccggggaattctaccccccccccatccggaaatgaaaaattgttccaagaaaaaattgccacttttttaaaaattttaattaatcttaataaaaggtattaaaattaaaaaaaaaatttcggcgtgcttagcaggataagaagaccccccccccccattttaaaaatgaaccttatgctgtcgctgaaaggtcactaataacaattgatattaatgagggggcaaaaaataattcacggcaaaacgatgacccaacaaaatggaaaagaacagaaacattttttgaatttttttttattaccatttttatttgagcaaaaagctgacacagacaaaaaaaagagaaagaaggataaaagagaaattagagaaaacagaattttaatttcggcggttaaatctctttgaaattccaccgccacctgaaatctctccttcaaatgtccgatttgtccattatttcccatccaccggaaataatgccctttagcgatgatttatttggcttttcatttttccattaaattatttgccaacgcttttcccagataattaaaataaaataaatttcagtttttattagtgttaatttgtgatgatttacgcccctctgttcaactgcttttcccattttccgcttgtccataaatcggcaaccgaaaaaccaccaaaatcattcattttacatagatcaatcagtacttttatttttttgtgaaaaacatatcaatttgtttctcgtttcatttttgcttg

SEQ ID NO: 41258 - DNA, 1162 bp, Heterodera glycines
  misc_feature (95)..(95): n is a, c, g, or t
  misc_feature (184)..(184): n is a, c, g, or t
cgcatcgttcggggggactgccccgaaaacaaaaaaatcgattttcaaagtgtccgtttgggtactcaaacaattatgaggagcaaaaatccacngcagaattaaagtacaggctatagggaagctattccggaaggattcggtctccccataaatctgggcgcatcggctcggggggactgcnccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaacaaataa

SEQ ID NO: 41259 - DNA, 991 bp, Heterodera glycines
  misc_feature (958)..(958): n is a, c, g, or t
tgcttctgtcccctcccatgttgtgaagtgaaaaaacttttccaatcaaccgactcgggatcgaaaaatacgtgtgtcatttttaaaatatacttttcttaaaatgtaatgtaagaatacaacttccccagtgaaatttaacgaattcaccaaatggtgtgtgaatttcaattgtaatttctgaaattcgtttcgactgtagacgatgaaaatactcggtgctatatataacttcactaattgatcctgggtcatcgacgacgttaactattcttaagagtggggccatctggttgccgataattgtgttttcgattaaatttggtgcataaatgtatagctgccttacacctcccgtcaaatccggcatataagtcgcctcttccgcgtgaaatagccttgtattcttaaaccccagaacatatgcgaggtgttttgacaaatctatatgggtgacggcagaggaaagatagacaataaatttttgatcaatgctgtcatattgaaattgaacatcctcattggctagtctttctcttttttgtagtcctttctcagcttcagatacttgtctattttcaatatctttacgtttaatatgctcacccaaagcctcattaagcctattcactatcccgctaaaacccttttccgatttatcattatatccctcgagagttgatgtatatttggtctttgcctgtctggcgattccctttgcgacgtcggctgatttctttgcttttttcaagtcattcttttccacatgctccaatgttatgtttttggctttatctacttcttcttgaaaagacttaagttcatttcgggatgtttgaatttcggttcccatctcaaccattttgtcaaaccaaatttttatatcaggctcttctaaaatgtgaggatttgtttctcgtagtgtgtttagttgggtttggatggaatcgagatattngtgatctgattaaatgtctttctacgtctctcc

SEQ ID NO: 41260 - DNA, 996 bp, Heterodera glycines
aggcacataaaacttggcaagcgtacgccttgcagaaaaaaagtgtcaaataattaattgaatttttggtaattatggaggtggcttttcctttgattattccatagttctaggcgtttacgattatataagaaagatttcaacatttggagaaaactgtgagcaaaaaatttccttggcacttttctagtcagaaaatttaattgacgttggcaaaaaaaattgaacactttttgtaaaataggagaaaccaggcatataaaactcggcaagcatatgaagcagaaaaatgtgccaaaaatgaattgaatttttgcttattatggcggcggcttttcctttgattattccatagttctaagggtttactattatatctgcaaaatttcaataaccccaaaaaattaaggccagaagaactcataaaagctgattttttaaataatttttttggttttacaaaaatttccagcttttctctcccagcgggcaggaaaattatttcaaatattctgttaatccatacagtttaatatcgctacagtgagacacttcaaaaccgtggcaacgaagataatcagcaaactgagtgatcactaaatggctaattttgtattttggcacagtttttgatcgaattattggcgaaagcgaatgaagcaaatatttttcgaacattgaatttgttcttgattaaacgatggattcttcagaatttcttctaaaattaaattcatgacaaagtttcttgggtgccgaaatgatttaatccaattgcccactatctcaaattctctgacccagtatattgaataatttatgagttaatgaaaatttttcaattttttttttgtcaaaaaccaccaaattaaattttttttttaaactcttaaaatatacaaattttctcatttgtaattatatattcttctacctatttacaaccaaaatgtatatatcatagacttaagagctttagtcttttcaataataaaa

SEQ ID NO: 41261 - DNA, 862 bp, Heterodera glycines
  misc_feature (810)..(810): n is a, c, g, or t
ttatattttatttccttttttcttcgcccattttcccattgcttttccaatttgagtcagtataacaagttcttcattaaacaaatggagctcatttgccagtacattaggcctttctaacacttttttcccctgccgttccgtgcactaattaatgactttgtcaatttgctgcttttccctaattgcgtgtccattcaaaaaatacgtttttcatgaaattgtattttgattaaaagtgcctaattgccatcatttgatttatttttcatgaagagtttcgggtttgggcttggcaaaatcacccaagtaaaatgccgtggtttcgaattacggaaaaacaaattgaaaaagaggactgactaatgatgaaaattcttttaagctttattggacctattaggactaccttcacctattttatcgcaaatttctgtctttcaatgcaatttgtggagattagtgctgctcgagacgaaaaacccgagacttttctcgagtcgagtctgagactcttgagtgcgactttttgcgccgtcggcactacgacggcactcaacttttgaattttgcatttttgggttgcaaaaaggcttaaatattaaaaaaaataaattaattaatattatttcattgttggctgggaccatcaatgctttgaaaaattctattcttttcttcaattaacactttttctgtctcccgtcattcgcctgagtttttcccacccgtccgtctgctggcggcactgaattgtcccacgcttaggccgcttcatcgcggcaaatttgccaccaccgccgttctggncccggtgcgtgtggccccgtccgaattttgctgtgccattgtcccccccccc

SEQ ID NO: 41262 - DNA, 748 bp, Heterodera glycines
  misc_feature (4)..(4): n is a, c, g, or t
tacncagcttaaaaaagtttgtgtctttcaaaatataacctttatttcaaaatttttaaaaatttatggttaattaattcattaatattcttaattttatgtaaagaagcagtaagccccgctcattctgcttctgttttttaactttttacccatcatttgtcaaatttcgaaagtcattttacacttttctcacttttcccattattttctttaaatttttttcttttttttattttcccatttttttcatttatagtaatatttttatttttgtttttgtgctgttttgattctcatctttggcgggggaaaggccaaagattttttgtgttctctttttttttctcggccatcggcgcaaaaaatggtcggccgattttcgtcgactgatttcaatcggagggccaaattgaaggccatttgcgcttttacgttcgcaatgttcacgcacaaatggtccgaccaaaattggggggggggggaattaattaattatatttaattaaaataatacaattaaaagtcttttaaagggcgtaattaattaaattgccaatttaaatatttgaagatggttctgaaaaatataaattttgaaaattctaagaaatttcgggttttattttacttcataaaattgttttcgtcaaaaatatttcctttttgcgccgaggctttttttgtatccttatgcgtattgtttagcgctttttgagagtgcgacccgataaagactgcgcttttt

SEQ ID NO: 41263 - DNA, 971 bp, Heterodera glycines
  misc_feature (75)..(75): n is a, c, g, or t
ttcgtccttcaaaatcaaaattttacattgtatcgtcatgtcatgtcatcttcgtgaatttggtatatccccccnatatatcaaccagaactttttttaattttcatatacatatatttccagggtccggatttatacattttttatttttcacaaaatttgaaaatggatttttctattcatttcgtagttgtaagaatgacttgaatattgcaggaaaataccttgatatgaggactttctatatgtaaaatttaaaaaatttgttaatatacaaatttaaaaaatatatttataaaacttgataatcaaattcagacactgccttgaagagttttatctaacgaaacgaacagaaaaatcgcatttcaaatttggtaaaaaaaaacgaatccgggccctgttaatttccatttttatttttcctggcgtaatttaattaaaaattagtttattttttcttttaataaaatccattaactcctgctgaaagcaaatgcaaataaatatccgagttttgatccatcaattactttaatagtaataatctcttttgactggttctatttttcagttgcgtcccccccccccccctattttatttttccattgtttcgctttatttcgtcactcttttgtccattttattgcatttatctttaaaaatatgaatattttatttcattttcaattcaatttaattttttaattaattaattaatttccttttaaaattgttaagcaaatgttattgaggctgttgtgactgactgttttttgttaacaaaagtgcaatttactacacactttagccacatttatttcttgttatgatggccatggaagctcagcaacaattagcaattaatggtgccattttgggaatgccgaaaaatgaagcgagttttaaaaataatattgtaaagtaaattaaagttgaaatattgtcaaaccaaccaaactttttagca

SEQ ID NO: 41264 - DNA, 1015 bp, Heterodera glycines
tgactttcgttcttgattaatgaagacattcttgcccaatgctttcgctgtagtccgtcttgctacggtccaagaatttcaccttttcacgtagcaatacgaatggccccgtttgtctctgttaaccattatctcggtcagcaaaacccaataaaatcggaccgaaatccttcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagttcaaccagatagctgctagcgagcgttgccaagcgccgctattacagccgtcttgtaaagacggatagtttcagcagaaacaactccgttcagcgcaagcgtgcgc

SEQ ID NO: 41265 - DNA, 1915 bp, Heterodera glycines
  misc_feature (53)..(53): n is a, c, g, or t
  misc_feature (79)..(79): n is a, c, g, or t
  misc_feature (81)..(81): n is a, c, g, or t
  misc_feature (194)..(194): n is a, c, g, or t
  misc_feature (982)..(983): n is a, c, g, or t
  misc_feature (1060)..(1060): n is a, c, g, or t
tttttaaaattgtataaagttcctatttttgtctttgactttgcttttttttnccattattttcaatcggctagtgctntnaaggttttgtctttgactttgcttttttttccatttatttcaatcggctagtgctttaaggttttgtctttgactttgcttttttgtccatttatttcaatcggctagtgctntaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaaaatattacttttttaaatttgtataaagttcctagtcgtatgtgctttgcgttggttaattggcgtgggtgagtgtggtggttgggccgtttttgcgatattgtggctggaaaaaagaagcgatttcgctgtggggagcgcggccgtgtgggtttaagtgcttgcttgcgcttgtgctcggcattaaagggtgatggctgctgctggggtgccaccttgnnccgtggcctcagtttctccagcgattggcagctgtcgaaatgaataaaaattcgaaaaaacacgagacataagcgcncgaaggcctctggcctgaggaagtgtcctaaccgggaaatccggaatgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgaaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagacggatctcttatgaggccggtcatcggaatgggtacaatttaaaccctttaacaaggatctatgagagggcaagtctggtgccagcagccgcg

SEQ ID NO: 41266 - DNA, 760 bp, Heterodera glycines
  misc_feature (697)..(697): n is a, c, g, or t
  misc_feature (713)..(713): n is a, c, g, or t
  misc_feature (715)..(715): n is a, c, g, or t
  misc_feature (722)..(722): n is a, c, g, or t
acagatgaggctaaaactaagattcggaccccaaaaataagattttttctaaaactgatagtagcgcgaaggaaacgcaataaaaacatgaaaaaacgacttaaaacaactttttattagcataaaaacgaaggcctgtcaactgaaaattttgtaaatcagcattttgaaaaattttattcaaaatttaaaaattaataatgtttttgcggcgtgctttttccaaaaaacgtgccaaaataaggacaaatcttacaaataaggacacttggccgccctgttaaaacactattttggcgttttgtcactattttttcactatttcgacattttttggaaaattccttaacaaaaatgcaataagaacaactaaatatcgcaataattgttttttattcttaaatttagacttaaaatatgccaaaaattaaatcaaaatcggccagctttcgggaatggattcgaaggatcggaggaactgacttttattcaacaactggcaaaataatttattgtcaattatgtgaacaacaggtaactgcgacaatccgtcgaacaacaacaactaccaatacaaaattcacagattccttgcacgcaattcgcgtatctcaaacaacacaacgaaacggtaaagcacaaggcaaaattggaacggaacaatggaggacacagcagcaatttttgacaacactanacaatattccaaaccnanttcaccnttgattgtgtgaagcctttgtctcagctaacattcctt

SEQ ID NO: 41267 - DNA, 898 bp, Heterodera glycines
  misc_feature (863)..(863): n is a, c, g, or t
ggctgaacatgccgaaatcttgttttttgaacaaactaattccaaaaattcaattttattaattttttaaattattatcttttcaattaaataaaaactatacattcaatcatttaattagacaatttttaatatttaaataaaaactgcaaaaatgcttaaattttgaactctaaacattgatatagatagatcaaggaaaatagtttcaagatttgtggacttttctttaaaaaaaaacattttcaaagtcttatcaaataaatgttatgtaatgctaaaattccaaaaccttctaattaaaaaatacaaaaaaaagttcatacaattggacgaaaaaatttaatttcttcctttttcccatcatgaaaagataaatgattagggcaaattttcaaaaaattgtttgaaaattggcaagagggggggggggtcccggcacggaactacgccatttacaacttccgttctttatttatttattcattacatcatatttttgatatagttttatgtaacttttaaattttaaaagaattttctgctcatctaattttatttaatcaatgccatcaaatatgcaattggctggcttacgttgccggtcacagccacacccattttttgcgtggcatttgaaaaacatatgaattcatccctcttagccaatatttattaaaaaaaataatattgtgacattattgatgcatttatttataagaaaataaattaattaaatattattttatttattttaattttacacttatttgtacactcacagaactccatccatgcctattactgtgtctgtaatactccaatttggtttcctaattttcctcgccaattatttggaattntgttcccgctgtggacgacattcgcccaaaagtcg

SEQ ID NO: 41268 - DNA, 1069 bp, Heterodera glycines
catcgttcgggggggactgccccgaaaacaaaaaaatcgatttttcaagtgtccgttggggtactcaaccaattatggggagcaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcaga

SEQ ID NO: 41269 - DNA, 1514 bp, Heterodera glycines
  misc_feature (28)..(29): n is a, c, g, or t
  misc_feature (80)..(80): n is a, c, g, or t
  misc_feature (138)..(138): n is a, c, g, or t
  misc_feature (146)..(146): n is a, c, g, or t
  misc_feature (171)..(171): n is a, c, g, or t
  misc_feature (175)..(175): n is a, c, g, or t
  misc_feature (188)..(188): n is a, c, g, or t
ttcattacttatttatttttgcaaaatnnaattcataagtatttttcagaaaagtgctctgaaccacacaaaactttatntacaggtaattaaggctctctgatgcttttctatcaaaggggagatgaataaatattntaaaattntaaatcctttttaaacaggccaaanagtntaggcttatattntaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacacacaaaactttatttacaggttaattaaggctctctgatgttttttctatcaaaagggagatgaataaatatgttaaaaatttttaattcctttttaaacaggccacacgggggaggcttatattttaaaaagtttcatcgaacctagcgca

SEQ ID NO: 41270 - DNA, 985 bp, Heterodera glycines
  misc_feature (870)..(870): n is a, c, g, or t
  misc_feature (900)..(900): n is a, c, g, or t
aggaaagctcccaaaaagtgccaccaaagcagcagatttgagttggtatgtgaacatataaatatgtgtgtgtgcttcatcacgtaagcgtgatgcaattcgcagcccctaattaactaattaattaattaatgaacattttgacaaaaatgattgccccgcgttcactcattagcagcagcatcatcattatgtatatctaactaactaactggtttcaatttctcttttttttctctgttatcgagcgattcgccgggggcgtggggaaagtgatcgaaatcgcttcccgcccccccgagcgtcgtccatttgggagaaacttttttgcaaaaaaagtccaaaaatggcaaaaaaataattttaaaatatacaccagagatgctttaaatttttaaaattctgttttttattttgtttttgttaaatcgtattatttaaaacgaaatttttgaaattaattaacgctaattaattaattatcgtcgtgagaacagaacacagaggagtcatcatcactctccgaagcattgaatttgaattaatttatgaaacgaaaaacgccgccggggtttgaatttttaaattaattaattaacatcaattaattaaattaggtaattggaagagaacatagcaaaaattcatttttgttgtatttcgaattaagcaaatccaagaaaataacggtaaaattatgaaaagcccccgggcgatgtttgaagttttggtttattatttattattctgcaactgtaagcccaatgtgtccgtccatgatgacctcgccaaccggcagaactcacgtgtgtcaacaaaatatcatcatcatccatttaatttccacgtgggtttaagtgaataaatggnggcgggcgaaggaatgggaaattttatcanaattgaaaaaataataatccgcggtcatcaaattaatattacatatgatgatgatatttgtataacattaaatttgtgtgatttt

SEQ ID NO: 41271 - DNA, 954 bp, Heterodera glycines
  misc_feature (791)..(791): n is a, c, g, or t
  misc_feature (881)..(881): n is a, c, g, or t
cgctgctgttgttgaacagtttgttgatgcttttactcttaccaatctcttcaccaatgagcttcatcctccctctctatctctcactccatttgtgtgcctttcctgtaatgtttcttttgtctatttctctgcctttacaaactttctctctctttctcgccctctttctctcccacctagttgttgtgtctgcctgtctgatcaagtcactgatcattcaaggctaaaccaatgaaacagtaatcagtatctgattcttcttttcttgtttatgtcttctccgcccactctcttaaaaacgtgtactccttcgccgttcatgatttctctaacttatgttttctctctccctcttcccttcgttactcatttcgccactttcgatctctccgtttttgtaatcgttgtattttcacaatttttaatgcaaataaatttttaaaaatttactttaatttttgggggttatttaatttggcgactccctttaacttacacagacaaataatttctggttgagaccgttttatccatttaacccatacttttttatcataaattagaaggaatttgccaggcgttttctgatttgaagtttaaatttaaatttaaatgcactgaaaagcaatgaaagtgatcagctaaatcaaccaatcggtggtaatacaattttataagtgatcacgaaaattagttgatcagctagggaagtgctgctgatcagcagcaccgaatccatcctccgcccatgcgccacgacttttgcggatttccatgcgcttaatggngagaggaaagccttccaaaaatagcaccagccgccatatccctccgccggcgaatgatcgatgggatgattatttgtgggcgatcgcggnatggaagtgatcggacggagaggagcagaagcagcagactgatcacataaaaagcaatagcccaaattagcag

SEQ ID NO: 41272 - DNA, 486 bp, Heterodera glycines
tggcctatttcgcgattttttaattacaagccctagcttctattttactaattaacccattaagaattaacaagtttcggtcgaagcatctttttggcaccatttgactccgagccaaaaatagtcaatttttagagaatttagttactcttattaaaacaacctttttgcatctgttttcctaatgttggtgcttctccttagtcttgaccgttctcgacttttgcgctctctctacttcttccaattctcgtctgaatgggctctccgtctttcagcggtatttttttcaattcgcccaaacttctttgttccaaaggtcatcaacatgttgcccggtaaattccccagcgcacttcagccgaggttttttgatctgtgcgaacaattgaccaagcaaattgtgcccactttggagccattcttgcgggaactaattgcagttgatcagaggtgtgcaaaatggaaagtgggggggggggggag

SEQ ID NO: 41273 - DNA, 1183 bp, Heterodera glycines
cctaaaatcctaattgtaagtaatacatttcatttccattcttagaattgtcaccgctttgcccgtcccttcccaacatttgttggcccttttgtttggcacttttcgcgtcatcaccgactcggcacaaacattcggcactcgaatgacgccggacgccatcggcatttcggttgcgccttcgccgttccacacgtgcattcacgatggacaacgggtaaaacttgtgggaaaatgaattaatttcaacccatgagtttctgaaaattcaaataattttcgataaaaataaattttggttaaaaatgcgattgaatccctcattttttggttctttggcatctttaactcatcatcatatttttatttacaaatatctgcccaaatctgtaatctcgttagaatgctttttccaagcaatatattagtcttctaaaagcatgatcattttttagcatggaatttttggcgaatcgtctcatagacaaaaattgagccgaaatgttttcttaatttttttaaattatgctttttctgctacgtatgcttcaattccttctgtaaaaaatcatcctctcttttacgaaagttttccaaaaacaaatttttgtttcggctttaattgattttgtattcaggccaagcttgaggacataatgcgcttcaaattggcctcccaagtgatctccaaaatcatccaatcgttcggtgctgtgcgactgtttccctttgaatgttacgaattctatgcccggatcaccggcaaaacgttgcggagggacgaaaaccattggcacatttccttccatttgccgtcgagtgagttttattttttaaatttaccattccattatgaaatggtacagtgtctaatggtagcccatggtttaagcctcgggattctcttgaaatgacaccattcattattaatttaggttaaatgccaataaatttaaaaaaaaaaaaatcgtggttttccatttttgtccattccattgtgcctccttttttgtttgtttgttttgctgtgtgctttttttacgttttatttgctttgcccattttttggctttttgtttacccccaattaaatccaaatggtccgtcccatgtgctttttaattacgtaattaatatcaaaaatatttttgtttgtttttttttgttgtccgtcggtttgggt

SEQ ID NO: 41274 - DNA, 1077 bp, Heterodera glycines
  misc_feature (65)..(65): n is a, c, g, or t
  misc_feature (100)..(101): n is a, c, g, or t
  misc_feature (103)..(103): n is a, c, g, or t
ttaaaatttatagaattcgtgcacaaaaaaagcaaaatcttagggccaaatgttcgtgacgcacnggcagaaaaattggggcctagggttcgcaagaccnntnaagcagggaaaatacgaggtgcaggccattttggccacgacaacgtacaaaaaggatcggcaattacgacggatcttctatgttcagtggttaggtaaattaatttttaacaattttatacaattgttaataaaatgtattcaggctatagtcaaaaagactatagttgggtcttgagttaaaaatcatcattttcatcttctctctcattttatttgtgtgtttggtaagcctactttcttagaattgtgggccccaaattcaccgtctttaggggaccaatagagtaaaccgcacagtctcgaattgtgtggcctctattgttcttctatttcttttttaattcctactataatatttgtttttaaccttggaaaattattgaaaaaattttttttcaggctgcggagaggctgaaggaattcttaaaaaaagaaaaaatcgtgatggatgcataaaaatttaaaaaaaaatgaaaccaaaaatattaataattaaaacccaaaaaaatctttaaaattaaaaaatcaaaaaaaatttttaaactaaaattcaaaaattttaaatattaaaatccaaaaaaactttaatactaaaaaattccacacacattgttcttcgtataataaaatgttttgccgataagttgtcctattcataattttttggcaaagaaagattggttcttagatcaaatgtgagataaacatttggcaacgggcggcacttaaagcaatgaatggaaattttcattgatcattctcactctaatcatctccaaacattagttgcttttctagaaattcgtccacaatttttattcgtttttaagccatggaatatccatcaaacttttcctggattcaactttccgactgtgcttgtgatttcagtacttgcattacgccatcgtcctacaaaaacccacataatttttgttcccaaatacatgggttgaaatttttcctccctcc

SEQ ID NO: 41275 - DNA, 1387 bp, Heterodera glycines
ccgatgattttacgaaattgttttttggactctcaacgcatttggcccatctctgagctcatgttctcccactcctccctctttttcagatttgtcgtctcttgggcgctttgtacagcgaaatgattttccgccgcggctacgtccacagcgacccgcaccccggcaatgttttggtcagacgaagtgccaacaccgggcgggaggaaattgtgctgttggaccacggcctttactgtgtaaaaagtccgtttggaaatgccaatgtcaaaacgagcgccaattgtcagactcttcccgacgaattgcgcattgattacgcgaaactgtggctggcgctgatgaagccggaccaggacgaaattcggagggtttgcgaacggatgaacatcggacagaactacggactgttcgcctgcattgtcacaatgcgctcttggaagtcagtcactgcgggcattgcgcggacagaaattgacgacagagaggtggggaaacggagacagggttttgaaaagggttcaaattttcaaaaaaataatccaaaattattatttatttttttggggggctctgtctttgcatctccctcaaatttgagtacttttgaagcgatcgcacatcaaagagtacgccaccggtcttatccctcaaatttccgtggtcctcgattccatcccacgccaaatgttgctgattctgaagacaaacgatctgctccgaagcattgcattcaaattaaaaacggaacaccgactggacagtttttcagaggtgaattcggccggaaatgtcttctctttcctcgttaattaatttttgttccgtcagatgaccaaacattgcactcgcgccgtttaccaccactcaatcgccgccacccaatctttgctgagcaaattgcgactttacttggccatgtacgtccttttggtcaaaataaacatcttcgaggtctttctgattgtgaatggactgctcacagcgaggcaaaggcatttgacactttaacaaatgcttttccttttgcatttgacttcccttttgttagcccactttctaatcattgcttgtcaaatacacaaatttcgcaattaagtcatatttctttaggaataaatctctgttacactaacaaatttagtcatcggcgtaaatgcccttttaattcaagtggttgaaatagaagaaacacttttgcaaatgcatttgtcaatatgagtaattattgaaaaaatgtgttgctacaaacagcctgcatttttattcattaaatttgcgttatattaaattgtgtctgtctgtctctctattgctgtcattctttgtttactctcttgctctctcctccaattcgctctcttcctcctcctttgtctctctctct

SEQ ID NO: 41276 - DNA, 945 bp, Heterodera glycines
  misc_feature (846)..(846): n is a, c, g, or t
  misc_feature (937)..(937): n is a, c, g, or t
agtagattttatactgtttcatttcctcgtaataatataatttacccttaaacagcgatttaaaatatatattttttattactttttaatgttgatttatttttaaaaagacgttccttatcatttcattatgtacaaagtcgatcaaaataaatattttatgaattttttttataaaaaaaataagtttagaacatttatttgagtctttccgcttttataagatattatttaagattatgaatatatttaaaatttaaatttaactgaaaatttttttaagtattgaattgtagtgttaacaaaataatatattaatttttagcaattaaattttcattttttaacatttttaatagtctttacaagtcttgggttcgttattgcaccaacattccaataaccgggacctaacctcacctgattcttcggtatcgcaaccaccgagactcaattctcctgcattccaatcactgtgactcaaatctccggcattccaatcactgggacctaacctcacctggtccttcggcatcgcaatcatcgggactcaattctgtgacattccaatcactgggactcaacttaccagcattccaatcacttggactcaattctccattattccaattcccgggactcaatctcaccagcattccaatcactgggactcaatccctcacttttcacgcattcttcggtatcgcaatcactgggactcaattctccggcattccaatcactgtgactcaaatctccggcattccaatcactgggacctaacctcacctggtccttcggcatcgcaatcatcgggactcaattctgtgacattccaatcactgngactcaacttaccagcattccaatcacttggactcaattctccatcattccaattctctggactcaatctcaccagctttccaatcattgngactcaat

SEQ ID NO: 41277 - DNA, 890 bp, Heterodera glycines
  misc_feature (333)..(333): n is a, c, g, or t
ttcgcgttttattttccgatttggcccatccctgggtgcaaacccaataatgacaaaatatttgcataatttttaaaacttacttaaaaaaattttaaaaaaatttagtaccctctaagattttttcgagaggaaacgctatcgggggcaactcaatttcttttaaaatttctgagatacgattgaagagatttatggaggacaagacaccaattaaaacgctaaacgtaattatgggacaatccaatagaaaaaactctaaaagaaatttaagtaataaaaaatttcattatttaaaaaaaatttttcagaaggaaaaatattggatggggnggggggttggagaaacgtaattttttttaaataaaaattcttggtaaaaaaatttcctaaccctatcccaccctgttgttgttgtagttgctcccagcttctggccgtccatgtcgtaatccatcgtccgcaacccgtacagtgtccaattggaaatggttgttattgcgattcggcgctgttcctcccggtggcggtggtgatggtggcccatccgtctccaattggtagtcattgttgctgccgccggccgtgttcggtggcaccagcgtgtacttgccgagcagacgacgcttggagcggaactgtgtgggcacctcacgtcgatggaacacttcggcgatgaaaattgcctagaaaattgtaaaattaaaaaaaaacacaaatagaaaatttttttataaaaaaagttcatgaaaaaaaccgatttcaagggaacatacccaactgtgagtattcaaatcactttaaaaccatttttatcatgtatagcatagttgattttctattgtaaattttcagcttttttggctccggcgccaaaaatgatcagaaaa

SEQ ID NO: 41278 - DNA, 1074 bp, Heterodera glycines
  misc_feature (12)..(12): n is a, c, g, or t
  misc_feature (955)..(955): n is a, c, g, or t
  misc_feature (980)..(980): n is a, c, g, or t
cgaaaggacgancggcggaggaagcgacatcctccgggaggattggttgtgggccattcccctcaaggagttcggcgagggtcgcgagacggtgcttgtccttcaggacaagggtcagttggcacggcactttcacatgttacaatattagcaattggctccggcgctgtacattttaggaactttaagtggaatcagttccccttaatttactcgtaatgtttctgtttgaattaagacattttggaggatggagcggacgaagtattgatcaacccaaacatgttagagaacgaacggcataaattgaacgtggaacggcgcaaaaagaaggaccactacaacccgtatgaggaggaggtggacgagttcggacaggtgggagaagggggatggggagttggaagtccaatatatacattaattgactaattaatgtgttgtcaggtcaaaaaacagcaaatgctttccaaatacgacgaaggcattgacggggagaaggaacgcgacacattccgacttggtaacacatttaaacaggcatttgtttcgaaatatacaaatatttgacacaccgaaattccttttatttgggcttaaaatggagccaggatttggtttgaaacccaacggaacgcttggcatatttagatgagagtggacagtacgacttggacgcggagaccgccgagctggaaacacggcgtcggctgatgatgctcaacaaaaagtttgagtcgttagaaagcaccaaatacacattggccaacgaatttcacaccgaggcaagccaaacacatcttcataatacgaaggctcattacaaaaggggaaattgccctgaaaaataaaaaattagaaatttgtttcacattttggcataatctaccaacaaatgttccaatttattggataaattcaggaagaaatgatcgcatttcgtcgtccgaagaanaaggggagggaaaagcacgcggaanagaaaggcattgaaagccgacgatttggagacggaaacgacggaagaaacggagggagaaaaaaggatacggtcagtctcatttcaatatgaat

SEQ ID NO: 41279 - DNA, 366 bp, Heterodera glycines
aaaaaaatgatagagtgtttataattattttaaaatgatcaacaaacaattccctatcaaatggcaccacacaaaaaatttaaacaactgcataaaaatatgctaggtggattattttttgaaaaaatttcaaaataattcaccatctgtcgggcggatccgaacccacgacaatgggcaactacatgtaagagaaaaaaaatctattttttttgctggcactgtcatttgatcacttttttctgattttttttggcgtcggggccaaaaaagccgaaaatttacaatagtaaatcgactatgctctacatgatagaaattgttttaaagtgatctgggtgtttacagttcgaaatgttcccttgt

SEQ ID NO: 41280 - DNA, 810 bp, Heterodera glycines
tgaaattaagatttctcttaacagggtaggcgaaaagggctgcaatttgttaaaaatattaatacagtttagttccccgtttttagcatagtcgtttagatgtgatcccagtgcaattaagaaagtaggtattaatgcttgggaaaattttgttgtttaaaacagagcaaatagagcggtgtgcgaggaaatgcttatcgtttaaagtgggtattgaagaaaaatcgacaaaaaatttaatgcgctccaattgcatgggcgcctgtaaattcgaaaccagcacaaaaaataagcctcatggcaaaattccagcgcaattggtcgggctataagccatggaattaccacaaatttcgacgacattcaagactgctttttgttaaaatatgaacacatatttaaccggaaataatgaaaggtgtgtgcttgatcagaagttatcttctctatttgttacactatcgattgcttatagaaaattgcataagattttttacaattaataaaattacaaaaaaaaaattgtttatttaattgaccttttccaaaacataatgaaaataaacaagcctatgattttttaaatgctttgcaatcatagaaaaatgtttgattattattgtatacttaataaagtacatagaaattgaaaaactcaccatagaagagttaatctgttatagaaaaaaattgagaaattattagtgaaattaagatttctcttaacagggtaggcgaaaaggactgcaatttgttaaaaatattaatacagtttagttccccgtttttagcatagtcgtttagatgtga

SEQ ID NO: 41281 - DNA, 1104 bp, Heterodera glycines
cccccccccccccctttttcccggcctttcatttggtgcaaatttcggccccttcttgcccttcgtcctctcccccctcctcgtccatctttgtcactgtgtacccggcacaacacatccatcgacatggctccatccgcgttctctccgtgcggcagcggaggcccttcagaagagagagaatcccctcgcagggcgcctcttcgctgaatgaacgggcacagagtgaggcgcagggccgacgggcacagacttcggtttgcgagagttcagttctaaaacaaagaggggggtaatggagataaagcagagagagaaaggcatggaaagataaagcaaaacagagaaagagacaaaggggagagaggaaaagcaaagagaaaaagccgaagggataatcaaacagagagagagagaaagcaaaaaagccaaagggataatgccatggataaaaagagaagaagcgagtgccacggttagcataattagcattgggaagtgaagccaatcgaaaacgtaaaggaacacaaaaccaagctgaagagaacaaagtgatcgacaaaaaaaacagaaccttcgaccgcaaaacaacagcaacggataagcaaaaaaaaagagaacacactgacaggcacaccgcgtccccgcggggcgcgcactcgcgcaccctccgacgcacaccgcacgcaccgcaagaggcactgcactcactccactcactccaagcgcccagcggcgcgtcagttgtcgcgactgcccgggcacgcgcttgaaagccctttccgccgcggtaaaaggagcggaacagcacctgcggggaggggggggggaatccattgccatcttcgctggagggcattctgtgccgttgcactgcccactcaccagcatgtcacgcgtatccgacacaatgggcgattcgggagtgccgaagcagcaatatcttaggggaggagaagaattattggaaaatgagggcactttctgcacagtcacctcattcccgtgttggcaaagtcggtggaattgcgaatctgagaagggaatgaaatggcatcactcggctgatgaatcgttcgttcgttcgttggccaattccatccc

SEQ ID NO: 41282 - DNA, 1039 bp, Heterodera glycines
  misc_feature (44)..(44): n is a, c, g, or t
caaagatgaattgatgatttatgtttatggctgatcatgagcanaaaacaccccacaaaaaaagacagtgatcaatttaattttgaattaacgaaaatatactttttttggcgttttgaatttctaacaccggacggagtgtgccgatcccacaaattttattcttcgacgggatcccgttccgcttggttttgtgttctaccccatggctggatcccaagcagaacaaaccctactttattgttttattcggtgtttttttttattttaatgttttcgttaatagaagctttaaaaattttcatttgacattcaaaaacataattttgtcaaataaaaaaaacaggtattcaaagtcattatggcggatgtttggcctaagacggttccaaaagagcagcaccctttttacatcctccaccccgagcctattcgaatctctccgctgctccgatttgctcgttggtcggccctcggcctaggcattgtgtgagtaaaaaacaatggagagaaaggtgctgaatgggctccaaaatccctttaggtatggtttcgtccgtcttcgtatggtcagcaaataccacgcggacatccgcgaatgggaagtgcaaaagaccatccacaagaaggatgcggataagaaggagtcactgagagtgctgcgtgagcaaaacgaatggattatgaaggtttgaagggcaaatgtccacaagaatggcaagatactccgtaaataatatttatgatatcattcggttttcggggtcatgagcatagatttggcattcaccctttacaacccacggacccgaacatagactcggcattttgtttgtataccatacgggtattcttgacgttttaggttcaacagaacctacagctttactcattttattttgagccctagcgacgacctttttttgttgctcttcggcaccttattttttcaccaattttctaaaactttttgactggtagggtgaggccaccagaatggaattttgggcccggcgataccgatattgagatttttgat

SEQ ID NO: 41283 - DNA, 1582 bp, Heterodera glycines
tataaattaattagctgtgctagaatatatttctatcatttgtcagatgcgtgccgtcaccgtcggtgccatgtgctgatcggcgtattactctgctgcctgatcatctgcttagtgaccatggtcgcctcgctgacattcagttgctggtggacacttggtaagacgaactattcataaagtttatatctgcaaaattcaaaaaatcagaggtgtgcgaattcaaatttttaataccctaggaattttttagccctttttcaaattttgttcaaaaatgacaattttcacgattttttagtcaatttttttacaaactattgagttttggagtctgtatgatgcccatagacgctgttgtgagtagcaacggcgccgaactggtcgattcccgcttaaaaagctgcctaaaaatgaaataaaggaactaaaattttgagattaactttaaaaaaatgtaaagcattttatggcagtaaaatttactaatgaaatttccattttcaatgcttttcttatgaaaggttccttcttcaaaattggccccaccggcgtcgttcagaagcagcacagcttcttctcctccaggcaaaaattgttacgccacaaaagcagcgtaaatggcacaaatgcaaaatgccaactaaaaaaattgtcttcggcaccaatttgggtgcatccgccgccgcccgcttctcagccgtccacgccggcacagcaaaatcaacaaaatggacggccgccatcaacagcaaaaactcaacgggtgcttctaaacaacgaattggaggccgtgacggccattgtttgactgataattgataatgattgcatctttaggcgagcaattagcggtgattaatgaatcacgagtcaaatttaaacaaaaaataggtgccaaggaaaagaaagacaaattaattaaatctatttttattatttttttatttcattttcataagaaaaattattaattttctactgaagcaaccagaaaccattgatatttaccgttaatcatattattttgcttttccaccttctttttacatgaatttatttaaattcgctctatcattaaaaaaatttttgtgagtttataaaatcgctatttaaacaagacagtttaacaagaatatattaattgttttcaagattttaaattaatgcattgtttttgataaaattataattttgaaaattgaaaatctctcgaaataaaaattatgaaaaatacaattgaatggtgtactataggttgggaaaatgattgaaaaaggcagccaaaaaacgtgtgtttgctctttgattctaaaaaacccaaagattagttttagcgatttggtgcctttttggcgtttttttcgaaaaattccattaaaaattcaataaaatcgggaaaatgcacccataggaaatgatataaaaaatttcagaaaatacacccccaagaaatgatataaaaaatttcagaaaatagaagacccctaagttttgtgccttttcatgcctttttttaattttttggtgcctattttaatgcctttttcacgctttttggtgccttttttgcgagctctag

SEQ ID NO: 41284 - DNA, 962 bp, Heterodera glycines
  misc_feature (906)..(906): n is a, c, g, or t
cagcttgctgcctgaggtcgccctatccttcctcatttccaatttggtcttcggatgtgccgagcgttacagcttatccgccgttcttggcaagccccgaaatgcataccgatgatgtaaaatattggcaccgccgttgtcctacccctcagatcccttctgccgttgcgataagaccaaagcaaacattgactccaaccgggcaaagttacaccatcgcctcaccctttgcccctttccccaacaaaaagtgccgccgctcgagaaatcctccccccccccctcgttttttggcgttttttctcgccgcaaatccgttcacccaacaacattatctgcctttttgatctttttatgtaaaatgatgtgaggaaaaaaatatgtttagcgtatttcatatcatagcaaatggagcacatcggaggccattttaaacacttcgacgcgattcgaaatgtactcgaggataaacagagttccattttgctggtctacaccaaaatgagtccaaatccaaagtgaggcgctgcccacggccccgtcacaatggtggagacgagcaatcggagcattcgaatcctaaagaaaagaaaggcatttggcattggccagagaaatgccctgctgactgatcagtgatcacaatcacaccttatcgaccaaataaagaattctctgggctctgttaagaattaaaagcctcccggattgactgacaaaaagtgccgaataattgacaccctccggtgccgtaaaacattgcaacacattaccctgaaacataaaaagtaatttggcagtgaatcatcaaattgaattttaccttttttgacattttaacgactgaccgcccacatgagacaagcaaagcgccgaagccatcgctggaaatgaaattgcaattgngctggtacgtgtcgttggaactgctgctggtgccgttgttttcctctgtcactggt

SEQ ID NO: 41285 - DNA, 879 bp, Heterodera glycines
ttttaaagtgtttaaattatcattaatctatgcattttgatgaaaatttttggaatttttcgaattttttcaaaaaaattttctcttgggaaaattcccgttggttccggcttttctcgcggtcccggtaccagactaaaatcgaggtcccggtcccgacttttctggtcccggtaagtcccggtcccgaccagctctaatagaaatcacgagaatttttttgtaatttatttcccgagaacttgtgatttcaaattttattacttttttgcatccgcctcactttcagcgtgccgtgctggccgatattcattacaaagtgccacatgaaacgggcggtaccgctggcggcacatcggacgaggacgcggcaccgatgggacagcttcggctgagcgcactgtcacgcaaagggacggcggaggaaaagcgggaggaaaaggtggccaaactgtcgcccgaactgcgcgagcgcgtcaacaagaagaagcgacagttggagctggtcaggcggtccaaactttcggatcaataataatgacattacaatttgggctcagttttgttcccacatagggtgccagttaccgagctcttttttgccaattaatgacgggcggcttcggacccgtcttagtttagccgggtttactgattcgctcaaatttagggaaatttctttcaacgttacatttgttttgaaacaggagaaaagtgatgttaaatatgcgttcatgctatgcatatattaaaacataaaaaattgttggcgtaatttgaatagctgaattttaaatgaaataaaatttgtctcgctaaaattgtttcaatttaaaaaagaaattgatcgagttatttttatcctggtcatgtgattgc

SEQ ID NO: 41286 - DNA, 1051 bp, Heterodera glycines
  misc_feature (22)..(22): n is a, c, g, or t
  misc_feature (1006)..(1006): n is a, c, g, or t
ggggagtaatgttttgatcgcnatcatctcacccctttctgacatgccggtgggcccatgatggaggagagcactcgggcgagggcaattaactcactaattgggtggggggagtgatccacaaagtgagtgaggcgctaattactggcaaaggtaacttttgcgatcacctggtgaacagcgcaacatttgtggccgattcgatcactttgtctcctcgcgagtcaatggataatgccggaaggctttttgcccttaaaatgaaaatgggttaagggagaagaagcaactcactggactacgaggttggccgttccgttggccacttgctgaatggcctggttcatctcttcgtaaaagcggtgctcttcctccgcttcttccgtgtcgtttagcgcgttcaaaagagcgaatgcgttttcgccgatgagactggccgaggaaagaaaggacgaccgtttctcacatttttcgggatttaattttgctgaaagtgtttgaagtgaatttggcattgacttagaaaaatgaactcatcaagtcgataaaagccgtgcaaattgagtgaacgagtgggcccatttccattgcgtccgttcggagggcgcaaaactcgcggaaacactgcgccaattcgcacaaattgtccgctgcttccaccacagcaatttgagccgcgccaaattggggatgcaattggaggtccgaagtccattcgacgaccggcaaaagggaaggttcggctaattaactaattaatggccattcggaggggcgggtccaaaaatccctctgctgatcgcttctgttccgcccacctgtgctgtgtaggccaagaacagcaccgccctgtgtcggattgtgtcctcgcccaactgaacggccatcagtcgttgctcctccgtcagtgccaaattggcaatttgctgctgccctttggccaagtggccgctgctttcgctcactcttcgcgcggactgtccaatggcggcattcaatccttgcnaatttcgattttgcgaataaaactgttcgaaggagcgatgagctt

SEQ ID NO: 41287 - DNA, 971 bp, Heterodera glycines
  misc_feature (33)..(33): n is a, c, g, or t
  misc_feature (904)..(904): n is a, c, g, or t
  misc_feature (951)..(951): n is a, c, g, or t
ataatttacatttatttttctattgaaatacanttttgccaaaaaatcctcatgaaactcaaaattttcgtcattaggagtatttttccatttcattaaacggacccatagggcgggttagtcgcataaattattttttacttttttaattctgacctttttttgggcaaactaagctaaaaagcggcattttcaacttttttgctttttgataccattttactagtttttaagaatatattccaaaaaaatacgcgatatgaatttctaaaaagatttttttggaaattttccggtttttagaagttaataaggccaatttatctggtggtggccgttcgaaaagaggttttttaggaaaaaaaatgtgaacaaatcatgtgtctgaagaatccaacaggaaacaatatggttattctttgaagtcctattcattagtatttgatgcataacataaatttaaaaaataatttttaaataaaaaaaataatttctattattattattattattaaaaatagctcctattctctatctttttgaaatttggctgccccaattgtttttttttcacttataaattttaactcttaacaaatggacaaaagaatggcgacaggatttaactttataataaatttttttatttttataataaatttatttttttttgattctctgttattttgttttgaattatgtcttaattaatatattatagacattatgtggaaacaaatttgcaattgaaaaatcagtgcaacagtgccatttattattattcaaatatttagacggaaattgtaattggaaaattatttaacaaattgattatattgcttttcgtatttttatagcaatattattataaaattttcattataaaacatttaatattatttcncatttttatttttaaataatttattataaatatttcattaaagactntagaaaaacagctaacatga

SEQ ID NO: 41288 - DNA, 939 bp, Heterodera glycines
  misc_feature (15)..(15): n is a, c, g, or t
  misc_feature (906)..(906): n is a, c, g, or t
  misc_feature (918)..(918): n is a, c, g, or t
cccggttcgaattancaatttattagagattaaaatttcattgataaaaataacaaatattaattaaaattgaaaatgactaaataacatattaaattatttaatgaaaaatttataattttaaattgaataataaaaacaaaaagaaattttatattatgggtattttttacaaaaaatttaacatttttgaaaagttaaatttttgcaaatattctcaaaaaattcgaattttctaaccatgcttgaacatgtttttgttcgtacaataggtaatgtttcttgttttagttgagttcgggatttaatcgaaatctaaatgattaaattaaattaatggtattaaattttagtctatattaaaattataggtttaaatattattttatcatcaatttctaataggcacaaaatcgaaaatgccaagctcggacggcgtttccaattgaatgccacttgccaaacgttggataaacaaatgaaagatgtgccaatgaatcaaattgacttactcggcaatgagtattccgacggggaagtagacgggccgaaatttttgatagaatttgtcccataggaacgatcaaaaaaaggtacaccgtctaaggcttccaaggccatcaaggcaattttatacaatatgaacaagaaacaatcaaaaaacagttcttataacaatgtcaagtcaatgccgaattaaacctttagactgacaaaaaaaaatcatggaaaattatccattgtatattatacacatatatatgtgtatatatatatatatatatttttttttttggctattattactgagagtcttgttcatatacatataataattatgtttttaattgattatacaaatgtaaccaaaacaaatttattcaaaacgaaatgaccactcgccgnatattattattntttgataattaactatccatc

SEQ ID NO: 41289 - DNA, 1360 bp, Heterodera glycines
gtatatatattattataagtgttggttgaatttgcttacatatttccattttattgcggcatggtcctctagcttccaagatttggcgcttcataggtgtaaaaatttcacttaaataatagtattttatattatttatataattcaattattttttaagacaaaattaagttaaattaaatttataattatactaaataattttattgaagaatttatttaaactcaattcaatatttataaataagagaactgacattagctaaaattgagggaaaatgatttcgacgagataataagcattggtttattttcaagctttaatcccaggttttgttttaaaaaatttgtattacatcgttggttttatttagatttttcataaagcattaagaatattttattaaatttagaaatttgtttttaaaattatttttgcaattaatggttagtagttagagcacaccatttgtccggattacggtagccccccccccccccacacctatgggaggggtgcatggccaactgagcgccagccatttgagcgccaaaatttttcagtactgaagcaaaaccttttgcgcgacttttcttgcaaacccaaacctattgtaagggggtgcgcggcttttttcttactgcgcgacttttttgctgcgcgactttatttaaattattttaattaattttaaattcaatttaaacatctaaaggtcaaaatatcttaacgtgttgaatttaaatgcattaaaatttatcaaaaattccccgcactgagcggatccgaaccacggagggggtagccagactgacgtactaaccattcggccacattggcaatgggtgataaacattaatttgctctcataaagggaaaaattgacgtcaccagcggggggaggggggcgagagcgtgtggcaagaagggcgggggtgttgaaaaggtgccaaataaacaaatcaattaaataatttccaatttacgtttttaaagacaaaatgaagcgagggactatataataaaaataatattattaaaataattataaaaatgtttaaataactaataattatttcaaaaaaaaatattttaagtgaaaattaacaataattttaactttatttatttctcattaatttttagagtttaattattttaaaattacacatttaaaattaattgttttattgtttagggaattcgtgaagtcaggcctgtgggcccggggcggtcgggttgtctctatgcctatgcaaaattgttatcgaccatttgtgggcaagggaattgttggtccaaacttcaaagttttgaattttggtcacactttgtaacaattttaattctgataaagca

SEQ ID NO: 41290 - DNA, 642 bp, Heterodera glycines
aaaatgtctccctaattattgaataaaataattaattattcgcattttatttatgtcataaaaaaattatttgtccaaattaatgcgacgatcaattctttttccatctttcatttcttggttaagctccgttttgttccgacctcagcagttattgcagcggcagcagcacatgaaaatctgagaaaaatttaattgaaatttaatttaaaaataaaaatctgaataccaaatacacatatttatatgaggatatatcctcattttttggcaaaaatatcaaaactggcaattttgcaaaaaatctgttaaaatcaaatcaaactgaataaaaaattttcccgatactgcttgtcaagccccttggagcaccaacaaattttgaaaaaatgattcaaaaaaaatgcacttgaattcgaagaaatttattctgaacacaaatttatgtgcatacctattatcaatataattatcgtaattagcctctaatagagtccacaggggctttaatttttgaacccttctgagggggaagggtgctttaatagagaaaatatgatacggtttttacaattgcccgacagcgacagcgcgatgaacaacggcatgggcaaaagcaacaactgctggcccacccgcaca

SEQ ID NO: 41291 - DNA, 1107 bp, Heterodera glycines
  misc_feature (1068)..(1068): n is a, c, g, or t
ggggtttgacaagtttattgggggaaaaaagactacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccttgggagaagggagtgggaaacatgatttcaaaattttcaattttttctagtctaatctactcaaaacggttcagaattcaataaaaataacattcacggtgcgaaaaatggggtttgaaaagtttattttgaaaaaaagacttacaaaataatacccctgggagaagggagtgggaaacatgatttcaaaattttcaattttttctagtctaatctactcaaaacggttcagaattcaataaaaataacattcacggtgcgaaaaatgaggtttgacaagtttattgtggaaaaaaagactacaaaataatacccctgcgagaagggagtgggaaacatgatttcaaaatttttcattattctagtctatctactcacnaacggtcagaattcataaaataacattcacgtgcgaaaa

SEQ ID NO: 41292 - DNA, 851 bp, Heterodera glycines
cccccgcccagtgtgctcatggggctgttcaactgctttgttccattcgaagtttggtggttccgcgaatggtgagctgttgagggagtgctcggctgagagaaaaaattcggcggccgttcaaagggatttactgaaaagtgagtgacttaaaaatgccactaattgttcacttacccccaaaagacgggcccaaattcatataatttggcgagttccgtacgactaaagccgcggcggtggcgaagtgctgtgcggccattgccgtggcaactttttgaaatgcgggaccgtacacgggggagagagaagcggcggcaaggatctggctgaaaaggaagttgctgccaggcgaaggccacggaagtgggccggacaacggattggccatcggattgaacgattggcctgaaattgacgacaattcgatcgtttttcccgcataattccctcgccctttctttgactcgccaatgttcgattgcatttcgatatccgcttccatggccaattcctgcttatccgcgtccaaatccgccgacgacccggccatatcggttgggtcgtcttcggcgttgttcgagcggaacactttcacttcgtccgccgtctcttcgtcgacgacggaaggccccgcggcgcctccacttgaagaagacatttggtggaaataaaatgaaatggcttaaattcaatgaacaataaaacatatgtaaatgttatggacattttgaaagaaaaaaacgaaattttgaattaaaaaaataaaaagaaaatcaattgttagagaccgaacttgtaaacataaaaataggagaacggcggaacagataggcaccgctaaaaatttt

SEQ ID NO: 41293 - DNA, 1218 bp, Heterodera glycines
  misc_feature (37)..(37): n is a, c, g, or t
caattaattataatgagtttatcaattatattatatntaaaaaataaaggcatggaataaagattaatttaatattggcaagaaatttataaaattctgtagaattgtcatgacaaaattagtttaatctctgaaaagtaaagaaaaggccaattttgaatcaaaaggtcatattttatgaaaatgattcaatggattaatagtaatatttttaaaattgtattaaaattaaaagaaattatagctttcattattcggctgtgccgaaagcgccttaaacattaatttgtgtggattcaaaagaaatgaatcattttcaaaaattattgagtacttttaaaatttactaattaaaattggcaagaaatatatttaaaaatatatagaatattttcaaaataatttaactatcaaaacatgatttaaattagaataatttaatttataaagatatttgtcaaatcaattaattaattagcaaagattttataattatcccaaaaaaattattaaagtgaaaatgagcaaatgttaattaaagtttttagaaaaaataattaagcaaagacgaaagtataaaagaaattatacctgcaaaatgagtaaaagtttaaataaaaaatataatttcatttaaactattgaaaaaatactcaaacctaaaaaatatatatatatatacagataatattttaatttaattcaatgtaataaaattcggcagttttttagacaattacgaaaaattaattattatttcaataaaaataaaaaataattacagtttctgtttattcattttgtaaattttttttcatttcatctaatcatcgaatttagaaatattttttttcctatgaatataatagcatttttaagtttcagttaaaatgcttgtttattattaatatttaaaacattttcaaataaaataaattcttttcatcaataataaatttttatctcatataatttatcattgtcacttttttacatttttttcaattatttattattctttattgttacactttcatttttcttttccgaatttcggtccgtatgataattaaaaaataatgtttatgtaatacagataaattaattaacagaatatgctaattttaataaaatttgaataatattttacaaaaataatttatttatcattttctttgtttttctgttttaattttaaatttattaaataaatttact

SEQ ID NO: 41294 - DNA, 991 bp, Heterodera glycines
cacacaccttcccataaaatatcaacggtgaagtcacgatttatcccaaattctctttcgcaaaagtgatggaggtctgtctgttcactggtccacttatattgaaaattttgaggtgtaggaacaaaaccgaaaagtatcttacatttattcaaatgaaataataaaataatatttttgaaaaaattttatgtgatagagaaagattcgataaatatttgtaaaatttttaaagaatgttatttccttaaattttttacttgtcaaaattttatttttttatgttcttctaaataaataataaattaccgattggggtccaccacgtccaaaacccgctcgaacttcggctgctcctcaaaataaggaagacgccccaacgcccaaaggatgtcctaacaaaattaaatttttgaaaaaaatatataaattgaatttttactttaaattgtttgtgctggagctgcgcatctttgtcattgtcaaagaaacggaaccaactgagatattcccgcagtttttcatcatccagcaaaacctggaaatgaagaaaattgtttttttttattaggtgggaaagaatcagagaagcaagagagatgtctgtgatcacacagacacgtacttaaaaaaatattccaaggcctacaaatttgataaaaatctgctaaaaatttacaaattttgaaattttttggataaatcaattaacaaaatcgcatcgcatttaaaagttacaaaaatattccctgcggttcctttgtcccgaaccaactaaattataccgaactcacccgctctgttttcatcggttggccgcccacggtgcccttggaaagtgtgtgcgcaaccataaaaatggtcagaatcgtgtagacaattgagaaaaggcaatgcattttattggaaattgactgtaaaaaaaagaaaataaaaaaaatattagtcaaaataaattagtaaaatttgctcaaataccaaaagtcaaaat

SEQ ID NO: 41295 - DNA, 952 bp, Heterodera glycines
tttctttttttcataacattagggcagattggtcagacattttgttgaataatttcttaattttcgagaagggaattaaacattgagtcaacgaacaaaaaataaaaaacaattcggtcaaaagatagtcattccgtacagattaaaatacatttaaacgagaattttgaaagttttgaattttcaattttttcgacttctgtcagggactctgaaaaaaccaaagtgaatgtccgagtcgtgatcagtagggatggtaattatatggaaatccatatttttttcctggaatgtgggaggcctgaaacgcacgaaaaacatgtttttagcttggtttgaagcttctaggaaggatttctatatccatattttccatatttttccatatttcgcgatttatgtccatatttccatattttggcatttttcaaaaaaatctctattagaacggccccagcagctaaattagtctttttgagcccaaaacccgaaaaatttttcaaaaaaatcattttttcgccaaaatttctcgagaatattgaataaatttaaattttcttaaaaattaataaatttatgtcaaaaataagcaaaaaagcgaaaatttcgcttttgttgttgattttgcgctaaaaaaattaataaattttagcttttatgttttttttcatttaaaatgattgcacgtaattgccgaaaaaattcgagaccaatttccgaatggttgaccgactaattgcaaaacgaaagccgtctttgtcaaagcgccttaccgagtcaaaaaatttggaaatggatttcatatgcaatttcaaccaacaaatttgaagaaattttgcactcaattttgaaaaatttatgtccatattttgacatttttgccatttattttcatattttgagaattttgccattttatgtccatatttttgcgattttagtccatatttta

SEQ ID NO: 41296 - DNA, 1115 bp, Heterodera glycines
gatttaaattatttattctgtaccgtacattcgctgaaatattggctgtatattctttaatttagatattcctaatgtatattagcaaaaaatctttaataatggaatttatgatgttttcttttatttagtgattaatagtttatttctcttttcttgagcctatttttagtatttattgcttttaaataatatataatatttaaattagtatcatattcagttatcgtcatactctaagtaaaaatatccattttattcgtttattttaatttcataattttatgttgttaataatacatagttttaattaaaggttaaaaataattaatataaaaaatatatttttgcaaaattttaaatttcgttttttgtttatggattaggttctttctcaaattaaaatttaattcaattatcgccgccataactttgcatccaaattttcaatcatgcacatataactgttataatttaacaaaattcgcaaaggagagctaaattttattttatctcttactataagttgaacttcatttcgaaattgttttctattatatttaaatttctatacattgactctaatatattattttgaaataattttttttttaaataatattgtttttatggattcaattttatttttcaagtaatgtgcatattctaatcttccttagcagccacattcgtacttttaaatttgttaattttcaattaatttataataaataaaactattagtatcatttttataacttaatcacaaatgtttattgtgcgaaacccttcatattgcataagggcatctttttgtatacacattttttttgtattacatttctgtttggctttaatgagtcttaaaaatgaagcatcaatttaatttttccttactggtccaatattaaatttcgtggtttttcgaaaattaataatttcatatattttttaagcttttttttataaaattaattaataattaaataataaaatagtgaagagcaacgccctgcggaaactaaacccgtcttgtttctattgatttttcacccaatgaaattgcatttttttagtacaataaataaaatttatcattttgatgcaatttaaag

SEQ ID NO: 41297 - DNA, 988 bp, Heterodera glycines
  misc_feature (15)..(15): n is a, c, g, or t
  misc_feature (863)..(863): n is a, c, g, or t
  misc_feature (901)..(901): n is a, c, g, or t
  misc_feature (955)..(956): n is a, c, g, or t
  misc_feature (977)..(977): n is a, c, g, or t
tagggctgggacttntagtgacgaaaaatctcgaaataattaactaaaatagtgagtaaaaatgccaaaatagtggcaaaaagtccaaaataatgacgaatagtgacataattttcagccaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaaatttttttcatttcttaggagtgctttttgaaaaaatttttaggtcgattcttaggggtgtattttttggttttattgcatttttgttaaggaatttcccaaaaaatgtcgaaatagtgaaaaaatagtgacaaaactccaaaatagtgatttttaactattttagtgacgaagtagccaaaatagtgatttctagtgaccgatagtgacatcagaatcgaaaaatttaaacgtagaaatgcgttttttgagctcctttcttcaaatcaattgagcaaaaaaaatagttaaaacctaaaattcccagccctagtaattagcttaataaaaggatgaaaacttcactaatggagcatatcggcatcaacgaattaaaaatggaaacatcaacacatatttccacccaaaaacacttcgtaattcctaatctaatctgatgatcagaatgggtttttaaaaaagaaaaatttaaaatatttatttttcatttatttagaatatttaaaatataaaaattcttttaaaaatttaattctttttttttattatgataatgagcaaataaaattagcaccaacatgtccagttttccttgngatgcttaatattatgaaggcattggtaaaaacagaanaaattattttggatagggcaagaaattcaaattagaaaatttttaaggaatgannaaaataactaattaatatttnattatattttt

SEQ ID NO: 41298 - DNA, 603 bp, Heterodera glycines
cctcaggttccaaaataatttgaatttttgtctcagtggtatatgtgctagtcaccaaaaggggggttccaggttcgaatccgatgcatgttaacggacgtttttggtgattttaagcaaaagaagacttgtaaaatgacaaataaatattctgaaaaataaacaaaaatgataaaacattttgtttcttcacttttttcaaatcatcctttaatccaaatttgttaaattacatcaatttggcattcgtcatcaatttcttccgccacttcttcatccgtgtcatcctcgcccttcctttcttcataattctaaagatgagaattcagaaaagggaaaccttttgaaaaaacaaacccgcttcaattcgtcaatccttccggtgtccagcagccaattgttgacgaaatggtgctccaattgttgcaaaatttgttccgcgtcaggcatacatttccaccattgttcgagtcttcgccacaccgaatgaagcgcttcatcaccttgaaaatattaaaaatttgtgctaattaagcaatttgtttttcaccctgctcatccaaaaggccaatgaattgatgttgtcgtgcaaatggcacaaag

SEQ ID NO: 41299 - DNA, 973 bp, Heterodera glycines
tgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgc

SEQ ID NO: 41300 - DNA, 1027 bp, Heterodera glycines
ttaagtaggaattattatttcaatatattaacaaaaatacaactattagtttcattattaagcttattacatcaatatattagaaaattaattatttaattgttttaattttattaaatttatcgttttttatttactgtagattatttattttacttaaacaaatcacaccttaatttcggctagatcaacttcggaacgtgtgaccagcagtcgaatcagatcgaaatcatttatgggaaatgctaaaaatgatttgaatttgtttacaataattttaatttttcatcttaaagttaattgagatcgtacacgctaataccgcaattaataaataattaattaccttccacggagtggtgcaataaatcagcaaagtacatagggcggtttcgaaggtatttgatgagcgccaaataacttaatgttaaaattaatgggccaaaaattgacaaaatgccacaaataaaaacctcgagaaaatggatttaaattaatggattaaaattttgttttccttagtgtgtcttgagcagttaatgaggatgaacgagttcatcaatttgctatactaattaaggctaattgttcacatctccagcccatctcaatttgtcatactaattaaggctaattaatcccccccccgtccctgcttctgccattaccccgctttgttggcatcgccgaattctttcttgatgcctttttcgatgtcaaattgagcgatttgtttataaaaatcgaaggtgagccgaagctaaaagtgcgaaaaatttacaagaattaccacaaattaatttaattgccgtccagaaatatttaccgataaaattttgtactacaaaatttgttttcttaagctttaaatatctattttattatttatcttttggttttttattaataataatttggaattcgtccgtaaattaaaaaatatttttccaacttgtttgaaatttcgttcggcaaacactttgttgaattcgtgatcattttcactcggattgaagtcggtgattgt

SEQ ID NO: 41301 - DNA, 964 bp, Heterodera glycines
  misc_feature (48)..(48): n is a, c, g, or t
  misc_feature (90)..(90): n is a, c, g, or t
  misc_feature (94)..(96): n is a, c, g, or t
  misc_feature (105)..(106): n is a, c, g, or t
  misc_feature (119)..(119): n is a, c, g, or t
  misc_feature (122)..(122): n is a, c, g, or t
  misc_feature (127)..(127): n is a, c, g, or t
  misc_feature (131)..(131): n is a, c, g, or t
  misc_feature (206)..(206): n is a, c, g, or t
  misc_feature (215)..(215): n is a, c, g, or t
  misc_feature (228)..(228): n is a, c, g, or t
  misc_feature (236)..(236): n is a, c, g, or t
ctgttttgtagcacttttaaatgttgtatatttgctcttcatggggcnaaatatcatatcaagcagagaccggcacgatcgagaaccgancgannngggcggagnngacgaaacacacngcncaagnggcnaaaacgagcgaccaaaacaaacacaccgggagacggagaaaacgagcccgggagacgaccccgagagagacacgnaaaccaacngaagaagaaacancccccgcncaatcgcccgcattagcgccaaaatacaataaaagtgagtgaattttaaaattttatttacttttatattttaagcacaaaataaatactccaatgaggagaaattaaggaaagtgaacgaatacttcgaaatcaaagaaaaaaatccgaaaattagtgacgaaaaaattgctaaaaaatttggaattccgtgtcgaacactgatcagatggataaagataaatttttaggatgggtgacaatataattgtcctctaatgctgctttttacatgtccagacgatttttaccgcattaaattacttgaaatacataacttttgcataaataaacaatggaaggttttaataatgtttcgttttgagtttttgcttgaaatttctttttttaaatttcaaatttccttttttgtcttaagtttttgaaataaaaacgaagtttttatgtaatttttcaagctaatagaaaaatccaagaacaagcatatcaaatcatgatcttattgctctattgcagttagcaacattaaggcttcaataaatttttgtacaagcatcaaattaagcatcattgtgttaatgtgttaattgatagcgctaactgttatctattagtcggctaaggttgaaataaaggccaatttcatgtacttatggccaaaaaatgtaattttctgaaattaattgaaatgttctaaattttggcataaaggagataacgcttaaaat

SEQ ID NO: 41302 - DNA, 1333 bp, Heterodera glycines
aaaattttcgagctaggccccctagaaattttcgaaaattttttttgggttgaaaatgggggtcaaaaatatttttctggggtattttgatgtgctgagcacgaatctgatgttaattttaagtttaggaaattttggaattttttaaaaattctttattttttggcaattttttggccctcgggattttggcctaatatttgaaaattcataactcagttcagatcaggtctattttggtgaattaaatctttataaatagcaaaaaatcgggagaattttatgagatttatttgaaatttataccataaaaacaaaaaaagttattccagaaattctggaaattttcgatttttcagaaaaaaattcagaactcggttctgtaaaggtgtttttgaaattttaaatactgaaaaaatccgcaattttttgctctattatataaattttattttacatttttatccctttttaaaaaaaagttataaaaataaaagtgattttgggattcgggaccaaaggggggtgaccaggatttttgagtggaaaaatttttccacccaaaatcttccaaaaacatgtcattaggggttatttgggccgctgatcacgaatacgtgatcagattttacttttgacatagtcaagacctcagaatccctgtgtgattggggattctgaggcatcattttttgggggggggcaggttcggatccggacggtgtaaattattttcgttatatttatggttatttttaatgtttttaattcatttaaaagagtgtttgttttataataaaaaataaattttttaatttaaattaaattattttttttatgaaaaattttattaaaattaattatttttttaattaaataatttcatatatttttttatttgagtttttcagaaattaatttcatttcaatctaaataaatttcaattattataaacttcaaagttttttttaataataaaaagaggcatttattttacaatttttaaaaattattaatgcatttttgtacctcttctgccatttgttgtacctctctcttttaatcacagttgtacctcttctgatcattgttgtacctcttttaatcaatgttgtaccacttttaatcactgttgtacctcttctaatcactgttttacctcttctaatcactgttttacctcttctaatcactgttgtacctcttctaatcactcttctaatcgctgttgtaccacttctaatcactgttgaacctcttctaatcactgttgtacctcttctaatcactgttttacctcttctaatcactgttgtacctcttctaatcact

SEQ ID NO: 41303 - DNA, 1292 bp, Heterodera glycines
  misc_feature (54)..(54): n is a, c, g, or t
  misc_feature (1233)..(1234): n is a, c, g, or t
  misc_feature (1243)..(1243): n is a, c, g, or t
aattatatgtgctgaattaatattcagctgaaatttaaactttctttttatttntggttttaaaattaaattgtatataaactctttgcattaaaaataaaatcattaactcatgtcaagtagactctttatctgagttgttgctgaagcatgattttaaataattaaatattttttaatatatttagttttagcttgctgttcaggcggcattctaaattcgatattttttcaatattgaaatttaattaataattcttatgataaaatttataattttgcataattatttttttaaattaaattatttatttaaattattagttttcttactttttataataaaatcttatttttctattttttatcaagactatttatattaaataattataataaacataaacttttaaattataaacgaaaagtgttaaataaattttttatttaaaatttatttttcacctttatgtcaagtatttttcaattttaattatgtccccttatcaaaaaacagataatcattattattacatctattattattttattttttactatcaaccattgaaattatattgctgaattagtttgagcggaataatttttttttcattatttacataatatatcacgatttaataagtcgatttactgagcccaaaaaaccccgacttttctcgccccgaaagatcggagcactgtcttaaaaaaacaattaaatagaagctctaattccaggtgtccttttgaatttgctttctctgctacttttttttagttttttaaaaatttataagtattaaaaaaataaaatctaagaattttcttttcaatatcgggttgctattttttccgtatctttttcaagtaatttttacccttttcgatttgcgtaatttatatgtaaatgatttaaaaattccgttaggttaaagtttaatgtatttatatggttttaattatgtttttatttgcacctgtgtttttcataatttccagtatatatttttatctttcctcaagttataaattttattataaattaatataaattacgtattgctcgttttttttctagaatttattttacttgattattgtttaattttcttgggaaatatacaaacagtttatttaatattttctcggaatatcaatcaaacaaatattgagttagtataatccattaattgcttatttgattgattaagaatttttttaaataataannatatataangttttttgttttagcaaaaatatttttattttttgttatgcttgcttaa

SEQ ID NO: 41304 - DNA, 1126 bp, Heterodera glycines
aaaatttgaaaaaaattaaatgcttaccattgattccagcgcgccgattcgctcacgaagcaagttgttttccaacttgagctcctcgttttccgcattcgtgctcgccagtgcatccgccctttctttcaactggtccttcttctgctttagcacctttttgtagcattttttcgcctcctttgcatccgccgcctatgaaaacgactaagtgaaatgatttcttctttaatgcatacatgctgctgaagaagttcgaacagtctagagatccgcaacgagcggctctggagttcaccgcacaattcctgtcggcgcaccatgttgggcgctttggtcttgcaaaactcatcaagcaaatcgggcgagttgacgtcagtgtcctaaaatggggtgaataataatatacttaaggtgcattcaaaggcacccaacttagtcgaaagagaatactataggtacattcagaggcacctgttctaaaagccaccaaaagacagactattctactaataacactctcaaaaacctcttctcgaagtgcatcttcaagcgtgagttcgtttgggttcacgcgctcagacattctggtgtattccaaatctccacacttctcgaagcgcccttcggcagccgccctcgcagcacgggatgtgcgttcagtgtgtgagtgcatgaactccttacgccaatgagccgcgtatcccgagcgcccttttgcgttcttccaaactgaaaaacggaaaaagtttaggcgtattttgtcccacccccccccccccttggaaattacctttctcaaagaatttgtccttgaaggcttcagctggtggccatgcgtggttgtccagccaattggcagccgccctttcatcctcagtcatagtgtcccggggctttaacacaaaagtataaaatttttaaaattttgtaaaaaaaccttttctccttttttgtatttgccttcgaaaaccttcaaatgttctgcagccgccctctcgtgcttcaggtaagcctccatgtgtaggtcgacataacgcgcggattatgtcgttgatagtattcataatatgctcggaaaaaaggattttgatctctaaaataaaggcccttttaaaaaaaaaat

SEQ ID NO: 41305 - DNA, 1345 bp, Heterodera glycines
ttgttttttctttgaattttgccttattttaaccccccctgcccccccccccccccgggggctcaaagcgggtccctatgccaatggaagaatttgttgtagttagtttcgtttctccgaaatggctcctcccttctctctttctctctatgcttctctgctgttgtcttctccaccttattatgccgggtgagagatccaacagaagcacagaaaatggcagaaggaaaagagaaaagggcacagcagggaaaaggaaaaaggggggggggacgaaggtttggttttcaatgccacgggaaaatgacgggaaaagcgaacgaagcagcggagagaaaagggggagggaaatgccgggggaaatgccggcggcgggtaaattctcagagggaaacgaagacggcgaaatgccgccgaccatcgttctctgtttgctgctgttttgtcaacaaacgccacacgcgcaacagaagggcgggacgaacattgcttaaggggaaagccaaagaaaaacattggcggatgataatgaaaggaatggaagggaaaggaagggaatgaatggaagagaagggggggcatttacatacacagcccaacgcagcagaagcattgatgaagccggagggaggggaagagaaagcggaagagagtgatgagagacaaaaaggaacagagagataaagagtggaaaagagagaaagatggagggagagatagaggtgggagggaaatagacaataaaagagggaagagagggaatgatgagtgtaaagagagagagagatagatacagagaaacgctctactctctcctctctcccctcattctcttcctctccctctttctctctctctcagctgctgcttttccttttctccttcccccgtttcttcgcataacttcccaagagaaaaaatggtcacactttgcctaaaaattacaaaaaaagaatgctgtgcaaatttctggtatgacctaagggtttagggcggaacaccaaagaaaatgttttttttatttgtgcgatgaatgcttaaattaattaattgagttaattaacccctttttggtttctcagatttttcgcattgatttgacttaattgagggaggagggggggggggggtaaagaactcttccgttaccatctcttctaccgtcgaaattaatcatttttgtgcggtgatcaccacacaatacacaaagtggtgatcgaagaacagaagggaaagaggggaggataaaaaagcaatgggtggaagaggggaagagagagggaacagaaagggggaggaaagagggagagagagggggcgggagagagagggagggacaaaaact

SEQ ID NO: 41306 - DNA, 1153 bp, Heterodera glycines
gggggggcaaagcaaatgaattgtcaagacaaagtgcgggcaaagggggggggagggtgccaccgcccatcgaccgactgccgggaaagtttttgcccctattatccggcaacttccttttgacctgcgcggtcaaagcttttgcgactttcccttgggctattttcacatccccccttaaatggcgccttttgcctttgccctttcattttgcattttcacccacccgtgtgcgttcggacgtggatcttcatattctcagaacgagcaaaagtcttatggcacatctcacaagtgaacggacgttcgccggtgtgcacgcggagatgattctttggggggggggggaagaagagagaggggcactgactgaccttaagtttgtatttggctttgaactccttgccagagcgcacacaatcttcccagagacaaatgtgaacagtttgggaaaaggcctaatttgatgggattagaatttgattggctttggcttttcgattgcctctgagccatgttcggtgcccgtgggcgtaatggccgatgtgccaagatgctctgtgtctaagtgctccacgagatgctccatctcctcaaactccttctcgcacagcaatcgctgctgccctgccatccccataatccatcggcaccgctttggcccattttccgcgctccttcccgtgccgttctctcttcgcccctctccgctgccctttctattggcatttttcggtgcctttcccaccgaatggcttccgtccttcttcagatttttcttcgttttgtgtcgtccattcgcttcagtgtccatttttccaatttcgttaaaatgttcgaatgatgaaaaatgatcggacgacgaaactgctgaattattaattcgaaaagcttcccaaacaaattagcactagttcatttcacctcttttattgttaaaaaatatgccgtttgagttcgtctcaaaatatgccgtgtttgttgatgtcgtcggcagtggcactgtctctgccattggtgttgtccgaccgaaagatgtgccattgttttggaaagtggcccaactttcatactcagttttgccattaaatggtgtgtatttagaagaagaaaatgatggaatttggtaagggatgtgctgatagtattgttg

SEQ ID NO: 41307 - DNA, 1360 bp, Heterodera glycines
taacttttttctttgccactaaatccaacattcttcgtctcattcgatagccctaagtgctctctattagcctgtaaaatttggaaaaatttcgttaaggttcaaaaaagttatggtcagaagagttcaactaaccaaaatttccaactttttttggctcgaactttttttatactgaacgaaattttttggaattttgcaggctaatagtgcatctgaagggctttcaaatgcaagaaaatgaaaaaaaaattattttggcggcctaaacaattgaatggctcgcttaaatacacaactttgcgggtaagatcaaggatcatcattttcaagtaaaatttgacgtcggatcaaaaaaaacaatgccggattcattttcagcgcttgaggtgacaaaaacattaaaaaaagctccacttcttttttttaaacatttttagttagccaacgaagccgaaaaattccaaaaatattttctattattttttcaacaaaacaaaaacattaaaaactccttctttttttgttacaacattcattatttccccattgaatttttattttcaatttttgaatttctctggtcccaaaagatgcaacaaaatgtttttcccccattgcttgtcactaaatactttttgtcatttgaatttgatttttttttacattttcattgtttccatttccatttttgcataaatttctgtttttaaattttaaattgatctaaaaaacaacatacttgtacagtaagcatgccttaaaaaagtgcaacaatattgcagtgccgaaacctttgccaagattccaccaaaatagcgaccttattagacaaaagaaaaaattcggaaaattactttgcagaaaatacaaccaaaagtgcaattccaaaaatttatgcgcaattaatacgctcagaaaagcataaaaacggttttctgtttggtttggatgccttttttgcctatttcgggggtttttgtgtttaatgtgcctattttcagaattttgaaaaaatcattttacaaaaatgcaataaaattgaaattttttccaaaaattgatcttcaaaatttaatattttttcttcataaaaattttggtttaaaaaaatgtctttattcgaaaagaaatctttaaaatatttacatttacaattgaaatttttattttttttttgtgttttgctaccaaaaaagcgttaataaaaaatgttatatttgcctattacgcgattttttttttgtctaaaaaatcgcagccatacgaaaatattgtaaataatttttaaaaatcgtaaatcatttttaagctggattatagaaatttgatggaaaatgggaaaataaataattatttt

SEQ ID NO: 41308 - DNA, 1000 bp, Heterodera glycines
tggcaggttgctgagagcctcgtggttggtcggtagtgatcggcttgtcttaatcgcgttcttccttcagttgcaaaagcttcttccgtaaaataaaatggataaattttaacgacatttcacagtaaattttcatcgctcgggcttgtacacaaaatcacttgatcattttgtgaaatgaatgtgctaacctcacgcttcaacagattacgcagtttcttctcgaaggctttttgcatcttccagaatgggttaacgagagggtccggaggtacttcaacttcaaccgtctcgacagaagacgcgttctccgactcagtggcatccgcgggcttacaattccccatttctctcgttgattgttatatgcagagcaaagaaatataaatttaaaaaaacactaattgtaagtaaaaggattattaattagtaatataattggtaatactatagatggtgcgccccctttttagaaaaaaaaatttttttgttctaaaaagtcatggaaacatgtttatgggcagttttgagggtcgctgatcaggaatctgacattttgaccaatttcgaatctcggacccgaattcgaagaaaactcatttctcaccaaaattcaccttttattgtccaaaatcgattcaaattttcagtttttgttcaagtttgggtccgagcttcgaaattggtcgaagtggatatcagattcatgatcagcgacatctaaaaccccataaaattttagatgactttttaaataagtgttaataattttgtgtgtacttggattttgtaaaatttgacagttatgtacttgcactatgggtcaactccactgtgcagagaaaagcctagtactatctcgtcgtttctattttctttgtaatttctctcactttggcgtactatctccttattttttaatagaaaaaacagcatttacttcgcgatggttaactttttttttccctatgtttaaatctgcttgaaattttgcatatcg

SEQ ID NO: 41309 - DNA, 802 bp, Heterodera glycines
tttatagatttttaaatgtttcggagccttttttggcgtaccaaaacttcatagagcctggttctttctattctcatgctactcgccccaaattttttttacaggttaactagggcctattaagcgtatttccagaaaatctcgcatgaatgctcattcttacatgattcatagatttttaaaagctaggattgttttttggcttaccacaacttcatcggacctggctctttctattcatcgcctcagatcgccgctaattttttttacagcttaactaggccatattaagcttatttccagaaaatctcgcatgaattctcattgtaaaattttttatagatttttaaatgtttggatttttttttggcttaccaaaacttcatcgaacctggttctttctattctctttcaaatcgccccaaattttttttacagcttaactaggcgatattaagcttatttccagaaaatctcgcatgaattctcatttttaaattttttatagatttttaaatgtttggatttttttttggcttaccaaaacttcatcgaacctggttctttctattctcttttaaatcgccccaaattttttttacaggttaactaggccctattaagcttatttccaaaaaatctcgcatgaattctaatttttaaatttgttatcaaaaatgtttggatttttttttggcttaccgaaactgcatcgaacctggctctttctattctcattcaagacgccccaaaaggttttacagcttaactaggccctattaagctcatttccagaaaatct

SEQ ID NO: 41310 - DNA, 1309 bp, Heterodera glycines
  misc_feature (1119)..(1119): n is a, c, g, or t
taaatttgttaagtaatcatagtttattcaaatagtgcttaaaaagtttgtacaaaagtaagacctaaaaaacggtaaatttaaattcccccccccccaccttttttcaaattttagtcatttcggggtcgctgatcacgaattcggcttccatttcggccaattccgaacccgggactaacaagaaaacaaaatgaaagcgtcaatcccacaatgaacgaccatttaagctgttttcaaagtagaaggaaaacaaaaaaatgcgaaatttgggcgttggaccttttgttcgaattagggtccggaaggagttcgaaatggatgtacacctaatatttgtgaccagagaacccgaaaagcctataaaacatattttatggatttataaataattttcttttcgaattaccctgaaacctagggtactttcccgagggtgggggtcgactgggcgccaaccaactgggcgccagcccggtttttggagcacaacttttttcatagttgtccgaattgaatgaatttagtagcactcgatagccctaggtgttttctataagcatgccaaaattcgaaaaatttcgattaagttcagaggaggctagccaaaattcaaaatttttgaaccattctcaaataatcaatgaaaaagtactcgaaatcaatttgttttccaattttttatcctaaatttataaaatcctttttaatttgaagttctcctaaattgctaaggtgatctgtagagatgggatttttaggtttttacctattttttttgcggcttaattatgatgagagaagcccaaaaatagcattttctcctaacaattttcgatttagagcgactttttagcacctaaaattacctaaaactggattttcggtcaatagcacctattttggcatttttcgagttttagcacctttttggcctttttccagaaatttcatagcaaaactgcaaacaaaaacgaaaaatacacccctattaatcgatgccataaaattttaaaaatatacccctaaaaattgaccaaaatttcagaaaatattcccctaagaaattaaaaattttcccaaaaattcgtcttcaaaatttaattatttgttatcttngaagttgcaattgtgcgggtgaaatcgatcaaactgaatcatttttggggatttttgtgcataaagacatggatttttccaattttttagcacctattttggcattttttggcgtttttagcacctatttttgcactttttttggcaacgtattttaatacctatttccaggatttttaacacctaaaaa

SEQ ID NO: 41311 - DNA, 1591 bp, Heterodera glycines
aaaaaattgaaaaaaaatcgtttttcaagttttttttaattggtttggaaattcaaaagaataattcggcggaaagggcgagcggcttgctctctgcagcttatattggtgaggaataaaaatgaaattattgcaccgcaccttccttaaaacggcggttgcccgtcgcaccgtgcctgcgacaatgaccaccatccgagccacccaaaagaacgaaatgtcgtgtccggtctccagccaaagagccggggaaaaaagtggcgcctgtccgccgttctgtttcgggcccaacccatccacactgaaagggccacgatgccggcggagaaccacgtgtccagcacgtcctcgtctggcgaaaatggatggggtggatattattccatttttaaaccggttaaaattcaaataccccgcttcgagtgtgacggactgttcagaaacgttgaaccgcttggccgcctttgtcttcgcctccgcctccgttcttccggacacccaatacgattcttcgtcgtcaacgctcttcattgtttcccggcggtgtcgaagaatgattgccgtcaatggtgataaaagaggccgggatttggtgaccccaccgaagctgacgagaagatgcaccgaatcccttagatgatcgatttagtaacttcttatgtgattatgtttctgttccgaaccgaatgtcgttcagccacgcattccacgtgttcacgtggtattccgggatgagtcgaagtcgtccgtcgaccaccgccgctttggcccgcttcgccatctctgaagagcgcacgtaccactgcgattttatgatgggctcaatgatgtccttggaacgactgaaaaaaatgaaaaatagtaattggtgttggaaaatatcatgaaaaaaacagcttggaaagtgcagaatactcgccccacaaatatttcgtgtgcataaaattacgacatattccttgggtgttaaacggaccattaaataatttttcaaatttgtataattgctaatgagccgggttcgctttcgtgaatatcttgtgaccaaaaccatgcttttttgccacagtctctccctcacctgcaaatgcgcaattgcatcgggttttccttggtgtcccggtacagtcccatcgccttcagccgcccacgcaccgccagccgcgcgctaaagcgatgcattcccgcgaaagggccgcagcaaggcgcgcaagaaccgtggtccgtgaagatgttgatcagcggaaggccgtggcgttggccaatgtcgaagtcggtctggtcatgggccggagtgattttcaccgcaccggtgccaaagtcgggcagcacggccgagtcggcaattatgggcagccgacggtcggggaaaaacgggtgaacacagtgctgaaatgagacagaaataataaaggggtgggggtcgacgccaaattttactaacaataagggggtcaaaccatgtaaatcgatgacccttttctttttttgtttttcaaaccatacctgcgcaagagggtggtcagtgacagggtcttacgttcgactttgaccacccatgggggggtcagagccccattttttctacgtc

SEQ ID NO: 41312 - DNA, 1260 bp, Heterodera glycines
tggacgcgtaaacttttgatttgacgcgtaaaagtcgattgaacgcgtaacctgcagtagagcctaaaaaaaaattttgtcgatcttagggatgtatttttgaaattttttagatcaattcttaagggtgtattttttgattttattgcatttttgttaacaaattttccaaaaaatgtcgaaatagtgaaaaatagtgacaaaacggcaaaaaagtgaattttcactattttaagtaacgaaacgccaaatagtgatttctagtgacgaaaaatgacgtccaaatgaaaaaattttaatgcagaaatgcgttttttgagctcctttcttcaaatcaaacgagcaaaaaaagttttttcactagaaatcgcgtccctagtaataatacctactggacacggcgattcaattttgggctccaagtacaaataagtttattatttatttagtaatcagaacgccaaaactttgcaaaacttaaaatttttttcggatttcccttgtaaaaatagaagagccgatctcgagttaaaaacttaagtttcacaaaataaacttggaatcgctagagggggtcaaaatattggtctatgcaaaattttaaaaaatttaaaaagctagaaaaattttttgaaagggacgaacatttcataattttaattctttttagccaagtcctcgatttaaggccaaaccaaataaaacttacaatattctccagaattttcccttcaaaaataattatgccttcttctgtaaaagaagaaattgaaattaacacacaacataaggaggactcgaacctgagacccccttttggtgactaacaaaaaattttcttttctaaaagtcgttaaaacatattgggggttttctgggtcgctgatcatgagtctgacattaattttgaccaattttgaatcccggactcgaacaattttcgaaattcaaaattctcacacataaaacaaatttgaattctcgattttttgtccgagttcgggtcctggattcggaattggccaaaactaaggtcatattcgtgttcagcgactccgaaaagcccagaacacatgtttttctaacataaaaatttataaaaaaatcaatttcttgatgaaaaatcatagacaaaatcaatgatttttcgaattctgaactcagatccgtaatcagcgtttttttaaattagaaaacttgaaaagaaaaaccttaaatttattttccgctgggacaccaattctccagtattacccaaaa

SEQ ID NO: 41313 - DNA, 924 bp, Heterodera glycines
cattcaaatcgccccaaatttttttacagcttaactaggccatattaagcttatttccagaaaatctcgcatgaattctcatttttaaattttttatagatttttaaatgtttggatttttttttggcttaccaaaacttcatcgaacctggctctttctattctcattcaaatcgccccaaatttttttttacagcttaattaggccctattaagcttatttccagaaaatctcgcatgaattctcatttttaaattttttatagatttttaaatgtttggatatttttttggcttaccaaaattcatcgaacctggctctttctattctcattcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactaggccatattaagcttatttccagaaaatctcgcatgaattctcatttttaaattttttatagatttttaaatgtttggatttttttttggcttaccaaaacttcatcgaacctggctctttctattctcattcaaatcgccccaaattttttacagcttaactaggccctattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactaggccctattaagcttatttccagaaaatctcgcatgaattctcatttttaaatttttta

SEQ ID NO: 41314 - DNA, 1037 bp, Heterodera glycines
  misc_feature (10)..(10): n is a, c, g, or t
  misc_feature (50)..(51): n is a, c, g, or t
  misc_feature (93)..(93): n is a, c, g, or t
  misc_feature (1013)..(1013): n is a, c, g, or t
tttttcgggncgagtcaattaaaaagattttttccaattgatcccatttnntctccagcctttccaccagtttggaactgcttgtttgtaatntcgtttaatttgttaaaaaattcttgacgttccgtttcaagaattgaaggaatatttggcgtaaagtcagtgtcatatttttgataaatggtgaacaatttctccttcatggaaccaattgcttctgtcaaatcattgactgaaaagaaagattaatatttaatttagaaaatgaatattttcccattttaggcttgaaatagattaaatgaattattatttttattaattttcactaatcaccgctcgtaacaagaaatattcggtttgctaatagagaaaataataacattgttgaggtatttttgctcattttattcatcggtgcctaaaaattaaaaagtttatgagtagaaaattaattagaaaatagagaaaacccatttaaaattaggaggatttaattatttaaaattcggctgatcccttcttaaggtatttattatggatctgttttttatcttatcgtattttgttttattaagaatttgtgtaaaataaaaaattaaaatttttgacttcaagagaaaaaataaaattcgattataagtcttattaccctaacctcttcatctttttataatttaaatattttttaacttatattattataataatgcaatttatttacttttaccagtgctgtctattgatttttggcaatgcttaaaaatttatttcactataataattttttattataatttttgttttttcatttataataaataatctctaaggggtaggaacggaagtccctttttgaggtctaccaattttttttttaatttcaaaaattttttgtaaaggtagcaacagcaccaattcgatgggaatttgctccgcttttgtggcagtgacgaaatcctgcaaaaaaaaaaacaataattggacaatcattaaaatattaattatatagncataataaaaaacgaatgataaaa

SEQ ID NO: 41315 - DNA, 1203 bp, Heterodera glycines
agccaggaatttatagcagttttgtgccaaaaatgacaaattaaaaaaaaattaaatttaattactaaccattttaaaataagaacaacaaatccgaaaagacattttgtcataacttgctttatcagagatggcgtcttcggagtgtatttgcatgtgccattttgctatatgaataatagccctcatacccttcagggacattggcagcgaattcagcatgaggatttgctaaaatttgcaaattcaatggaaaaacataggaaaaggatttaagaaaaattcaaaaaatcttagaagccataaattttcttcacagtcaaccaaattttataaatttgacatcaatcgaagcttagtcttaatgatcttttttagactaattaaaataaaaatatgatttaaaataattctacctccaattccatcagttccaattgccgctgctgctgcagatggttctgcgtgagtgcgttttgactgctcgtacagttgaccatcagagcgttctgggcaaggacaatattctgcatcggcgcctgattaaaaattttgataataacaattttagatttctcgatcgcaagaatcttgtgttttgtacagtaagtttttctattcaagatatgtccttgaaaatgcaagcagattttagaggaattcctgtggaaattttttaaggttaattagccagggatttttgcgatttattatttttttgggcatggttaatgtttttatcatgtaaatgccttttacataactaatcatgtccgggattatgtcctgttcttatctgtctacactttcatctcctcgtttccctactgttttatcaatttgctcaccctgtgctccgattggccctgatgcgccaggaaaaccgtccttgcccggctcgccaggcggcccttgtgggcctgattcaccaggttgcccttaaaaaattaacattaaaaattctcgaaaaatattaatttgacgcgtcacctggtggcgagtcgtccccacgttccccgggcgggccttcttcaccgactgggcctggcgtgccaagttcgccttgtggcccagttgcaccgcgtgcatagccaatggcatcctcaccgggtgggcctcgcaggcctgcctctccaatatcgccttggtgcccaatccatggggagtgggccttcatctcctttaattttttctttcaaaaag

SEQ ID NO: 41316 - DNA, 1072 bp, Heterodera glycines
aaaaatggtctaagtaaaatcgtaattacgctcaaaaagctctcaaaccattttagcgctcccattccttctacaatcgcttttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaatttccttctacaatcgcctttatacatcccattatgagcgctaaaattatcagagtgccgaaaatcgcatgtgatctaagcttagcaaaaaatgatgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaactacgctcaaaaagcttctcaaacaattttagcttccaattccttctacaatcgcctttatacatcccattatgagcgctaaaattatcagagtgccgaaaatcgcatgtgatctaagccttaaaaaaatggtgtaagtaaaaatcgtaattacgctcaaaaagcttctcaaacaattttagcgcatccaattccttctacaatcgtctttatacatcccattatgagcgctaaaattatcaggagtgccgactcaaatcgccatgtgatctaagcctagcaa

SEQ ID NO: 41317 - DNA, 1551 bp, Heterodera glycines
  misc_feature (1516)..(1516): n is a, c, g, or t
aatctgtgctgcgcaacttttttatcttcaaaaaggcgatcaatttgcgtggccgaaacctcgaaaagacgtaataacttgagttgaagtgatctaaactttagaaataaatattaatttaaattcaaatcaatttcattttgccttggttttttgttttttgcataaatcgtccccccatttcgtccgttttgtgctcccaccgaatttgcggatcctcagtccgggaggcaccgaccgcttaaatttaaccaagctttttgattgcgatataactaatttggtatacctaattcaaattgtgcaagcgattaaaactgaatgtgcgcctggcggcacttgcacttgctctttgtacgccgtcggttgcggtggcattccattggtctgaattttgttcttgaatttaccgagattacatattccagagttggaaaccaaggtttggaactaaaactgacaagttatcttcagactcttaaattgcctatttactctcattagcatattttatttatttttctttatgctgttttctattaactaatccactcaatcattgttgccaattaactttatcactttaaaatgcgcttccgtgggaagtgaccgtgccccgctttctccgtcttcgctgtcctcatcatcgtccgattcagcgagtgctatgattcgtgcggcataccctaaagtgaacgaacactttgcaagtggttgatcctcgaagttacagagagtacttttaattacaaaaaagaccaatttggggggggggggggataaacttatttttgcctttaatgtattcaaaaagaattatagtaattttttaaaattaatattgtgcagaaaattcattcagacgatctatctccgtattgtgtaaaagaaggctttaaatctttaaaactttaaattgaatattgacacaaaatgttaagcggcatatgccagcaacgaatttgtccattttttggtgtttaatttcatccctccctcctccgccatttgatcttatttaacagttttgttattaaaaatgattgatggacttgttcccggctccaacaaggtcagccgtgcacttttgcccatcgccccaattcgaattttcgtctcgcggtcaatgtgcccattgtttgtcgtctcgtacaaataaatcaaataatggtccaccaaatgcgcattaaattttggctcgacccacgaaagttcgaccttcagcggaagaaaatggggcggaacaaaaatattttttttacacaaaaataagcaattaaaaacgtttaaatgttacctcagttgtgccgacgtattgaaaaacgatgttccgagggggcgacggactctttctgtagcccctttgtaaactaaaaatacagtaacaaaaaaagaaaaaggaatacagtatactgcaaccaaagttttaaaaaatgcagtagcctaagttgaaacaattcaacgaaaatgatactatgacacttgtttcaggtttttaattgcaattgcattctgntgatttaatatttaccatgaaaaatgttgcgtatg

SEQ ID NO: 41318 - DNA, 1490 bp, Heterodera glycines
  misc_feature (1343)..(1343): n is a, c, g, or t
  misc_feature (1428)..(1428): n is a, c, g, or t
ttggactcataaagtgtattagagcccaattctcttggacatgagattgacccccaatttatgatgcttttgatgtaggaatttcatatatttttatggtggcgacgataaattatgaaaatcaatttaaaagtgagcttttgccattagaaattttgctcttttttggcccgttctttccctttttagataaaaaaaaatatgtcctacttttttcccaattttaattaaatgtttttaatgaaaaataataaaaacacatggaaaatcatatttaaaaaatttatactttcatctataaaatgatttgttggaagcgaatcagacaaagagttttgtaatgtgtaaatatataaatgtgttgatttgctgctttttggggggacaaaattcactaaaaactattccaattttctaaattacgaaatggaggaggcattattgttgaagagaatggcaaacaaacggttaataattcaaatatggacttttgtgatggtggcgatggtttaagcataattagttctctgggtgaataaaaataaaaaacaattaaatctatttttgtgtggtttttgggcaatctcttaacacatggacaaagattaaaaactgatcaaaaagataaatttctttcgcatccaaatcaactaatcattttaaatttgttggactgtcagaagaatttttgatttaaaacgcacttaaatttcaacaaaaatttattttttactttttttcgaaaacaattaaataattgttttctgaaaatctatattaatttttcttaaattttggcattcgaataaactaaaattaataagaataatgattagttaattggactcataaaataatgaagaccaaaattttgtttttcatactttaatatgcttatgagattgctcttcaatatacgtaaaataactatgggtgttttttgtatattataatagccattgtaaaacaaataaaatagcaattttcatgaatttctaagtttgaatatcgaatagttgagatatatgtagaataaaaatattaaaacaaatttgtataatatatattgtattctgaatgtttcggaacatacttttttgtattatagcttgtatgaatacggggagagagagagaaataagccatgaaaatacagtaattcttttttgtgaatatacggtagcaataatatgtaataaagtgcagaataaattgtgtgtaaggacataaaatgaatggaaatgcaccgagggacaaaaaaaaaataataaaattaatttgtgaaaaaaagaagagaaaaatgcagagtgaatttgcttaataatataaaaagtattggtggntggataagtaaacactttcaaatagagccaaaaaatcccattttttaatgaatatttgtgaaaaagtaacggaaaaatgggattnttcatttaagtaccatttcaagtatagaataatggtaggaaagaaagtacacaaatactaat

SEQ ID NO: 41319 - DNA, 770 bp, Heterodera glycines
gcaggcacagattttgagcaccaaatgcggcggcgattttcggtcagtggcggataaactcccaaagcccccccccctccttcacaaagattgaactccttccgacccccttcagtccgatttgtaatatccatcgtccgtccgtccgtctccccattccgctgaccttggggggggggggggggggagatgctttaccaacagaacacaaatcgatgctggtcaaacacttaaaaagcattcaaacttaaaaagcatattctgttaaatatttgttggtgaccttttctctctcccatctctttaattattaatttttgttaaattttgtttatttaaatttttcaaataatcatttttatactttttgttatcgtttccaaacagaaaaaaagaagaatgaaacccacgaagagaatgccatcaggcaaaaatcgaatgtttggctgcttaaggaaatgccattggcactgactctcccccccccctttcccccgtcgcttctctccgctcggagtgtctttttgaaacccttcgccttttgttgttttttctccagtattttaaaattctctcccgggcattcttttctacatttttttttgttttgttgttttgccattccatcgatttgactcatttaattgtgacgaacgaaactcacgaaaatgaaaagcgggtgaaaaacggggggggggggggggtgaagcattttttatcgatagttgcttttatttcaccaacgaagcacttagggggcgggggggggg

SEQ ID NO: 41320 - DNA, 849 bp, Heterodera glycines
cccttaaggtggccagagtccataagcgtgtccgaagcttagtcggggcgcttatgagaagttggtgtgtaaggtacgaagtgttcaggaacggggaagtacggaagagcgcagcgctgttggtgaagaatggtgtgctacagggagacacgttgagtccgctgctcttctgcctctcagtggccgttgtttcgtcttcagtgagaaaactctttgactttgaagttctcataccgggacgaggtgtgatgcaacggcagaaccacctgttctatatggatgatttcaaagggttcgcaccgagtgaagagtccttaaaccggatgcttgtaactatggagcggaccgcctcagccgtagggttgaaggttaataagaggaaatgcgccttagtgagtacccgtgaagcggccggcgaggcgtcagggaatgagattccgaccctcggagcccacgacacttataagtatcttggagtcgaagagaggatagacatcgtttttgaggatgcgtgggaaagagtctgtgccaagatgaatgagcgagtgaggtccttgttacgatcggaaccgacatttggtgagcttagaaaagccatcagggtgacggtgaccccagtagcgaggtatctattcctcaatgtaatcgctggcgggcctagctggggaagcgtcctagcaaatgcccaagattttgacacgcgtgtccgtggcctcctacgggaaagagtgagtgatgagcctggatggcggtttaagcattgtaacgctgatcgcctgtacctccggccacagtggggtggattgggcctggtgtcgattgaaaacactttggttgagtctatcatat

SEQ ID NO: 41321 - DNA, 1658 bp, Heterodera glycines
  misc_feature (23)..(23): n is a, c, g, or t
  misc_feature (59)..(59): n is a, c, g, or t
  misc_feature (112)..(112): n is a, c, g, or t
  misc_feature (1109)..(1109): n is a, c, g, or t
aaaaatgataagctgacagaaancgggagtgaatgggaatgttaatttatttatttatnttgtcaatccctctcgcaattttaattttatactcattatgctaataggttgngattatcatatgaaacaaataaaacattccaaacgaaacaaatataaaaaagtatgagaattaaaataaagcaaaaggtcaaagcatttttcttgtcgtcaaatatctttgacgtcatgttgtcatctttataatctgataaacacctggtgctgttgaagcggaggaggggaaggcgtccatttgagcggcggcccaatcgaacacttctcgtcgaagaggtcgatcaggtcgcgctcgacctgggcggaagcgttgctggaggcggacgagccgaaaccggaggatcccagcgccggcgacaagctggcgttggcacggtgtccaccggtgttggcgttgtgatgctggttcggtttgctgatggtcattggctaaaagggtgggaaacgaatttaagcattgcccacttcgttccattcttgtctttcctcaccccctccacctgctgtatttgctgctgttgtgacgtttggggaattggcggcgtcgttcccttcgctaattgtccctcggtcgtcgttggctgcgatcgataacgagaacccacaaactgtaaaagaacagggaaatgggtgatggagatggtgaaacggacgggtgaagaaaacattcatatcggggggcagacaaataataattatgggatgggacacgccccaatgcgtactgtagtatttacactgacagtatgaggagcatactacaatgtacagaatgcagagcaattttgtcgggaataaagcagaagaggaaatacgaatgttgtaattccattaaacagaaagggcgaaaagggacttcaaatttaggccgaattaaattaataaatggcaaataattgtaaaaataaaacaaatttttatgcgcttaaacaccgcccgaccaattgcttttttgtattaaattctattttaaaaaagggaatgtgtgcgtgtggtgggcgttgtgctttttgatgatttcttttgaagcaaaaaaaaagagagggggaggngagggggtgtttggtgaaggaagggaaggacgatggaaggacaagtggggggggggggggggaacgaattgtgttgtgtttggtgtgcgcttaagcggcgggtgggaaagggaaattatgtatgcacaacgaactttgattcattcgaaagcattcgttgaataaacaaacaaaaaataaaataaattaatgtaataaatttacagttaaacgaaaataaattaaaataaaaaattaaattaaatttaaaaacaaatacatatacatatgtatgcttacaggaatggataacggataccattaaaaacaacattagtaaaatactttttgttagcattccgattacaaattaatttcaaacggcacagttttgcgctccggtaaatgtgggattatttaaactcgaatttcgatcgattgggagaaaaggaaaataagagagaaaacatacgggggattttgaaggtcgttttgctctcgtgcgggagctcaatcgggggttcttcatgcttaaaaagggagaaagaattatcagggattctatggaac

SEQ ID NO: 41322 - DNA, 905 bp, Heterodera glycines
taaatctgggcgcatcggttcggggggactgaccgccataagagaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaattggtgcgtttcagagcagtttgtgaaaaaatatttatgaattaattttgctaaaaaaataaaatagtgaagcttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgattgtgaaagcatcagagagccttatttaacttttaattaacatttggtgcgtttcagagcacgttctaaaaaatatttatgaattaattttgccaaataataaataattaatgaaaaagtcagaatttcgaaaatttt

SEQ ID NO: 41323 - DNA, 1069 bp, Heterodera glycines
  misc_feature (23)..(23): n is a, c, g, or t
  misc_feature (58)..(58): n is a, c, g, or t
agtaataggtatagcgaccattntaagtggtcatacagtctgtaacaaaccataaggnccattaaaatttttggatttctcatacattccatggggcaccccctcccccaataacccacgaaaaaatggaaagtgtaaaagaaaataatttaatgaattttttcccgaaaattggcccaaatttgctgtaacaaaattataaggccacttgattcaacacaaataatttttttaaagagcaagaaaaaacctgtaaaaattcaagtaaacataactctttgtgttgatcaaaaaagtcaattgcaccccaatgatcagatcactccttcagggttatcgggaatgatcaaaattttaacatccccagggacttgagctctctctgaaaattttcaatacgttaaaactacacccaatcaacatgacatcatgcacagacatcctacaacaatttctgattttgaaaaagacccgataaatctaacaacattccattacattgacattttagtgatcaaataccgtaaacgcaagagtaggtgtctttaaaaaattcctagggggttggaaaaattttttggtggaagaataatatcagggtcagataaagcacaaaatttgctacaaaatggcatttggatgatggctcaatgatgcgtctccgccgaggaaagtaagcataaattcagactaccccaaaattgatcatgggatactgtatttttagtctagtcaattttcgacctttcgtttctccatgggcaaaagtcgtagagacatgcggttttatgcattctgtagcaatctctttctgtccgtcataatcatctttaacgaaaatttttccagccccctaggaatttttttctgaaaatttcccaatttcaagccattttattttgatcgacaaaaattcaaaaaaattacctactaaaaatcagtaaacttttgatgctggtatacccatccttggtgtcagatccgaaccctggttaagtcccttattatttttagaccatattcatataagtgatcgaccttcgaaactagaaaagtaccagaattatta

SEQ ID NO: 41324 - DNA, 127 bp, Heterodera glycines
cctgcacatcgccggcacggtcaccctgcaacggcgcgaacttgaagcgcgagttgccgaggtcgaacaaccaatcgctcatgccgccctcacgctgacttcgccggcgtgcagcaggcgttcccgg

SEQ ID NO: 41325 - DNA, 866 bp, Heterodera glycines
gagagagagagagagagagagagagaaaaaaatagagagagagagagagagagagagagagagagagagggggagagagagagagagagagagagagagagagagagagagagagagagacaatgagagaaattaaatgtggattaagcaaagtatcgtttccgcctttgtgtcatgccatttctcaaattgagagatggccttttaactcccatcgactgacttacaaatacataaagcacccgcaggcgcagcaaaggcaaatcgatcgggcaaagagaaaaaacgcacgcgcgcgagcggtttcacagccgcgcgcacgctttgcgaaaatgtgcccgaagcgtgaaattctcgcttgtgccctttgtggccaattttgccaccctcggcccaggagaggggggggggcggggggggcaattccccggcactgtcatcgagacgtccatttgacaataaatgccataattggagagactttcagagttaataaatcgggaaaagtgcatttgaaacgacttttggggagatttttttccttatggtttcgttttcttttttttgcgctgaaaatgccaaccaaaatattcatttgtttttgtatttggcaaaaatgaacgaaagtgtccaattaggagcgaccaacgcgtaaacagaagacagaacgagtcggccccggcacagctgtgccaacgatggccaaacaaacgacgcgtgaatgacgtggtgttgcatgcaccgccccgagggttattttcggcacagaaattgggggaccaatgggggacaaaaggacacaaatttaagcaatgtataaaaattaaaatatggcacaaaaatggaaacggaactcaaatggtcaa

SEQ ID NO: 41326 - DNA, 1084 bp, Heterodera glycines
  misc_feature (997)..(997): n is a, c, g, or t
cggagtaggacaaaacgtcgtcagccgaaacgtcgtcgtacgaatttttcgaccataacttttatctttctcaaccaaattaaacattcttggtattattcgaaagcattcgaaaaatgctattagcctgcaaattttcaaaaattgttatttatgcacaaaaaaatcagagcaaaaaaagttcgaattactgggtttttgagttccttctggacataacttttttgaaacttaaccaaaatttttgagattttgcaaattaataataaacacatagagctatcgaacaacaccaacaattcttaatttgattgacagtgaacaaatttatggtccaaaaagtcttccgacgacgtttcggccgacgacgttttggggtgcaccgccgctgagaacagttttcatcaaaacaccaaattttgcgattataaacagggtttcactgaaaattagccaatttatatgtaaagttttgaaaaattttatgggaatttaatccaattcttaggggtgtaaaagtcgcgtttcgcgccaaaaagcgaaatgcgaaacgccaaaaaatgcgaaaagcgaaacctaggcacatccatgctatgcaggaatgatctgatcaagtttctgttaaagacttatttgatcggcataaaaagtttgcttagaaggaattttttcagaattttggccaacaaaatattgattataaacaatatgaccacccgataattgggtgtggcacacaaactcaaaggtaattggggcaattaacaaatattaggtttaatgaattggtatcattgagaagtccattaaaaacggtacaaaaaggttaagagtatacgcctatcaaagatctaagaaaaataatttaatgattctttacattggcacgaaaattccatacattctacggcacaatcttttcacccttggcaattttttaatgttgaaattgttccgtgcaaatttactgcaaaagttgatcaaaaatgtacacaanttcgggcggttggtcatcagagagtgccgacaaactccattgaaagccgttcggtgagcgtcgatcaaaaaatgggaaaagtgtacc

SEQ ID NO: 41327 - DNA, 828 bp, Heterodera glycines
  misc_feature (111)..(111): n is a, c, g, or t
  misc_feature (553)..(554): n is a, c, g, or t
  misc_feature (560)..(560): n is a, c, g, or t
  misc_feature (562)..(562): n is a, c, g, or t
  misc_feature (566)..(566): n is a, c, g, or t
  misc_feature (580)..(580): n is a, c, g, or t
  misc_feature (583)..(583): n is a, c, g, or t
  misc_feature (585)..(585): n is a, c, g, or t
  misc_feature (598)..(598): n is a, c, g, or t
  misc_feature (601)..(601): n is a, c, g, or t
  misc_feature (603)..(604): n is a, c, g, or t
  misc_feature (612)..(612): n is a, c, g, or t
  misc_feature (614)..(614): n is a, c, g, or t
  misc_feature (617)..(617): n is a, c, g, or t
  misc_feature (620)..(620): n is a, c, g, or t
  misc_feature (627)..(627): n is a, c, g, or t
  misc_feature (629)..(629): n is a, c, g, or t
  misc_feature (632)..(632): n is a, c, g, or t
  misc_feature (638)..(638): n is a, c, g, or t
  misc_feature (643)..(643): n is a, c, g, or t
  misc_feature (646)..(646): n is a, c, g, or t
  misc_feature (653)..(653): n is a, c, g, or t
  misc_feature (657)..(657): n is a, c, g, or t
  misc_feature (660)..(660): n is a, c, g, or t
  misc_feature (666)..(666): n is a, c, g, or t
  misc_feature (670)..(671): n is a, c, g, or t
  misc_feature (675)..(675): n is a, c, g, or t
  misc_feature (677)..(677): n is a, c, g, or t
  misc_feature (679)..(680): n is a, c, g, or t
  misc_feature (682)..(682): n is a, c, g, or t
  misc_feature (690)..(691): n is a, c, g, or t
  misc_feature (701)..(701): n is a, c, g, or t
  misc_feature (712)..(712): n is a, c, g, or t
  misc_feature (720)..(720): n is a, c, g, or t
  misc_feature (722)..(724): n is a, c, g, or t
  misc_feature (732)..(734): n is a, c, g, or t
  misc_feature (738)..(739): n is a, c, g, or t
  misc_feature (744)..(744): n is a, c, g, or t
  misc_feature (746)..(747): n is a, c, g, or t
  misc_feature (754)..(755): n is a, c, g, or t
  misc_feature (762)..(762): n is a, c, g, or t
  misc_feature (773)..(773): n is a, c, g, or t
  misc_feature (782)..(783): n is a, c, g, or t
  misc_feature (792)..(794): n is a, c, g, or t
  misc_feature (798)..(799): n is a, c, g, or t
  misc_feature (805)..(805): n is a, c, g, or t
  misc_feature (810)..(811): n is a, c, g, or t
  misc_feature (817)..(817): n is a, c, g, or t
gacatatcatttgtatagaaaattcatttacgtcaaatattcttcaatttttccaaaaacaaaagactttttatagaaaaatagtgaattttaaaaaaaaatatctttccnatcacatttcaaatacttaaataaaatttttcattaataaaataaaaataaattatttaaattttgcactcaaaaaatattattaatttccgtctaatattttagcattgataatgaaattttcctattcaaaatgcttttgggtggtgacacatcaaattaattaaaagaaaattttatttttttaaatggaatattaattttaccaaaaatatttgtttaatatttcattgtctgatgacaaataatattttatttattctttctttcacatcaattgtttcttcattctttaatttgatcagaaccagttgacaaattctgcgtaaaagtgaaaaagaaaaataaatatttataatcgtttaaataatttttattatttagtcattgacaattcgaggaagttgtatgaaaaaaaattttactattaaaattaattaannttattngnttantgtgtttgaattantananattttatttttgnttnannagaaaaananggnggnaattaananggnaaaaangatgnaanaaatggnaaangangtgtgnaagnngatnantnngntagggganntaaattttgngattgggatanataatatnannnatgaaaannnaggnntgganannaaaaagnntaggttnaatgtgtgatntaagaaaannagtgaaaannnaggnntggatntattnntagttntgagtgttgtt

SEQ ID NO: 41328 - DNA, 983 bp, Heterodera glycines
aaaatcgaattttttgttttcggggcagtccccccgaaccgatgcgcccagatttatggggagaccgaatccttcgggaatagcttccctatagcctgtactttaattctgcgtggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacagaaatgctctgaaacgcaccaaattttatttacatgct

SEQ ID NO: 41329 - DNA, 830 bp, Heterodera glycines
cccgaccattcagtcacattcattgatcacttatcctcctcccttcagggatcaatctcgcagattaattaccctttgatagcttatttgctttccggctttttctctgtctcccaccttcctctgatcactcttatttctcctctccatccccttttctgatcagttgtccttctcgtccaatttattttccttcctccgtttcttcccctttcagctctttgacggatcattcggtggtcagtcttgccgaaaatgcgctgtcccttcgtggcgatgtgctgctcaaatgctgcggcgtgccgtcgctgaacggggcggagaagcaattgcttttccagtgccaattcaacacttgcgcacttagtttggacgctttggacagtcccaaattgcgtttcttcaaggacgatctcgactatgtgcacgaacgtcagtcacttcattaaccaattaattattgaattactttagcccatttgttgtcttcgtccgcttcgttggaaatttcctttgaactcgctgacccccgtccgcccgctgtcgcccccgctgctgctcccactttgaacaacagaagcaacaaccgcagcagcaccagcgtgtccatggcaaaccacgcaaaacagcaacagcaaaggaagtcggcgtcgccggcacgaatggcgtcggcgggcccaatgccaacaattgtcgccggcggggatttctcccgggtggacagctatgagaatttcgaaagagcggaaggtcggtttccccgctgccggggggcgaatggttttgtttttgggagggcttttgctttgtttcttcatattctgaataga

SEQ ID NO: 41330 - DNA, 1212 bp, Heterodera glycines
  misc_feature (22)..(22): n is a, c, g, or t
ttcaaaataattgacaaaatantcgaaacaattaaatttcaaaattcgcttggccgagtccaaaaattcctaaatcttattaaaaaaattggctcaaaatcgaaaatattcagcactttttgggcaaaatctgttaacagacccatgcaaattttcaaaaattttcccggcggcgcctatcggcaccgccggacccctttctcctgaaaagtctttagaaaaagcgcgccgagaaaaaaagatggttgaaaaagaaaaaagtaatcagaaatttttgatcattttttgaataagattcacttttttcaaattgccggatccgaaaccggtttccggattgggaaaaatttaaattttcacatgttaatatttgtaaaaaccggcaaaatttcatttattaatataaaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttattatggaaattataaaaaattttgactatatggcataaggtaaaaatttaaaaaccccgaaccccgaccccgacccgaacaatttggtcgaccccgaccccgaacgattttgttaaccccgaccccgaacttgctgaccccgacaaccccgacttttctaaccccgacgttcgggggtgcaaccctaaaaaatgcaataaaaacgataaatacacacctaaaaatcgacctgaaatttttcaaaaatgaattcttgaaggctgggaaaaattttctggaaaatccgttaggtaaaacggaatgagcacaaaatttttcacgaatttcatatttccttaccaatcactcataaataaattttaaaaagttttaatcgatttttaagggtgtgagaatttttgaaaagtctcggattttgtgtttcgcggttttcggactcggggtaagtcgcgaatctcaggaagttttcggtaagcattccgattgatcattctctactccagcggagataattgatgaaaatttccgtgatgaactggaaattgtcattaacaatatctaattgtgtgactaaaaaatgacagcctaaggcgagccgaaaattgttgtgccatggcatttatttggttggaccgcgaatatgccaagcttttaccgtttt

SEQ ID NO: 41331 - DNA, 945 bp, Heterodera glycines
  misc_feature (44)..(44): n is a, c, g, or t
  misc_feature (73)..(73): n is a, c, g, or t
  misc_feature (115)..(115): n is a, c, g, or t
  misc_feature (130)..(130): n is a, c, g, or t
  misc_feature (158)..(159): n is a, c, g, or t
  misc_feature (288)..(288): n is a, c, g, or t
aaaatccccgaaggccaaaaaattgacgaattttcaaaaatttntaaaaatccaaaaaaaatctgaaaacganatacaaaaggtcatattcgtgctcagcacctcaaaatatacnccagaaaaaaatttntcacccccattttggcccacaaaaaaannaattgaaaatttctagggggcctagctcgaaaatttttgaaaatttgagaaaatgaagtacaccgttcgatagagcttaaaaagctctacaattttgctctaaggcattttttgtctaaaaccgacccnctgacgagttatgggcccgggactcaaatgtcccgctcaggccaaaaaatttttctatttccgggaaaaaatcgaaattttttcaaaaatatcaccaatcgatagagctagaaaaactatgttttggaagtggtcttcgtttttctgggaaaattcgttaaaaattcttaaaattcaaaaaccaaaaaaccgttttttaggcctagctcgaaaaattttcaaaattttcgaaattttaaaatttagaaaaatcgagctttcgaagctctacaataagtctgctggccaccctgcgctcaggtcaaagcctaatgagttattcaacggggactgaactggacaaatttggtactgaatttttgtagaagcacacaggccatggggttagagatagaggcctggaattttttttaacatttagccaacacttcaacttagggccctcacagcgggaattttttgatccgagttttaaaaaaaaagttacgggccctaaactgcaagaaaaagtgagaaatcggtccccgggactcagtcgtccgcgcagaatttttctctatatttttcccggatgcgccgtgaaaagttgtaagaccaatgcacaactttcaaacccgtcccgttagccattcccgagaaattggttttaaggatgaa

SEQ ID NO: 41332 - DNA, 1590 bp, Heterodera glycines
gctctcaaaatgcatacgaattattagctagcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcaaacttcttagagggatttttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgac

SEQ ID NO: 41333 - DNA, 977 bp, Heterodera glycines
  misc_feature (956)..(957): n is a, c, g, or t
atttcactagtagggatcggatttatagttttttcactattttttatcctgagttccccatagcctgaaatgcacgaaaggttgttaagctacttttcgagttattagcaactattttatagttttttatttttagcaactaaaaaactataaattttttgaaaaaaaactattttcaattattttggcgttttgcctaaaatttgttaacaaaaatgcaataaaaaggaaaaacccacccctaaggatcaactttttgaaaattttcaaaaatacacccctaagaatagactcaaaaaatttttcaaaaatgcgcaccacaatgaaatgaaaaatttctcaaaaattcatctccaaatttatttatttattttcttgacattaattctattttaaaaatttttatctcaataatgatttgtcttaatattgtacctttttttgttaaaattttacgatattacacccctaaatttgaaatttttagcaactatttacccatttttagcaactattttgggggttttttagaaactaaaaactaattattttggcagtttttagcaactataaatccgatccctaagaataacaaaatataattgtttcttataaatgaaataaatatcaaaaaaagtgcaaggtcgaacctaaaaagtaacaataaaatcatattttattttattattaattttatttaaagcagccttggcctaaaaaaatcaataattgatatataaattaataatcagttaaagtttcatttttaaaagatattttaggtctatataaattttctttaaactaaattaacgatcatatttcttgaataatttcatacggcataaataatgctacattcaacctgataaaaataaactttaaactgttcaacaaaatatcaaaataaaaaatattatataaatttagatttttcaaaataatgtataaaaatnnaataaaatcaatttacaaaa

SEQ ID NO: 41334 - DNA, 1068 bp, Heterodera glycines
tgtgaattttaaaacaatttgttaagaaaattgctaataatagagcctgtgaagggctttctaatgatagcaagattgttggatttggtcgacaacttaaaaagttatattgactcaattttggccagacggagtttgcccgttccggtctatcggcaccgcggaccctaaacccttacttttcttaaaaattagctcaaaatcgcaaaaaattggcatttttggacaaaatctgttcataaattgcactctaattttctaagttttccccggcgtcgcttatcgacactagttggtacatatatcactttttgaaaaaaaaatgttttttgctttcaaaaatcaccaacgaaaaattgtttcctaggattttctgattcgctgatcactaatccggcatccatttcgaccaattcctgtcttgaaaccaaattcgaacaaaaagtcgaaaactcaactttttagtcgtgatcagcagggcttccttttttctgccgttgctcagcaatcgttgagtacatccgaactagtgacaaataatgacataattttcatccaaaaatgagcaaaaaaattttttattcactttttgcagttgcaaatgaggtacatttcctttagaatagtttcttcgcaaatattattctatcagaaagtgtgctttttttgtataaagcaaaaaaataaataaaattttatttcctataatatctttcaaggaaggatgggacaacactttgaactagggttgcgtccccgaccgtcggggttggaaaagtcggggttcgggtcggggtcgacaaaatcgttcggggtcggggttcgggggttttcaatttttgccttatagcataaagtcaaattttttaaattattttagcttaaaattttttattattcataataataattttatgtacttttttatttctttttatcataaatatttttgtatagaattaattaaaacgataaggcatttttaaatgaacaattttcaatgaaaatctgtaaaaattgtcaaaatttcaaatttttcctccgggccggacccacaaaacctatttt

SEQ ID NO: 41335 - DNA, 1344 bp, Heterodera glycines
  misc_feature (1307)..(1307): n is a, c, g, or t
  misc_feature (1316)..(1316): n is a, c, g, or t
tggaaatttttattttaaatggggttttggctgattcttggtgcaatttttcgtgatttaaaccggctcaaaaaccggttttttgatttttccgcacctcgggaatattttttacgatgattagaagtcattagagattgattggaaccctttttgggcggtttttttttgcgggcccacaattctatagtaaagcctaatttataaacatttgagttaaaattacttaaacctattcaaaagcccacccaaaaaagtgcaaagcaacaaaaatttttaacttttcttttatgcctttcaaatataaaaaagattttaaaaatccggctgggataaatgggcgctggcaaatgggcgccagcacggttttttaaagtcatccgaactaatgaattgatattatatgtgttctctaataacctgcaaaatttcaaaattgtatcttaaggtttaaaaaaaaattattactaaaaaaacttccaaaaaactggcttttcctaacattatttggtcataacttttttggaaacataatgaattttttttgaaatttggcagattaatagaagactctttctcttacattaggattttcaaatgataacaattaattcggttatacaacaactattaaagaaattatactccaaaaacggggtggcgcccatttgtcctccaccaaaaaattgtctaactaaacttgaatttgcaacaaacattgactcattttcaaaatgattctcataaaataccgaagccactggctataattgaattgattgccaaaaacaacccaacagtattggccataagaatctgtataattactctactaattaatcattatacttcattaaataaattgtttgtgcctcataaaaaaaatttctcagcggcatttgctcagcagtggtcgaaggttcggcagaggcggtccctccgatgctttcgccgattcatccacaacacttaatgaacgcgtccgggctcgactaatggtcaaattggccgattttgagcagcgaaatgtgcgccgaattggcaccaaagcgacggcatgcttttatcggggctttattgggcactcccgcggattaagacaattcaggaaatattttacaattttctgagtctttttggcgtacgttgtgaaattcggttggttctattgcactttttgagtccaatcaaaattttatgatttaatcaataatcctatatttttggaaagtaatttccgaacaaactataaatttttggtatcatttaaaacacaaattctaatgacgctagaatatacaaaactntaattttanacaattgaaaaaaaatgattacttaagc

SEQ ID NO: 41336 - DNA, 1147 bp, Heterodera glycines
aatttttggctccaccaaaatgcccacgttgtcccgtctcagctcactgcttgctgtcctcttctcggacaatgtcattcggtttgtgtagagaaagggggagatagactgttacgggatgggatctccctgggttttttacccaaaaaaaatttttttttgaatttgcaatttagggattaatccatcgggatcccatccgcaaattttttttattccaatccagcagcggaatgagtattataaatgttttatttttcaaaatttttagcgttggctcgaaaaatcaggaattatagcggtcttgcaccaaaaaatgacaaatttttacaaaaaaaaaaatcgaggggggggggcgggcacgtgcctccttcgctttcccctggatatgggcctggttttattacatttttggcatttttaaatcctttattaaacgatcctccgtcttaaaggctttacgacgtgtcatcggcggtcgacagtccgttgattcaatttgatttcaatgcgttgttgccagaccgaacgcctgacgacagtgaggcgagtggagacgaatttggacgaggacgtgcccattctacgcttggtttcatcactcaactaggtacatttctgatcaaataatttgccatattcccagatttctctcaattagagccccctgaaattttttaaaaattttcaaaagaaatttcatgaattttttttttgcgatttttagtaaatttttacctcaaattaattaattcatttttcagtttcttttgactttggaccccctcaatcggtggatggcaatcggacagtgctcggctctcttctcgcgttggattcgaatggccaactttacgccacacttttcccctttgatgggattgggttggaaatttattttttttaattcaaaaatttttaatttaaggccctgtgctcctccgaagggtcccctgcctttgtttgccttcccggcttcgtctcagcaccgtttgctttgttcttcgctcgatttgctgcacattcgtcatcacttcggtgttcaacactttttgttgtgggttatggcatcggaggacggactgttgacccatttcatacttcccatggttagaagttggcatttttcggtttggcacccattttt

SEQ ID NO: 41337 - DNA, 1400 bp, Heterodera glycines
gtgacccctgaaactttaaaataaaaagtcattcctaattgttggcattggcaccaccgccacagcactgatacatttggacaattaggaaatgggaacaaaaatcaaaactgatgaaaaaacaatgtgaatgacgggtttttattaaaaaataataataattaaaattagaaaacttaaaaaaactgctctcataaaggaaggtgtaaattttttgcgtaaaaaatagacatttgaacatgatggacagggagaatcaatgaaaattgcaccatcgattagtccgatcgatcaatattcattcattatttgatctcgctaccgacaatcccgaaatgccatcgctgtgatgcccaaggaatggccctggtacgttctgaccactttgcacgcgttcaactcccacattcggagaatgccatcagacgaagcggtcaccatatgctggaaaaacaaattttacatacatatttcatgaatccatcaagaaaatattacgcttgaatcgttggtaaatgcgcagtcccaaacccatttgttgcccggcactgagtaagtgttcaactgaaaacaaacaacgaaaattgatcaatccgacgacaactcagggcacggtgaacaattaattaattactcctcacacaaaaataattggttgtactacgtctcccaccccccgccccgttttcccgcgagaatttgagggggggggggcgagctgatcccgaaataattttataatttacgaagtttctaaattcgtccaaatgcaccgaccagcttgtgcgtgttgctgctgcaactccacagtttggcggtttggtcagctgatgtggtggccaccgcgagtccgtcgggtcggaaacggcatttgagtccaaatgtgttgtgtgcccgcactttggtgcactggtagtggtgctttgcggcgccagtgccgggcattgaaaggggcggcggcgacggacgcatcggttggggcacggccaacggcgtcggatggtgtggctgtacgtgttgagcatgtgttggtacaacgacggagtggtgatgcggttgctgatgatgttgcaattggggaaggtgatggacgagatagggttgcactgcaaaaaaaacacattttgagaatgcgacataataaatacccacaaaattgtccggaaaaaatcccggaaattcttctgaacaagattttcactgacaaatcagctttttttaatcttgagcacatattagacatacgggtgcattaagtacgttttcaacctcacggataaattcacccgtatcgtttccccccaaccccgtaaattttttttaatttttgcaaattaaaaaaaaaagtaattaatcataaaatgtggagaaaacgctaaaaaatttttaacacattctaa

SEQ ID NO: 41338 - DNA, 819 bp, Heterodera glycines
tgccgtgccatcattccccgatcgatcactcaattcccctccccctttggcttcttccccccccccattattcgctttcgctcactttgctgtggaaccctcgccagcaacaaaaggtcatttcggctgtcgtcgctcttcttttgcgaattctccgccgttccaatgggagggaatggcgaattgaactgatggaaaaggggcggcggaggagggaaaggaaaagcgactgaaaagggaaaatgaaaggggaaaagaaaggcaatgaaaagccatgccctcgggcggcggagattggccaaagtttggggcggaagaagcgcaggggaagaacatggaggaggaggagggagctgaacggaagggaaagcacttccgatctacggacagaagaagcggcgacttccgccctcccccccgctctcgacggactgtttcactcttccaccggtgacggagcaagacgcaccccccccccccgcaaacacccttttgccttaaccattcatttcattttattttcccctccatagccattagcttaatccgcatccattaggcgactttcagaattctctttgccagttagcgccgtgaaacatttaaggtgccatcgacggacttttggcatcgtatgtttcaaagtctctgagacttacttaagcactaacaaataagtgtgccatcattcgaccggaagaacttgtttttatttaatgttcttttaagcggcatagaattttgttttagtgagtgtcaatacagtaataggtgaatagacggaacgcgtaatcaagggcgtatccagggggggggggg

SEQ ID NO: 41339 - DNA, 470 bp, Heterodera glycines
tatcacatttaataaattcctttaaaattttctaattaaaaaatatttaatccagtatttttcatttttccatcaattaagaggcgcttctcttttccatttctgctccgcagctatttttttattagcggtgacttgtatcaccgtggctggcagaaatggagagaacaaaaaaaactgtttgtaatttgtttattggacaagtcttttttcaaatttaatttaattattaaaaaaatacatttgtattttgtacttgtaattttagtaccggaaatgcacattttccgttttgaacttaaattttagttttttttttcggttacgtttttttttgtattttcaacaataattttgctccgattgcgttttttttgtaaattaaatttttttaacttttttcgaaatttcattatgaatactacttttttaacaaaataaattctttttaaaaaattttattgaaaaat

SEQ ID NO: 41340 - DNA, 988 bp, Heterodera glycines
  misc_feature (920)..(920): n is a, c, g, or t
ttgcaaaattaattcataaatattttttcagaaaatgctctgaaacgcatcaaattttatttacatgctagtttaggcactctgatgcttttactatcaaaaagggagatgaataaaatttttaatttgctttttaaacatgccaaaaagtttaggcttacattaaaaaaattttcttcggctctagctctttcaataagcaataaaatcgtaccaaattttataggcatactccccggtacaggactaacttaacctgaaaaaatgacaattgtaattgattttaaatttttttagaaatttgagtttttaactgtttattattttttgcaaaattaattcataaatattttttcagaaaatgctctgaaacgcatcaaattttatttacatgctagtttaggcactctgatgcttttactatcaaaaagggagatgaataaaatttttaatttgctttttaaacatgccaaaaagtttaggcttaaattaaaaaaattttcttcggctctagctctttcaataagcaataaaatcgtaccaaattttataggcatactccccggtacaggactaacttaacctgaaaaaatgacaattgtaattgattttaaattttttagaaattctgagtttttaactgtttatttatttttttacaaaattaattcataagtatttttacagaaactgctctgaaacgcaccaaattttatttacatgctagtttaggcactctgatgctttttctatcaaaaagaaagatgaataaaatttttaattgctttttaaacatgccaaaaagtttaggcttacattaaaaaaattttcttcggttctagctctttcaataagcaataaaatcgtaccaaattttataggcatactcccccggtacaggactaacttaacctgaaaanatgacaattgtaattggagttttaatttttttagaaattctgagtttttaactggtttattatttttt

SEQ ID NO: 41341 - DNA, 519 bp, Heterodera glycines
tctcttgttttctcgtattattacattattcagactttgtggctttcgaatgataccaaaaagatagggtttgtttgaacatgaacaaagttattgtataaaaacccaggtattgtcaattgattggactcataaaggtcgctcataaagtgcactagagccgataattttgttaatttcaagaaaaattggcaatcatgtcgatactaaatgaggaaatatataaatgaccgtcttctctcccactctctcttccaccctcccaggcttgtctgtgactttctttctttcaatcaggcctccatttcgaccaatttcaaacccctaacccgaattcgaacaaagtcgaaaattaaaatttttcgatttttagtctaaaaatagtttaaacgattttgttgtagcactgatgagtatcagtgatgactttcagtttgttttcgtctgtgtaaacaaaaggtggaacataaatttgaaattgaaagaacttgaattttcgacttgttgttataatttgag

SEQ ID NO: 41342 - DNA, 724 bp, Heterodera glycines
cacggcgagtcaattttggactcccagtgcaaataagtttattatttatttagtaatcagaacgccaaaactgcaaaacttaaaatttttggagattttcccttgtaaaaatagaagagccgatctcgacttagaaaatatactttcaaaaaacaaaatagaattcgatagaggtgcacaaaatatggatctatgcaaaaattcaagaaaatctgaccctaggaaaaattttttgaccttagtttttccatatttctctcatcgatatgtaggaatgaatgaacacaaaataaccaaaatttgcaatattctttaatttttccccttttcattatctgctctttattcattcgaacgaattaattaatcatgcatttaatattaggaaacagtaacttaattttttgattgcaccgcttccacttaattacctacccaaaaacgtggcttttttcgtttgtgccaactgcaaatgtaaacaagcttttcggacaccacagacatcgccttccaaaccaaaccaccttatgactgagtcggttgagtcgtgttcatcgtccaatttcgtttccgaaaactcaaatttttcttcaccgacgggagaggaggacgtggagggcgaattttacgattttaacattgacaaatttgtgcaagaattaattaactctgccgtaagagaagcaagttgcaattgtgcagaaaacgtacggagaaacagcac

SEQ ID NO: 41343 - DNA, 1072 bp, Heterodera glycines
gaaagacgcgacgcagagggtgccattttgggatgggaatgtgttggtctcgagcacttgactctcgagaccagtctatgaaaagccgtggggcgtttaaatgtttaacgcacttgaaaatcgaatgtgaaaaaaggctcaatattaaaatttgattttggtttattatttttttaattattcgtttccggtttttatacatcaatttaaatgtgagtcgagacccgattcccgaagtgttatagacgcgaaaacctaactaccgattttctggcttaggggatcaaactcagtagtgttggggggtgccgagtcataacttaatttcgataaaggcttgacatcgttggcgcacgctgtcctgtctaaacacgtggatgtgatccgtttgttggtggagagcggcgccgacgttggcgtttttgacaacgaaactctgcgatcgccgttgacgattgccatcaacgagcaagaaaatttgaacactgagattggtcagtcagcaattaaaggcagtgaaatataaatgttcaaaaaatttgggttttctttcagaaatttttgatttttatggtttattctgcgaaaagttagtgttttcgaatgacatatttacattcatcgaaatatttcaataaaaaagaaaaaattcaaaattaacaggggatcatttttaaatacataggtcaacaagaaaagttaaaaattatgaactcgtctttgcctgaattttagctaattaaggtttttctgggtccaattaaatttttttcaattcagttcgtctgctcgttaagcctggcgctaacctaaacagcgcggacataaatggacggaccccgttgattttggcgaccagcctcgaaaatgttgaaattgtccgtttgttgctggacgccggagcaaacccaaacattttggacaacgaaagttggcccatattgaattaatttaataaaattgtgtttcccccatatatttattaacccaagtttttatttatgatagatcaaactgcattggattacgctgttttgtcgaacatgacgggctcattttgcttctggaggat

SEQ ID NO: 41344 - DNA, 804 bp, Heterodera glycines
aatcactgcaatatgcttatttctaaatttatgtacctctcctattattaccattaaaattctgaatctacaatttttcttggctccaataaccaaccaccgggcgcctcctgaaactgtttttcatcgttcatctttgtttggttcttcttactctattcccgcattttttatttgtggcacacaaactctggcaaaaacaaaggagttgatggccccaaaaattcagtatttaatcacttaaatctttcttcccaatcactgcaatatgcttatttctaaatttatgtgcctcttctattattaccattaaaattctgaatctacaatttttctgggctccaataaccaccaagcgcctcctgaaagtgtatttcatcgttcatctttgtttggttcttcttcctctattcccgcattttttatttgtggcacacaaactctggcaaaaacaaaggagttgatggccccaaaaattcagtatttaatcacttaaatctttcttcccaatcactgcaatatgcttatttctagatttatgtacctcttctattattaccattaaaattctgaatctacaatttttctgggctccaataatcacctagcgcttcctgaaagtgtttttcatcgttcatctttgtttggttcttcttcctctattcccgcattttttatttgtggcacacaaactctggcaaaaacaaaggagttgatggccccaaaaattcagtatttaatcacataaatctttcttcccaatcactgcaatatgcttatttctagatttatgtacctcttcta

SEQ ID NO: 41345 - DNA, 620 bp, Heterodera glycines
ctttacgatgtaactctctataggtctgagtagagcagcgcgggagcaggaattttgcccaaaaccgggacttgccgggacctgagaagccgggaccggaacctcgattttcgtgcgggaaccgggaatttttaaaaattaaaaaaattcaaatttaatttattcaagtgaaaataatacaaaattaaatttttaaacaaccagaacaagatttaaaaaacagaacaaacattataaataatatatttatgaattcgaacgaaaaaggcaacaaaagacaatgagagagcatttatgaaaataaatgaaaaaaatccgtttccaattggtgagatcgatcatttcacaaatataattaattcacttccgcacaatttgacattttcacaaataatcactcattccgctgatcattgggcccggaagtcgtcgagaacatttcatcgttgctttgacccgcttcttccgatggtggcgacaatggcctaaatgattaagtgcacttttgacttatttaaacaattgaaatgtgtttttttttgctcacccaatgcattgtttgtcaattttaagcataaattggacattgttaaaatttgcatccaaattttcgtcttccc

SEQ ID NO: 41346 - DNA, 1286 bp, Heterodera glycines
  misc_feature (1240)..(1240): n is a, c, g, or t
gctactcccgaaggattcggtctccccataaatctgggcgcatcggttcggggggactgccccgaaaacaaaaaaatcgattttttcaagtgtccgtttggggtactcaaacaattatggggagcaaaaatccatcgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaatgtcncgtttggggtactcaaacaaattatggggagcaaaaatccaacgca

SEQ ID NO: 41347 - DNA, 1102 bp, Heterodera glycines
  misc_feature (18)..(18): n is a, c, g, or t
tcaatattgggtattaantctgagtagaaaacttaagtattctttattttaaaaatttcaaatttacaatagcaaaaactttttttcttctttttttagtctatatttttttgtgagcccagttagtatttacaaaaatataagccccagggcttcatttaattatttttggcaaaatcatgacgaattttgtatgcattatccaagtttgatggaatttatgtaagaaacgtcccagccccgatttctttccatcaaatctatgtaaaatctttttggctatcatctttgtttcatatccatgtccgaattctttcatccgccgactgtcactaatcattttatcaatctgttttttttcttttgcagtaaattttacatttttctaaacttttctcttgcttaatacgtcactaggggggttggggtgatttccctaccgccacttccctaccgccatgtccctaccgccaattccctaccagccatttccctaccggccacttccctaccagccatttccctaccgccatttccctactaaggcatttgggccatttccctaccaaaaattttttgaaattttttggcaaaatttcaaaaatagaaagggtattttcaacattttgatgtttctcgtgaattataagacaataagttttttgtttaagttatagattagaaaattcaggcaattctaacacaaaagaaccgtacaaagcttcaacacaacgggcattcatacatttttcacaagctgagtgctgacggtgaagttcgcttttgatcgtgtgaacaccatcacgcaaaagacatccgttgcaaagggcgccttcacactaacctcaacaacaacgttttgcgtgaagttggaaaccaccaatgtgaaccaagtgcagctcgaatggaagcgcaacgattggagacttgacccctggaatcattgctctggacaaggctcttcccgacgaacttactcccgtccttgactggtaaattgacaatctcacaaattgtttagtatttattgttctttaattatttattaggttaatcatgaactacacgggtcgtcttaagcatgatggaagcagaacacgcc

SEQ ID NO: 41348 - DNA, 295 bp, Heterodera glycines
tgaccagttaaaataggaagtgttcagataaagaaaatcaggaagtgatcacatagaaataaggagtgatcagactgagagaaacaacataagcttgtctacccgactgaatcatcggccacccaacggctgccagcgtatgcttgagtttgtcctctttgctgagcaaaggcacaaatcgcacattttcgttgccagttaaatgatcattatcggattcgatacggtgtgactgacgaaaatggtaagtgatatgtgctgtgaagtcgacagaaaggccaatagacatcaaagt

SEQ ID NO: 41349 - DNA, 1407 bp, Heterodera glycines
ttgcgttgggataatcagtgccgggcagcgcgaaaagctccgcccccttctccaaactgatcagatttggggagttcatctcgggctgaaacagttgtgggttgcaaatgacgcgccaaaagttgacgccgagcaggtggggctgtgcccgcaacggcaagtcgggcaccaacaaattcagccaaccccccgcggcgactacgacattttcggccaaatattttccttaattctatggcatttaaactagcgtccgtcttcggcatttaatgtacaactttttgtcgtttggacttcgacaaagtgccttcctccatgccaactttgtgggtgttcgtcggcatttgccggtgccgtgatctctgctgagtccgaagcatctgttgcactttcccacggcgtaatggccaacacttgctcattgtctcggattttggccaaattactaccaagtttcacgtattgcctctgaaatgatttcgcatttaaacaataatgtcccatttggaaagacgaaaagcgcccattagtctcatcgcaattcgcaaatgatccgtcggtcccaagcactttttaattatctcgacgcaaccctttggcactgaagtgcgactgacttgaactgttcgcagacagttctcagcgagcattgtgccggcaccaggctcgtacagtgccgaccatcgttcgtcataattgtgcaaatgcgggaagcgtcgctgaatggcactgcccccacggaacacttggtgtggcacaccgaactgacgaaggaccgaagcgcgcagctgagtctgagaccaatccgggtccaatgtcaacaagccgttcttccttttttcaaaaagagcatcaaatttttaaatattaagaggagggacaatttcctttttttaaacaattttgaaatattttaatttaaattaccaaaatattttggattatcaaaatttaaattatttttacgtttttaaaatttagcatttcttggctttgctcaaaatctgataatttctccgttttagttgcacaaataatttggtaaactaaatatttatgcataaatattatgggtaatttatgaattctattttctgtacatgtacagcgcctccccgccatccaatttgtgcagtccgtcccattcccggaacgcgtcttgcgcgagtcgaacccaatggggctgactgtgagtaagccgaatgatgcgcgaggcgccgtgggaagatcccaatttgtggtccaaagcgaactgaatttgtttgcgattggatttgttcaccgataaggctgcgattttaaattctttgattaattgagccgggaattttcggcgtttcggccaaaaaatgaaattgtttaagagaatttgagacatggcgagaggaaatgttttttttaattgtt

SEQ ID NO: 41350 - DNA, 1159 bp, Heterodera glycines
  misc_feature (22)..(22): n is a, c, g, or t
  misc_feature (89)..(89): n is a, c, g, or t
  misc_feature (213)..(213): n is a, c, g, or t
catgagtccacccttggccacnccgtcttcgaaacggcttttggcggtcggttgaccaatcggacatttcttggccaacccaatcatcnacattaagccaaaattgccgtgaacatttgctacgggcgccaccatccgcaaaattgagatgatgtacgcgttgaatggtgtgcttctgctgatgctaccaaatgcacttggttcttctccccnccactgtttgaggtgccgacatcattttcaacccttccgccactgtcagcggactcagcgaagcactttggcccatcgaagcgcgcaacgcggccatcgccaaccacgtgtttacagtgggtgaaatgccatttggaaatggcatttcttttgttggcattttgctcaggtggccatcaatcgcgtgggcaccgaatcgtttccgaatgaattcacttcgggcaacggaagagccggtgggtgggaggacattttggcaatttttgagagaatggccccattgattggttaagcccacaaggaatttggccatttctacggcagcagttacgtgacagcgccggacggaagtcggacgccggtgaaaattggacgaatttggggaggcaaaagtaattttcctccaaaagggcctctcgaggacgcgcgacggcgtactaattgtggaattggacttgaatttgtgcagacaaacgaaggactcttggggatttagggtcaaaactatcgataacattccaagtaaatccaatcttttgttgctgaaaatctcttcagatgactcaacggttggaaatgtacgcccaaagtctaagcgcagccgcagcaagtgaatatcggccgaatgtggtcaaggagaagtgaggagcagcagagggaggaggacagagaagaagaagcatttgcattgatcaaaaaataaaataaaaaataaataattgaaaaaagacggacgaataaataattcattcgagtggccctttaaaagtgacccttccccccccccctcttaagggaaaatagaaaaagaatggtgagtgaatgagtagtgagtgtgagaatatcttttttatgcatgtcaaattgcgtcacgcccccccccccccaatgtggtcaaagggatgcacataaatgcggggcatcgaatcttcgatacatttcggaa

SEQ ID NO: 41351 - DNA, 1000 bp, Heterodera glycines
tttttcaaatttgtgccctcctctgcactgctcacttggcacgttggacacaagtcgaagcgggcgaagcacgcgaaatgcccgcaatgccttgacgtcaaatgcctggatgttgatccgggaaagcactgtgctgatcagactgaaaatgatttaaaattctttgaaattgaaatttaaaattaaaaaaaattaattcccacccgataacaacaatgataaagtcgaggatattccacgcgtttcgcagataggcacccggatggcacagaaaaccgagcgcgatcactttgatcacacactgatcagaaaagggaattgaatgataatccaatttaattattggtgttgaattgattaattgttttcaaatgtgacgattggattttcaatattttttatttgttaaaaatttatttaatataaatttaattaatttttacatttaataaacgcagttaattataattttaaacgaatatttatttaaatatattttaaaattcaatttaaatgcgaaaaaataaaataaaaattttgagataattatttttttaaattaaaattattcctttttaaaatagatttatttcattttttctctgttttcttttacctctgctgtgaatacaacaatgaaaagattctccaaattttcctaaaaatatttatttatttttattttttttgtcatttttaaccgaccaaaacggtgtttttcatgtccgaatcttgcgcaggataaggctgataaacggctaaggcaatgcaattaccgcaaatcatctgaacattggaagggtgaaacaatttaaaattaaattttaaatttataaaatattaattataaaaaattgataattaaaaaaatgatgttttaaaaaagaaatattcaaatatattttgcgaaattactttgatcagaaaaaaataattatttaaaatttaatcaattattttggtgaatttaaaatgatattaatgaatttaaaattaagta

SEQ ID NO: 41352 - DNA, 1472 bp, Heterodera glycines
ttattcacatgatcgattgtttgtatttatgagatggatttggtgaaaattttgcggttttcacgcaacgcccttaatggtgatatttaatactgtttctttttggtgataattaatttcattttttttaattttttttactcatatttattatgataatacattgagtttttatcaatttatctgtgctctcacttttcttatttaaattaaaattacttttaagaaaattgtcttaaattttaatattcatttttaaaatgacgaataaactttcttctgtggccttcgcagcgaaatgttttcattagttgttttattgaaatattatttttaatattattactattatttttgcaaatttaatgcgtatttaagtgaataatttaatttaaatcgaaaatttgataaaatgagaaaatatattaatttaaatttatttttagaacattattttttttattatatttttatttgttagaacattaaaaaatttaatttttacgaaattcaattttgtaatttaaatattgttttaactttttaactattattttatcaaaattgttattatataatctaatattcctcagttgttgaatggtatatgaagaaaaatttggtttttaatttacttgcaaaaatgtcgagagaaattaacatttgatttaactttttttaatttttaaaattatactaattataataactatttacctatttacttcatttcatttattaaattattgcaaaaaaatttaaatcttttttgctcttatataactcatgaaacggcatgtatctatttcagcagtgtggttgtttaattaaaaattattcgaaatcttatttaatgttttttattcaataatctaaatattcaaatttcaatgtctttcaatagtgaaactagagaatatcaaccgtaaattatttgtttatgctcaaatttttaaattttgaatttttaaattatttttgctttgttccaatattccgtcaattcttgtgtttgccttgccttaaaacgcattaattaactgaatgaaaatttggttttttaaagcgactcaaaaagcacatcctcgaaagcaatttggagggtcgaattactgtgagattaatgatcaaaaaagttaaaagcattaaataaacttattttacaattaactaaataaaaagttataaagtaaataaaattataacaattaatcttatttataaataaaaatttaaagctaataataatttttcgccatttcgaatctaaattaaaatatataaatagatttcttcattattttctaatacttttgcttattgtatatttatcttgaacagttgcgatagataaggcaaaaaatgcatattaaaattaatttatgtttaaaaaatttgtggttttaataatttatattcttgaccgactattttaattatgcaaatatcaattatatttaatgaatgatttt

SEQ ID NO: 41353 - DNA, 1216 bp, Heterodera glycines
  misc_feature (890)..(890): n is a, c, g, or t
  misc_feature (892)..(892): n is a, c, g, or t
  misc_feature (900)..(901): n is a, c, g, or t
  misc_feature (911)..(911): n is a, c, g, or t
  misc_feature (913)..(913): n is a, c, g, or t
  misc_feature (921)..(922): n is a, c, g, or t
  misc_feature (927)..(927): n is a, c, g, or t
  misc_feature (932)..(934): n is a, c, g, or t
  misc_feature (943)..(943): n is a, c, g, or t
  misc_feature (945)..(945): n is a, c, g, or t
  misc_feature (951)..(953): n is a, c, g, or t
  misc_feature (964)..(966): n is a, c, g, or t
  misc_feature (969)..(969): n is a, c, g, or t
  misc_feature (976)..(976): n is a, c, g, or t
  misc_feature (979)..(979): n is a, c, g, or t
  misc_feature (993)..(993): n is a, c, g, or t
  misc_feature (997)..(997): n is a, c, g, or t
  misc_feature (999)..(999): n is a, c, g, or t
  misc_feature (1004)..(1004): n is a, c, g, or t
  misc_feature (1006)..(1008): n is a, c, g, or t
  misc_feature (1010)..(1012): n is a, c, g, or t
  misc_feature (1016)..(1018): n is a, c, g, or t
  misc_feature (1035)..(1035): n is a, c, g, or t
  misc_feature (1039)..(1039): n is a, c, g, or t
  misc_feature (1041)..(1041): n is a, c, g, or t
  misc_feature (1046)..(1046): n is a, c, g, or t
  misc_feature (1048)..(1050): n is a, c, g, or t
  misc_feature (1053)..(1054): n is a, c, g, or t
  misc_feature (1058)..(1060): n is a, c, g, or t
  misc_feature (1063)..(1063): n is a, c, g, or t
  misc_feature (1077)..(1077): n is a, c, g, or t
  misc_feature (1088)..(1088): n is a, c, g, or t
  misc_feature (1090)..(1092): n is a, c, g, or t
  misc_feature (1095)..(1095): n is a, c, g, or t
  misc_feature (1100)..(1100): n is a, c, g, or t
tttttttctagggtattttgaggtcctgagcacgaatatgatgtttgttttacgtttcagaatttttggaattttttaaaaattcgaaaatatttttaatttttttggtccttggaaatttgggttagaatgtgaaaattcataactcaatgaaggactgctcaatttaagtgaattaaagctttaaaaatagcaaaaaatcgggagaattttatgagatttatttggttttataatgttcaaaagaaaaaaagttattccagaatttttggaaattttcgatttttcagaaaaaaatttatacctcggttctgaaaagtcattagggaagagtaaaatactacaaaaatccgcaatttttttttaggggttatttgggccgctgatcacgaatacgtgatcagattttacttttgacatcgttaagacctcagaatccctgtgtgattggggattctggggcttcattttgaggggggggggggggggggggaagttcggagcgggtggtgtaccattatttttctttgtattttttgggttaattttcattacttttaataaatttaaatgtttggttttattaataataattttttttagtttaatttaattattttttgatgaataatgattttcatttaaattatttattatatttaattaaagaatttcagcttttattttaaaatttaattgtaaaatttttttcatttcaatttaaataactattcaattattatacatttcataatttgtttttcattaataaaaagtgtattatattttaaaaaatgaaaaatataacacatcgattttttatctattttgattaaaaacaattacataattaccgataaatgctctatttgaatgccccctttctaatnantgttgtanntcttttaatnanagttgtanntcttntaatnnnttttatatntnttaatnnntgtgtgattgnnngtntgagttnaantaaattttaaaaangggngngaagngnnngnnnaagnnnaataaaatttgaaaaangggngngaagngnnngtnnaagnnnaanaaaattttaaaaangggtgagaagngnnngtntaagnttaataaaatttgaaaaatgggtgtgaagtggttggttaagttcaataaaattttaaaaacgggcgcgaagcgcccgtccaagaccaacaaaattttaaaaacgggtgcgaagcgc

SEQ ID NO: 41354 - DNA, 1034 bp, Heterodera glycines
  misc_feature (86)..(86): n is a, c, g, or t
  misc_feature (97)..(97): n is a, c, g, or t
  misc_feature (109)..(109): n is a, c, g, or t
gttccaaaattcgcaccacattttactgtgaaagtccaagtaccttaattggacaactacgtgtcaatgagcacagtcgccgttgnccagttgtganacagaaaaatgngatatcagatggggtgcgtcccatcctaaaaattcctcttttcgtctaaccatccctcccttattgtgcactatttcgttttaaaaattgggaacatttttttgtttgtttttttgaaactaaaatgtaaaaatttaatagaattatttttgattttaaataatgcttctgtttcgaatcttttgactctaagaaattaaactataaaatttagaacaattaattctctgaagtttttaacttggctttagcgtgtttttaagccccgccgtgaggcgggacagttccaaaatttgcaccacattttactgtggaaagtccaagtaccttaattggacaattaattgtcaacgaacacagtcgcctttggcctcttatggagcagaaaaggggaaatatcagatggggtgcgatcctttcaaaaaattactcttttcgtctaaccatccctccctttttgtgcactatttcgttttaaaaattgggaacatttttttgtttgtttttttgaaactaaaatgtaaaaatttaatagaattatttttgattttaaataatgcttctgtttcgaatcttttgactctaagaaattaaactataaaatttagaacaattaattctctgaagtttttaacttggctttaccatgcttttaagccccgccgtgaggcgggacagttccaaaatttgcaccacattttactgtggaaagtccaagtaccttaattggacaattaattgtcaacgaacacagtcgcctttggcctcttatggagcagaaaaggggaaatatcagatggggtgcgatcctttcaaaaaattactcttttcgtctaaccatccctccctttttgtgcactatttcgttttaaaaattgggaacatttttttgtttgtttttttgaaactaaaatgtaaaaatttt

SEQ ID NO: 41355 - DNA, 1593 bp, Heterodera glycines
  misc_feature (561)..(561): n is a, c, g, or t
  misc_feature (1546)..(1546): n is a, c, g, or t
catggtcattcatttgactttgctcagctgaaccaaatgatgcatcacttcgattgaataggtctcaggtcacccatagattgtcacatttttgttggttttgtttgtttttatctcctcaagttcatccaatttctaagaattcagtcctaagttaattgtaatactaaataagccaaactaagcctaagcgagttatctaattaaagtgttattgttgttgtccttttcttccgataaagttctctatttattgtttgtgaatggggtttaatcgttcatattttggtattaatatagaaatgaaaacgatggaattctttgaacaggcaaataaaggcctttgattatacggggagggatttgtcatgtttcaaacgtgttccatttttaccgtatttttaacttttctcttgtctaaactgcctaattttattcaatattctggcatatctcaacgtatcgtcatggtaactgctgggcgaaaggaattcaatgaaatgagttggggtgaagccgatggacagcggagaatgggcgggggggggggggagagagaanccccagccaccgttgtttgggctgtgccagcggccctcacctcacctcattttcgcttggcccgagtccctccatcaataaataatatgctcacttttcccactaacactgccggaaaaggaagatgtgagcgagtttttcaccttttcatacttcgaccacaaaaaaacaaattttgctcaccgcctcgccgaatgtttggactggcggccgtaaaaagggcaaaggtggaggaattatgccaacattttccacacattttcgcagtttgcttttcgtccttcctttttttcattggcatttcattcatccgattgtcctaaaaatgatgcggttgttggcttatttccatctgccgctgctcacctctcttccggccctttattatgcattattcattcacccaccactgctggtgccttccatccatgccaattgtgccgtgccatgaccattcaatgtttggtccgacccgtcccattttcactgctcctcccaatgcttatccaccatagagcatttatctgttgtcactgaccaaatttatccgatgccataagcttcccgtcatttccatgcataaaacaaataccaatttcgcattattttaggaacatttgcatttttatgctgctgtaattctgcaaatgtccgaggaagttgacagacacatcgtggagcgttacgaaattcaaaagagactcgggaagggtgaggagtaatggacgttttttgtgggtggtgaattggtccctttcaggagcgtatggcattgtttggaaggcgattgaccgaaaaacgaacgatacaattgctctgaagaaaatcttcgacgctttccgaaatgctacggacgcacaacgtacatttaggtgaacagaaggcgcggaaggacagccattaaataaataaatggaacatgaaaatggaattaactaactacggttttcagagaaataatgtttctgcaggagttccggacggnacccaaacatcatcaaactgttcaacattctcagagcggacaatgac

SEQ ID NO: 41356 - DNA, 1039 bp, Heterodera glycines
aaagacaaggaaaagagccgcgaagcggccgagtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaatttttcattaatttttaaagcttcattacttttatttttttagcaaaatcaattcataaatattttttcagaaactgctctgaaacacacaaaatgttaattaaaagttaaataaggctctctgatgctttttctatcaaaagggagatgaataaaaattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgttttaaaat

SEQ ID NO: 41357 - DNA, 892 bp, Heterodera glycines
cggcagacaacagatgcatttcaaacaattcaacaatattatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataataaaaagtttatttttatttgtcc

SEQ ID NO: 41358 - DNA, 1510 bp, Heterodera glycines
  misc_feature (90)..(90): n is a, c, g, or t
  misc_feature (1499)..(1499): n is a, c, g, or t
acagcacacaataccattggtaaggttcaaattgaattctatatgttcaaaaaaattcgcatctattgtattgttgctcaattcatgctntattctaaaaacaaacattaattaagggaaatgaattttttctcattttcgtcgctttttcaaaaaaaaaaaatatacaaaaaccaaaagaatgaatttccatgttgtaaaaaccaaatattaaatttgtcttccgactatattttcgtcaaatgttcgggtcggaagatctcaagtttttgaaattttattttaaatattaacttttattttttaaattaaatagataatgaaaaataaagcaagttttttaaattttgtattatttttttcaaatctctcaccgttcctctgtgcacaatcagtcgaataccgaataaaaaaatactcaatattttcatcatttttttgcaaatattccactacattggccttttccaataaattcaaaacaaaatttgccaaaatgcaataattttctttcactgaaattcgcgtttcttctataaactgtctatttcgattgttcaaacgcattaaaactgaaagtaaaattttggggtccgatgggcgcacaaaaattttggcgttttgcatttcgccaagaatttttgccatttttaagctttcatataatgtcgtagaacaattttcaggcagtagtggttgcatagaaattgaaaatccgacaaaaatttgaaaaataattaaaagaaataaatcttttgttcgcttttttttgaaattatgatgttatgctgttttaattttaaatctgtctgccaatttgagtttttaaactcattctgtgatcttttttaattggtcgaagagaaatgagtttgagtttttgtgggtttttcaaaaaaaattacaaaatttaatttttttttgaatgattttaatgcttcggcataatctcgatttcaattttctttgtaactttagttatagataattcaatttcaaaattcctatagtcaaaattctatccaaaaattggccatttttgtgaaaatctgttaaagataaggaaaaattccaattttttccaactccttaattttcataaaaaatgagtaaaataccgaaaaaaccatttcattatgaattttttaatgctcggatgcgttttacaaaatttagagatttagccttgttttaaataaacaggtttttctaaattaaatttaattttcctaccctatttttggctgtttattaagaaataatttaagatttttaacatgaaaaattcatctaaaatataaaaaaactgagggatgaggaggaaagtcatgcatttccgctggaagcgagagagaattgaatgttggcgatcaattggtgagagtttggcgtcgcgttggcaccatggccaataatgagttggcattggcatcgcccaactctgtggttggacctggcattttcgtccccccccccccactatgtatacattctcaagnggggggggggg

SEQ ID NO: 41359 - DNA, 110 bp, Heterodera glycines
tctagagtcgttgcttacagctgcagcaggcggaacagggcgatctggttgatctgcgtcagggcttccttgaattcggcattggcatcgttgtggatgcgcttttcaaa

SEQ ID NO: 41360 - DNA, 922 bp, Heterodera glycines
cgaaatgaagaatgaaaaaatcgaatgaaaatggcaaagttatataaaaaagggtaaaatattaaaaaaaaaattttttgattaaattaaattagaagcgaaaattaatttaattggcatttgctgtctaagaacgcttaaagaaatgccaggatctgcaaaattttggtaattttaggcagagaatttacagtcatcctttaaattttgtattataaaataatgatggaatttgcgagttttggtaccatgaaagcataatttgatacaaaaatttacgaaaaagtatacggtattacaattttgtaaaatttcattttggattattttcagagcaaaagtagaaagcaatcggcgggatcagccttttttcatttgaattataataaacaaaataaatggggctggctaaaaatgtggagaaaataccgcgcgcagattgtgaagaatggggggggggaggcttagggagccgatcaactcgagagtctcgaggaaaatcttcaaattttgggggtgaagcatttcggctggcaacgcagggctttagctgctgatgaaagcccaaagacaaacattggagaaccaaccgtgcaaaacggacagaagaagaagaagaagaagatggaacaataggaggaattgatttatggaattttaaaaatgggaaatttaaaaccaaaaatttctttgtattaaaataggaaatgttttttagtaatttaaaaaataaaaaagagttaaaatcaaatcaaaaatttctttgggctaaaaataatttttttttttaaagaagcataattctttgaattaaaaaaggaaaaaatggaaatgggaaatttaaaatcaaaatatttagagctaaaatttgatttttaaaataaaaaaatgaaaatgcctatttaaatcaaaaattttcata

SEQ ID NO: 41361 - DNA, 1122 bp, Heterodera glycines
  misc_feature (986)..(986): n is a, c, g, or t
atgtatttgtatatatttatgaaataactaattttctctactatacatcgatttgtgtagtagatttagcacattttttattagtccatttatgttcggttatttaccttaaattgatgaacactttaaattaaattttaaaattcttgtttaccgccatcattcaggggtgccccgtcgtcagtgtctaaaaataatgaatttcatgaaaaatctatttttaaaattaatccgaattggcaatgatctcagatctcttttttatctttgccagcgtcgacttttcaacgttttgcattggcacaatgggggcgcaaccggactgaactgaagcagcgtgttggttggcagcgactgctcgtcaggccctctctgacgaaagaagaattggcggctgagcgggagattcgtgaacagaggcggatgaattatgaagaaagcaaaaacaacgaaatggtgacgacgcggcgtggaggcaaaatggaaaaaaactttttaggtcacaaaactttctcaattgtttttactttaactcaagaagtttagtaaacaagatggatgagtttaggcttttacttttagaaaataggtataaaattatcgtaataaccgaaagctggttgaacaataaaataagcgacttgcaaattttaggaaattttcctttttctttaataagaaaagatcgaaaaaataaaaagggaggaggggtagcgtttgtcatttctaatgaaataccgtttgaaattataaaaactccaaaaatacaaaattctgatatactttgtatcgatgttttttcgcccattaccgaatcaaaaatccgtcttattttggtttatagacctgtaactactgaacactcgaaaattttatgcaacttgtagaatcaattttgtcactaacagtttcaactgaaaattttgtcattcttggagattttaattttactaatattcactggaacaaaatggccccttctctgntcaaaataatttgacaaaatatgaaagaaaatttccttggtttttgttgaaggttacgacttaatcaaatgattaaagaacccaccagggaaatggaattttttttggatttatttttaaaaaataataaaattct

SEQ ID NO: 41362 - DNA, 1064 bp, Heterodera glycines
cacggggagtgccatgctatttctaatttaaatttgtctactaattcgttttctcactttccaatctctgattaattttggaaaaaattaactttgattattttaaatgaaatgaaattattaattttttatcaatatgttattttgctctttttttctacgggtatttgcttatttatttatttagcgataattttcagaaattttatataaattcttattgtttttttcaataaatttgtaaaaagaattaattttgattattgaattaatattattttaaaagtttagcttatttttgattttatttactaaacaattatttatcatttaaaaacaattttgacactaataatttatcaatttttgacttcaaatccaatttttatttgatataatctctttaactgttttattgttgaaaatttgaaataataataatgtatgttattttttaacatttatttaaattcaattttataattcattgatataatttttttcagcttacaaaaatttgtttttacttctattttaaaggggttaagttgttattcaaaaaacatcaatttttgccaaaaaagtttttgaaaagtatgtccaagaagttaaaaaccgttttttaaacaattttggacacagatttttgaaaattaatgaaatatttgaaattttaagttaacaaaaaagttgattaatattatgttctttaatctttaatcaaatttaattgtaactcattggcgaggcatttattgttttttttgctcatttattatttcacttaaaaatttttcatctgtcgagcggacccgaattgctttaattttttattttttaaatatgattaaatgcaataataatttattactttgtttctttaatttaattaatttaaaataaaattatttagtgtctttatctcttttttttaatctcatgacgcataaactcgttttgaggatttaagtctccaccttttcgatttttttagattcgctttttattaaaaaataaaatgatatgaagaagatttaatatgatagattttttgatttattcat

SEQ ID NO: 41363 - DNA, 867 bp, Heterodera glycines
tttgagtacaccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccatatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccatatttatggggagaccgaatccttcgggaatagcttccctatagcctgtacattaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtcaccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgt

SEQ ID NO: 41364 - DNA, 1045 bp, Heterodera glycines
  misc_feature (46)..(46): n is a, c, g, or t
tttaaatacatgagaaataattacagaagttaacgaaatctttttnaatgaataaaataaaataaaatctttaacaagcatgggtatacaaaataagtttcagaaagctttacatgcttaatcacaataaaataaaataaaaataataatcaaataaattaaaattaaacaaaataaaatttactgaaaaattctaaacatatacttaaagtgaatattctgataatattgttaaccaaataataagcattattttttattattcttttataaaaaagtcatgtttgaattaaaattttaattcaataaatgttgttttaattttttacaaataacagaaaaccctaattaaaatacatagaaaaaattcataccgcaacattcgctctactctgtttaaaacaaatataaaagttcaataaatattaaaggaaaccaaccatacattgaattatataagatagaataatatatcaaattcaaaacaattgtaaaaaatacaaaaattatttacaaaacattttgggccgactagcaagggtcaacgtggccctatcgcgaacaagacacgggctcaaggtgttttgcaccaaaggtgcttattaaataaaatatcatatgctaaaataaatgcagagaacaaaatatgaataaattagttcatttaggtagcagaataaataattgttaaacctaaacaggcatgacattcaaggaaagaataaggagattcataattaaattaaataaaaaattagtagtcatttgcattgttcaaaagtaaattttaaagttaacaaagaaacaaaataactgagaattaaagtactttggaacgttaataattaaatttattaaacaaggaaaatgcttttttattagtaaatagattaatatttacaaaatattttgggcagactcagcacgagcaacagttgcattaagtaatgctcggtttaaatcacatgacagtcaaaaaagaccaatgaagaactcatatttttataataaaataacataaaaaatacttattcttttgtattgt

SEQ ID NO: 41365 - DNA, 735 bp, Heterodera glycines
tttagaacgtgctctgaaacgcaccaaatgttaattaaaagttaaataaggctctctgatgctttcactatcaaaaagggagatgaataaaaaatctaaaaatttttaattgactttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttattttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaattttttattaatttttatggcttcactattttatttttttagcaacattaattcataaatactgtttcccaaactgctctgaaacgcaccaaatgttaattaaaagttaaataaggctctctgatgctttttctatcaaaagatagacgaataaaatttttaaaaa

SEQ ID NO: 41366 - DNA, 1176 bp, Heterodera glycines
gtggtgattcattctttcctggactgtgttcacttcttcaatattttacgtttggcggagggtcaatcagccggcaatttccggatcaactcccaggttgtcagtgggttttacgcaaaaaagggaaattcgtccatttcccttttaggctcgtctacaaatactttttgttcatgcataaactcagttacatttttggtattgtcggttacttttcactcgtctttactgtcattggaataaattcggtgttcggtaaaattaaattttctaaaaattcaaaaaaggctttttaaggaattagcagtaatctgagcttggattttggcgtgcatttgttgttttattgcctttattacggtgtgcttggacgtgatttggcacattcatccgcggatggtgtgtggtgggcaaattgcagacatgcccttactgtgagtgttggaacaaatcaaattctccacgtttttttaatcattaaatttaggcagtttggcaaccgatcattgtggctgttctgcatttgatcaatggttaccttggactggaatgagcttatttgatgtatatgcacgttaaagatgcaataacattatttattgttttaatgtattagaaatatatgtgtttgtgaaagacaatttttgagcaaggaatcacttatgtgcataaccggaattctgtgatatttaaaagtgccggagaatcactcatacacaaagacgtgtttgaacttcgtcatcggttccatggcattcgaccgcttctttgaactcctcaattttccatttccgaaagggcggcgtcgaaagcttcccacttttataccaatcgttaaagactgtacatattcgaacgttccttgagaaaattccatcgtttcggtcatcatcttttattctgttttacctccgaatgtccacaattgtaccatcgcgacatccaaaagccgtgcaaagtgatttcattgaaaatcaacgaggaagtgggtactaaacggtgtaaatgtggtaattaatatcggggtagccaatttcttttttttgtgccgttaggcgtcgccggggaaattttgaaaatttgagcttattttgttaatagattttcagcaaaaagtgacaaaattttttgcgattttgaacatgtatttaagaaaaaaattggggttttagggcg

SEQ ID NO: 41367 - DNA, 990 bp, Heterodera glycines
  misc_feature (864)..(864): n is a, c, g, or t
gggctgtttaaataggggcagaagaagacagatgggggaggagggggagggcgagagacagcctcaaacacacaactcaatacctaactaattggtgtgcccgtgttctcgacccaacttattcccttccccctcccgccactctccgaccattgtgctattgcactcatcatatgttttatgtgagactcataattgacgacccaaaccatccaatccctgataagcttctcgaggacgtgatgttaaaatgcgaatttctcagtcttggtggtctaaagatcgtcgagactgaaattttggcactctgtgccaagcaaaaatgaattctatcagcaaagaaaaccgagaattgagagtgatttttggaggataagataaatttaaaaaaattcctcacataaaatcttatatgccgagagtgttcatcaaaattccaaaccaaaaataattatagttatttttaaataagattatttcaaattcttggccttcgtgccaaccaatcagccatattacaaggttcgagactgagaattttggtattcatgacttcaacatttcccgtggcattggtccatttgcattttaatttgtccatttgcacattgttttatttgccaacaaccaaccagccatttgttctattgcttttgccctcggcttggggttcgagtttggcacaaaaacaaaattggccaaaaaaaccaaattggtaaaatgtggcgcgcgccaaatgggccatggatgagtaatggccgtcctcatccgtccccgtccgcttttccggccccaaattacccggcggtcgcgtcccgtcatctaactcgaccccatcgattttgggcctggcgtgcggggggngggggggataccaagcccacactgttagatgtggaggaggaggaggaacaagaagcacaagctaaagcagccaccagctaagtgagtgtggcgtaaatggccagccccgggctggtgtcccccggg

SEQ ID NO: 41368 - DNA, 1088 bp, Heterodera glycines
aaaataaatatataaataatataaattaatttgagacaccgaacatccgccgggggcaaggaattttggggtcggggaaaggcaaaaaaaaaaacgagtcggggtttggagtggaattcagcaatgctaattaatcgagttataaatataattaatgtaaaattttaattaaatacaattaaaatagaaaagaaacaatgacttaaggaaagaacaacaaaaaaaaatgaaaatttataaaataaaataaacaaaaataaatactaaaaataataaaaattaattaaaaatgttaaatcataaaaataaatgttttaaacattaaagaaataattttgacaaaaactgaaaaaatattaccctgcttgtgtaaacacatgccttattaatagagtagagcggcgggaccgtgaattttgggcaaaaccgggacagggggaccttttcgggttgaaaaactggtaatttttggctcgaaaaaccggtaaaaagccgggactagtcccggtcccggtcaaaactggggcttaggtactactcagttgtaccgttttttcagtaccaggtcccggtcccgctctactatacttattaacaatatttttaaatttaattcttttaaattaaaaaattgtcaaattactattagatataataaaaagaaaacaacactcactaaaatatttgatgctgtagtcttttattttgcttgagtgttttgaaggatgtgcaaaatttggccactttttatatttttagtggggaagaaagaagccagaatgaatgttatattatgtgtggtggctgaattggggtgggcaaaagatcaccaccaaaacaccatttaatggatgctaatggatgaatgggggagggacgaactgaaattggccaaaatttgggccaaattctggaagaagcggcttaattgcttcttcccaaatgagcattttgggatttaaaatagaaaatatttttacaattaattaagagccaatgaaaatataatttaaaaattttaaatatatatcaattttctgtaaaaggaagtttccataatttatgttaataaatcatttttataaata

SEQ ID NO: 41369 - DNA, 979 bp, Heterodera glycines
ttcttgtgacaaaaatttagcataatccatcgccaattcattgtcaccaacaatatctgttaagggaaataatttaaaaataattcggtaaattattatttttcaataataatcaccgaaattcatctcaatcggtcgaattaattccaatttggtcataaaaaatgggccaattaattcccttaatttgtccttcattcgaatcattaatttatttttgtccattgaacgtaaatgtcgtatttgaaaagcaaaattcgactctttttccgcccttttatcattgaaaaaatttggcaaatctctgaaaaataaagaattacggaatattaagcgcaaatttgatgtatgagccttttgtcagcgaatttaaataaaaaatttatgcataagaaagggattttatttttttgccaaaaaatgttttttaaaactttttatgaaatatctaaagccagaatatggcaaaaaaactacattaaatttgtttaaaaaactagaaaatgtgtgaaccttgtttttgagttgaattgatatttttaaatattaaaaattctgataatatgataataaataatttttccacttttaagcctaagtaattattaaaaacgccaaaaaattggcatgaaataggtacaaaaaagcggaaaaaggcacaaaaattcgaaaaaatgcatttatttttcaaattccatacatcattcgaaattcctcgtcaattccaaatttaattgtccgtttgccattttgaagttgcaacagtgcgataattgcactgaaattcgcaagtgccgtgtctctgacaaaaactcggtttcggccaatgctttcatcacattccacgccgttcaaatcaatttggtcgcgatttttcaaataattttttacattctttggaattttgggattttccacttaaattttcaattaaaagattttttggcctatccaaagggtattttcaaaaaataaaagt

SEQ ID NO: 41370 - DNA, 1422 bp, Heterodera glycines
  misc_feature (17)..(17): n is a, c, g, or t
ttttcagtgtccgtttnggggtactcaaacaattataggggagcaaaaatccaacgcagaattaaagtacaggctatagggaagctattccggaaggattcggtctccccataaatctgggcgcatcggttcggggggactgccccgaaaacaaaaaaatcgattttttcatttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaattgaaaattttgaaatcatgtttcccactcccttctcccaggggaattattttgtaaagtccttttttcccccaaaaacttttcaaacccccttttttccccccggggaaggttatttttttttgatttctgaacccggttttgaggaaaattaaaaaaaaaaaaaatttgaaaaattttgaaaatcatgtttccccactccctttctcccaggggtatttatttgtgaaaggtttttttttccccaaaaaattttggcaaaccccctttttccccccccgggaagggattttttttttgaattttgaaccgtttttggaaatataaacaaaaaaaaaattgaaaaaatttaaaaaattgtgttccccccccctctttttcccaggggatatattttttggaaagagttttttttttcccacaaaaactttttataccccccttttttcccccccgggaaaggttttttttt

SEQ ID NO: 41371 - DNA, 1146 bp, Heterodera glycines
attaaaaatattcttaatgcaatatcggggagattaactcacgcactaattctactcacttttaattttttctgcagcacaattgattcgagaaaagtatttttcaaccgaaagtggatctgttcactttttttgtcaaaggaaatttgatagactcttttattctcagaatttttctatacaatttagttcaatattttgaatgagatcagatttggaataaaggaattaaacaatattgttctattcaaattctgaaattatttcccattcccttcgattaactccaaacgcgatggagaaatactcttttcagaaaagccctttaattgaattaaaatctatattttctggacgacaaaaatgcgttggctgaattaaaattattcttaatgcaataacggggagattaactcacgcactaattctactcacttttaattttttctgcagcacaattgattcgagaaaagtatttttcaaccgagagtggatctgttcattttttttgtcaaaggaaatttgatagactcttttattctcagaatttgtctatacaatttagttcaatattttgaatgagatcagatttggaataaaggaattaaacaatattgttctattcaaattctgaaattatttcccattcccttcgattaactccaaacgcgatggagaaatactcttttcagaaaagccctttaattgaattaaaatctatattttctggacgacaaaaatgcgttggctgatattaaaattattcttaatgcaataacgtggagattaacttacgcactaattctactcacttttaattttttctgctgcacaattggtttgagtaaagtatttttcaaccgaaagtggacctgttcacttttgtagtcaaaggaaatttgatagactcttttattctcagaatttgtctatacaatttagttcaatattttgaatgcacaaatagagatcagatttggaataacggaattaaacaatattgttcgattccaattctgaaattatttcccaatccaaatcaattaactccaaacgcgatggagaaatactcttttcagaaaagccctttaattgaattaaaatctatattttctggacgacaaaaatgcgttggctgaattaaaa

SEQ ID NO: 41372 - DNA, 755 bp, Heterodera glycines
ttttcggtagatttggggcagggtaggaaatccaaaaccccttttttagtgttcactcaaattttttgtctaataaatcgggtctttgcgtggcattgccgaaattaattttggagttttatattttggcatctttttgcgggaccataattaaaaaaaacaaaaataaaatttcaatagggatggagggtagcaaacccaaagaaacttttttggttttccccgaaaaattattctgttaatggaaaattggcgctgctgaaaactaaatggaatttttattttttgggatttttggattaaaaaattttctttttcatttgtggggctctcttttccccgtgtcgtgggcttaagggggcctatgaataaaatttttatgaaagttctttttcgtaattatactggtattattgcttagtcaaaaaaaattttcatcaaataatttgtagaaacattgttgtgattaattaaaatgaaaaatattaaaaaattgaaaaactacgacgataaatgtgattatttagaattaattttaatttaatacaaaaatctgccccaaatatagataaggtaacatatatttgatggacccagcccttgctgaatatgggggagaggaatgcggatttgttcagctttgcttctatgagtgcaaggcggcgacgacggatttgttggggataaatattggatgcatttgggggagggacttttgacgaaattttactaccgccttgggtatacggtagaga

SEQ ID NO: 41373 - DNA, 713 bp, Heterodera glycines
atactgataatgaatctgatcaaagacataaaatgatcaatcgctttgatgggatccactaatggaaccaaagccgaaaaataaaataaataaacatattggcgccgcttccccgcagagcaaagggcgggcctataaaaaggagttgctctccaatgccatcatttcacacgcaccacttcaactcatccaaaaattgaaccaattcagcccatctcccccccccccccccctcagtcgggttgctaaacagcaaaagttaatttgcttatatatttttcatttatttaatgcaataaaaatttcaaattaaaatataaatttgaaaacaatttcgcattgacaatcgtttttggaagcatttttcgaataaggaaaattttctgttttaagagaaagaattttttcataaaattttcatttcttaagggtctattttctgaatgcagtccctaataatcatagccaattatttatttaaatccgccaattaccactaaaattggctcattcttcgaataatttcagcatcaaaaaacaattttaaatttttattttgtagcttgcgctttgatcgaccgcgcatccgcgcagtggggcccttggggcggaaaccgttggggcggcggatggggcggaaaccgctggggcggcggatggggcggaaatcgttggggcggcggatggggtggcaacggatggggccgaggtga

SEQ ID NO: 41374 - DNA, 623 bp, Heterodera glycines
tgcattccccgttccgttcctcgtaaccctccggccatacacagtaaccgttgaaacagtacgagcctccggtacaaacacttgggttatgacgacaattcagtcccggtgattctgggataataaatattaaaaggtgatatatcaacaaaaaaacacacttgaatatcaaacgaagaaattacagtagtctaaaaattttgacaaaataaagtacagtaaccgagaaaattttgacgagcaaattcggtattccagaaaactatgataaacaaaatatgatattccagaaaattttcctaaatgaagtacggtagtcagaaaattcagaatacagtagtaaataaaattataaaaaatacagtaactcaatatattaatgctctcacttttaaccagcctttttgttccaagaccagcaactgtgtgcccaccattttccgaaggtaacatgcgaatgctatataaaaagttaaaaatttagagaataaattaattaaaattttataaaaatttgaaaataatgaattaaaatttatttgattgattagtgaattaattaaatttgggaattattcatcatacattttttagggggggtcgacccccccccccccccctcg

SEQ ID NO: 41375 - DNA, 1311 bp, Heterodera glycines
aaacgatcatttttttaaagccagcgaaatgaaatcttatatatatgaagctgtaaaactgtggaacgacaacacttgtttgaatattgttgagagtgacaaagtttctcctagaattcaattcacaaatattgtgggcaggggatgcaaagcaaatgttggaatgcaatcctcgaaagcataccaggaagttgatcttgaatacccagattgttacgaagtaagtaaaaatttgtttacaaaaactatatttaatattttcaaaagcttggattaattgcgcatgaaattgggcactctttgggattttttcatcagcatgagcgatatgatagggattcctttgtttggttttaccctgacaatgttgaccctgaaaatcattacgctttccaaaaggaaacaactgagtctactgataattataaagtcccttacgaccttggctcagtgatgcactatagcgcaagtaaacacaaatgcataaaacaaagcacggttttatgccgtcttattttccagaagcattctcaatcaatgggcagtataccttggtgcctcgagcgggtgcttcgtatataaatacaattggacaaagatttggtcccagcatcagtgattatattgtgataaacaagcattactgtggattagagtttctcccagatggatcaaccataaatacaggcacttagaaatttctatactgtgcattgtttttgtaattaagaagcatgtcgtgttacaatgaactgtgacaatgatgggttccagaacccggacacttgctcaacatgcatttgcccacagggttatatcggagcgaaatgccaagatgttgacactgttggttatgcccctgtcggcattgacaatacttgcgaaggaaatattttatttgcaacaccaaattggcaatatgtaagcataaattatgatgcacatttttttacttttactaattttccatgtctcggtcgcaaaagttttaatttggcgaacccaaaaggtataaataatataaaaactattattattttaaatatagatggtttcattatttatggaaattcctatgtttcgaaaaattatggccttgatttttcgaacttttggttttagcttgttttttaatttttgcaaacttttcgaaattaatgatacttaaggagcgtgatgggtcgttccttaaattctactattatggccgtttcttaaatctgccaaggggtagggaaaaaatatgacaaataaaatttaaactttttcacaaattcaactaaattaatatttcatagtagcattcaatag

SEQ ID NO: 41376 - DNA, 1655 bp, Heterodera glycines
  misc_feature (37)..(37): n is a, c, g, or t
atagaggggggggggaccggaattttgtgactcaatngtcaataggatgataatgattgtgattgtgcgccaccgcgacgacccgtaaaaatgagtgggtaattgtcgcgcttttgcggggaccactccggcggcagcgcagcagacggacggacggacaatcgacgcgtttcattgcgtcgcgtgagttttgggaacacaactacagtcattcaccagagacagattaacagcaagcacaaaggaccaatttggacacgtaaacaaatgccaaaaaatttaaaaattctaaataatgtccaaaattgcgtggcatttaacttattagtcatccgccgatgaaaaagtttgtccatccatcactttcaattccggtaataggtgcttcccaaaatgatcgatgacgattggctgggcccaagcacaagcccatcgaaattggccaattcagacaacggtcggcgggtactgcgcgcgatacgccattttgtgttgggattggccaaattttgaaatactatgagattttttggcgttttgatgattctgagagaaggcagaaagagaagtgaattttgaatcactttttgccggggatgggagagagattataattgggcggcgatggcggacggctcaaccaaaaacgccgcggggaaaaataatcaaaataataataataataatgcggatgaatgactgacggaatgaatgaatgcgttgttacgattattcgccactgctcacaatgaatgaaagaatgaatgaatcagttgcccaccgaataaaataaaaaaataatttataaaatgtgcaaatccccccgggggacggcgttttatgaaacactcaacagcagaaaattgtgggggaaattagtgaagtttcggtcaggaatttgtgcacagatgagcaaccaaaacaaacagcaaatgtcgcgattggctgaggggggggggagtttaattcaatgacacggatgaatttttttggctaatttaaaatcatttttagaaaatttttataagctaaatgaattggaatctgcacaatcttgaagcggtgataaaatgaacttttccatttgacttactctaaaaattgtattgtaatttgagtgggcttaagtccagagaagtgccaatttatattttaaattattttcattttgttaaattaataaattggcctgcttttcttcaatggaacataatttgttgacaatttgccgaattctgcttctaatctctcgttgttcgttatgcctttttctattttcattttgccaaattatttttagtataaaaaatcctttttttatttaaaaaaaatttcaatgaattctgaacaatcaaaattgaattagtgattttgttcatttaacggtccccgtccaattggtagtcaacgtgcagaaacacgcggtcgacaaagtccaaagttcgaatctaaaaggtaaatttaaaaaatagaatttaatcattttgtggcaatttgaccaaatgccaatgccaaaccttccgttccaacgcctcgcaaaggtcatgtgtgacttttaacgtcaacgtttcgtccagcaccacgtgaagttcgaccagtgcccgctctccaagatataagccataactgaacaacacaccaaatagtggtgccgt

SEQ ID NO: 41377 - DNA, 755 bp, Heterodera glycines
  misc_feature (32)..(32): n is a, c, g, or t
ttgttagttctttcgccaatttacattattanagtgaacatatcgtgacaaaaaatacaatacaatatgaaattgagtaattggtcaacaaaataacaataccgaggaaggaacaagcattcgccatgataaaataatttaaaaagcattgacgaataacggcgacacttttttaaggcgagatccaattgagcatacatttgcgtctcttttttcaactcgctcatgggctttctcgagtggtctatctcagcgcgggactcttttctctacttggccatttgtctgagcatcccttcggcgctgctttacgtggccgaaattgtcaccattctgcggcataaacaattccacaattcattctacgcactgttcatcatccgtgccgtgccggtgattgttgctttggttgtgcagtttccattcgtttggatgcttccccttaggatttgctgtacctgctcgactccttctactgcttccgcttgcccattctgttcggctccgtccttttccctctctattctctgttgcccaattggatgatcggcggattaacttttttcatcgccggttacactttccaggccaacaatttagccaccgctttcatccttctcaaccgacttaccgcgattgccgtcccattgaaacatgacaaagtacaggacttgtcccaagtctccccggacatacatatcttgctcataactagagcaaagatttttaggagcgacaaagttgggggggggggg

SEQ ID NO: 41378 - DNA, 1528 bp, Heterodera glycines
tatatctagaaaacaaagaattactttatttaatcttctttgtttgtaattatttaattatttttaaatatacgtaaaaattgcttttttaaaatgttgtccgattaatgactttcaatttattttcatttattcttttgtttaaatatgactttaaaagctttttcatatcttaaagagaattaaaatttaatttttgcaaatatattttactttataatttatctctttattataaattaatatttttttgattcatttgcagcagatcatgccgattatatgaaaataataattgatctttgcagtaataaattattttttaattctgtttagacaacttcatgtacaataaaaaaaaataacttttataatatttaaaaattattagtcataaaaattcctaaaggatgacttttttttgtatatttaaaataaaataaatttaaatacataaaaataaaattgagtaataaatgtttgaattgataaagcacgtgccattcttaaagagtagaagcccaaggcctgttgttgatcttaacctttaaaaatatgacaataaaattaattagaaaataatgttaataatgcatatgaacaaccatccattttaataaaattatttctttttaaattaattcgaattgaaaaaataatatttatggcacaatcggtcccttttggcgatggcattttattatgtttttgtgtagtttactgaccatgagaataacaattattaaaaaataataaataattaaaaaattattatagcacttctacataagttattaaaaaaaaaaacttaaatttgatttttatatagaactgattaggaaataattataatacaaattaatataatttttttaaaaatataatattctatgaaaattatattcaaatgttaaacaaagaaataataaattctataaatttatagagagatattttattattatatgatttctagaatgaacatttattaaaattatgagatgttgaaaacactttatattaataaaaaaagatggattatttgcttttatcaggtaaaaaggaaacttaaataattaattaacaatgttttaatgcactgtcaaaaaaagtatcaataaaatgatttttattattttaaaacaataaatctaaattttaaataagtcagaagaaatagaaaaataaatgagatgaataaaataataaaataattaatttcaattaatatttattagaattaattatttgaaataaaaatctcgtccgtccacaaagaattcacagtcacagtcgaatgcatgaacacaagagattatttatgattaattcataataaatttctttttggtttttagaaaatgttaaaaaatgattttaaaaggaatatagtaatatttaaaaacacttttaaataatataagaaaatttagaaaaattctctaatttagtaatgattttccaacaaaataaaacttatcatattttacgatgcaaagcgtctccatctaatattgaagtgaaaaca

SEQ ID NO: 41379 - DNA, 918 bp, Heterodera glycines
  misc_feature (20)..(20): n is a, c, g, or t
aaatgggatcgatttacacnattgaaaatataaaaaatatttatagaatgtaggcattcatccattcatgtgattgaatatattttttaataattttttttgccgcaataatgaaagaaatttacaaaataaaataatgcaaattgaaatctaaaaataatacatcattattaataatcaaagtgaaaattattattatttagctaaaaaagtggcatttttcaacaatgggactttgttgtggccagagcatctctcgcgcccggacgagtgctgtgtcgtaggagttccccgactcgaatgctggccaattcttagaaattcctttttatcataaaaattaattaattctaaattgtatggaaatctccatttttattttcagtatcgttttatccttctttcttttcttcctctttcttttcctcttcctcccatttttctcagcccctttaattaagattttcctcctccactgctcttcttccgatgcccttaagcaagtttcatggaatttcccggcgtctttttcatatttattttccatataatttgccgcttcttttccctttattttattccctttacccctctcccccgtttttctccccacctttcaaatccctttggctagagcaaattaatttttgcataattaacagaaaggtcgtgtggcaaagtttgacgccgattttcctcccacaattacactttgctgcgctatgttatctaaacttctcgtcattttgcgcatacatctgctgaacctgacagaaaactttgtcaaaatgccacagtaccattctcttaattattttgcccattttttcacgcaataaaaaaataaaagtaaaatttaatcattttttattatcatttttttatgaaaattgaacaaaaatttataatttacctata

SEQ ID NO: 41380 - DNA, 1006 bp, Heterodera glycines
agttgttttttgtggttttttaggtttagttggtattacgtcggattggtctttgtcgggttggtttttagtcgttttttataggcgttggtgttttgtcgtttttgggtgagttggtgttttgtcgggttggtgttttgtccgcgcgccttccttccttctcttcccattcccaacacctccctttcctcccctcccattcgtcgattaacgattaacccactttttgctttctctcctttccacatgtgctagacatcgctgcatctctgccttaacatttattcagcgcttattctcctctgagtttcatttctaattttctcggtctttccaatttcatcactttttctttcccaatgtaactgtaatgtcatcatttttatagtggccttaatacataacatttgaattatcttttagcgatcgaattcaacaccctttcaatttggcgatcatgcaaatcttcgtcaaaactctcaccgggaagaccatcacccttgaggtcgaggcgagcgacaccatcgagaacgtgaaagcgaagatccaggacaaggagggcatcccgccggaccagcagcgcctcatcttcgctggtacatcgacttttgatatgccgaaacaatcatttttatacccaacccttattttcagggaaacagctcgaggacggacgcaccttggccgactacaacatccagaaggagtcgacgcttcatctcgtcttgcgccttcgtggagggatgcagatcttcgtcaagacgctcaccgggaaaaccatcaccctcgaagtcgaggcgagcgacaccatcgagaacgtgaaagcgaagatccaggacaaggagggcatcccgccggaccagcagcgccttatcttcgctggtacaatttgatgtgccgcaacttttaatcataaacccttgttttcagggaaacagctcgaggacggacgcaccttggccgactacaacatccagaaggagtcgacgcttcacctcgtcttgcg

SEQ ID NO: 41381 - DNA, 1281 bp, Heterodera glycines
  misc_feature (68)..(68): n is a, c, g, or t
ttttattagaataaccctatgcttttacaaattaaaatttttgatataattaaaaaaaaattgcttgnccagaaccgataaaaaccgatcactttttctttgcagggttaaattatacctagttcctgttccggtgttaatttattcggatttttccctgaaatttggctgaccaaatttagcacggtatgcaaagatgacatccgctagggatgcgcgagaaatgatttttacagagaatcgagaaccgagaccaagaagacaaaaacccgagaaatttctcgggtcgaaaactgattaatgaaattaattaaaatgtttatttttaaatcaaaaacatacatgaaaaagaggagggggggggggaggttaaccaaaaattttgagaatgactttaaacgccggatttacgacattttttaagaaatataggagtttttggaatccggcagtgtctataggcgccaccggggaaaaattggaaattttgatttatttattttggacaaattttttgactaaaaaaataaataaaattaagcatgatctattaatccttataattaatcgcaaatatgcaccaaatatgcacaaaaaaacttgaaaattaggggtgcaaattaattaaaaaattttattcctcataaaataagttgtttttgcaattgcaaatcaaaaatttctcaaggttttcggcagtgaaactcactgttgatccactcgcgcatccattcaaatttggatttaattttaggcataatcaaaaaattttttcctaagagatattcaaatcggaaaatatttgaagaaaaatggcaaaatatgaaaaaaatctgaaaatatgtacaaaaaattggcaaaatatgcaaaaaatctgaaaatttgtacaaaaaatggcaaaatatgcataaaaacccaaaatatgcaaataaaagtcccaacttttgttcgcaaacacaaaaaagaaagtgtttttcctactatttagagcatggagaagccaggaaaaaaaatatgaatttgcatattttttgcagccctgataataaccattttgaggcaatcgcacttggtgactgtgcattgtgccgacagtttatgccattattctgttattgtacacgccgcccattctgttctctggtctgtacatgttgtgattcttcaacccatacgtcggttatgtggacaattttggcagaaatgtaaagatttttcaataaattttaaacatattgtaccgtatcaatttcacaattacagtaccacagcccaatgcac

SEQ ID NO: 41382 - DNA, 956 bp, Heterodera glycines
  misc_feature (16)..(16): n is a, c, g, or t
  misc_feature (26)..(27): n is a, c, g, or t
  misc_feature (871)..(871): n is a, c, g, or t
ttgcccgagaattaantttaatagtnnttgtttggctcatcatatgctcataaatggcagacgcataattcccaggctcatcacatcttattgcgtaaaatttcgtctgttagaaatatatattttttaaactgtagcctggtgtacaaataaatgtaaaaaatttcaaacaatttttttttaataaatattttcgttcgcggttgtttggtttttcggtaaaaataaattagaaacgccgtaaaaaacacaatatgtttaggttaaaattctttgtgatttcacttatttcccatggaaaatgtacaacaaaaatttataagggtaactgcttgtatatttattaattttgcctctatttttaaatatatttttttacaaaattccaatttttatattgaatcacaaaattaaaaaaaaattctcttaaatccgctaatattagtctttttatttatttattttttttggaataaacgaggaatgtttcaaaattttcatcaaaaaaattggcaatttctatttaaaaagtttgtccaatattttataaaatttcccagcgcttatcggtgcagccgaactctaaaactcataaatttctctttatttgaaattcaaatttatttaattatttaggtggatatttaattcaaaatttatttattaaaatatttaaggtattattattcatccgaatttccacaagtgtagcaagtaatttattttgtgacattgaacataccgtaatctgttcaagaagtctgttttcctgtatgtatagtgaccaatcactgccaatttccgcaaattcaaacgtttctagcagaatcatttcaccgtatttatacagtacgcaaagcaacaaaactgngtctttaattgtttttaaaatgtttatttgtgcccattttgaacgatgatttgctagtctggcctccaatttgttcactgatgaa

SEQ ID NO: 41383 - DNA, 895 bp, Heterodera glycines
aaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttcctcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaatacaaatttccgcagctcttaaggtaatggaaaaaatttt

SEQ ID NO: 41384 - DNA, 945 bp, Heterodera glycines
tgaatagtcaagtaaatggccattgatcagagcattcgttcattcacttggcggagttttgaacattgcgagccgccgaaggcgacgtttgactctgagcaaaagccgctaacgcaaatttggccatttgggcagtcttgcatcagagagcaggggagaaggccggaggggcgccctttggcaacaaacaaacgattggcaagagaaacgaatgaatgagcaaatgatgacccaaaagcccaccgatcgatgagccgaacgaatagccgccgtagccgtaaggcgagtacggagaagagaattcggcacccatgccgagcccataagtgccgagtccgccgcccatgccgtaccccgctgcaccaagcgttgcgcctgcgtatccccccgattggaaggtgcaccgcccggacaaacacacttggccactgcattcgtttggcggaaatttgaaaattaattttattcacctgtaacaatccacggtatccgcacacactgaaaaatgccgaattaatcgaggctaataaaaccgaatttgcgctaacatttgttcgctgcgctgttcagtccgagcattccgcccgccccaccgtacagcgcactaccgtaccctccaccgtactgaccgctggccacagaattcatttggcaaacgccattaatgcaccattggccgagagggcaagatacgaaacggcacaaatcagtggtgccatagcctattcaagaaaataaaagcgaacaaacaaagtgatggcaattaccacgaagggcagagagaaagttactcccataaaattgggcaaaactaaaaattagcgaaaaaacaaattaattaaattctcaaaaataccccaaattaacggaaaaaagaaagagcaaaagggccaaagggaaagacgacggaaaaagcattgacagcgaaagcggaggagaaagtcg

SEQ ID NO: 41385 - DNA, 1165 bp, Heterodera glycines
attttcacccgaacatttacgcggacggcaaagtgtgtatcaggtgaggggaaagggcctccattttgtacatgtacacaacaatgtttgattctggctgacatttggcatttcatttattcaacaaaatttaagaattatacacaacaccacaacaaaatttattaattattataaaatttaatcattgaacaaaaaagcaagatttttttaaaactcagaaaaattatttaaattttatatattttttaaaacggaaatccacaaaaataatttggttgtattataaaaaaaaacaatttcaatttttttgcatatgagttagttgcctgtgtaatatttctatgggaggattcaacctcataaaatttggtttcaatttttggaatttctgcgcttttttcagcattttgcacaccccgggcgacgacccgaccggttacgagacgagtgccgaacgatggtcccccgtgcagtcggtggaaaagattctcatctcggtggtgtccatgctggcgggtccgtcccttgccaatttgatttggcgttgacattggcttttttcatggcattttgcccatccatcctttgcagagccaaacgacgaaagtgcggccaatgtgaacgcggcaaaaatgtggcgtgacaaccgtgcccaatttgagcgaattgcgcacaaactcgtgcgcaccacactggtaaaacaggggaaaacgtgtacaccgcaaaaatgttgtcggcacacaatttcgccgcaattttaaatttaaaaaaaaaatttagtttttttccaaagccttggtttactgaaaacaatatttgccgattttccagggaaaaaaactagtatttttatttgtttccatgaattttcttaatacaattttttttttcgtattgggctaggtagccaagaatttttgattattttttcttgaattttacaaattttgtggcgaggtttcgacggcattgttttatcctgctcctgggaaaaacaatttgcaaattaattaattaatttaattgatcattgtaattaaatcagggtctgccggcgcaaaaaccgggcgacaacactgacgaaacagcagcgacaacaacggcggcggttgtgcccggcccaagctcatcatccagatccagataaatgctgacacatttt

SEQ ID NO: 41386 - DNA, 604 bp, Heterodera glycines
ttatccacatatacatatgcagcaattattcgttctcctctaaatccaaagatgggatcatattttgttaaaaaataaactcacatgaatatcattttatcttcatctagtttgataggcattttctcctttattaaatttctgttaacaaatttggccaattttagggaattccactttttaagctcatcttcgttttttttattaatttttataagaagtataagttttgctaagttctttttttgggttattccaactaacatatctagcacagaaggttgttctgtaatccaaccagttaatcccgattttttggacatgactaaatcggcgtcttggctttgagatattacaaaaaagtttctttttccaaatgctctattcgtaaaatcacatgaacatatgacttctgcattgttttcgttaattgatttaagaattaaaagcccataatcattcagctcgggtattgtatttccacacccgcgatgagtcagctcaataaatgcgctcgaatcgtttttcgtaatattattattaatttcattcaaaattacgcggcatgtgaatgaaatattaaataatggcacaagaaataata

SEQ ID NO: 41387 - DNA, 1200 bp, Heterodera glycines
ctgttgaaagcgatgcagaaggtggtgagaactcccgggtgtcaattgctctacactgataccgactcgctgattttcgtccatccaatcggcatgtgtccactgaaaacagggccacacttgggacagttcaccgatgaatatcctgagcacgaaatcgtcgaattctgcagtggcggtgcaaagcagtatgggttggctctacggcgtaaaaatggccaagctgatgcggaaatggaatacgtgcttaaactccgtggattgacactcaattatgatgtgatcaacaaccaaggcttaagatacgaaaccttcaagcagcaagtcaaacgttatgctcaaacaggagagattgaaccaattaatgtaatgtacccaaactttattagacccaatattcgtgatggtggatctgtaatatcaagctctatgcaaaaatgttatcagccttatgttgggaagggtattgtaggagccgattataatgttctcaattttggacacactttgtaattgctcacccattataatgtcttttcaccattcattgtaattgttcacacattgtaataccttcttcaccaatcattgtttctctctcatatacacatgtacccttttatgttttttcgcctcttttgtatctctctctcatatacacatgtactcttttatgttttgttgatctgttattgtatctctctctctcacacacacacacacacacatacacacacacacaccccatacacacgtacacacgcatgtaccacctttgtttttcatgttttataccaaaaattgtgtaatttttcattttatttgcgtttttaataaaaatacatgtataattaagcaatggaagttacaatttgtaaattattaagcaattgggaacgtcatttttaggtagaaaaatgcataattaagcgaaagaagttacaatttgtaaagtattaaggagtggaagatacaatttttattatgtgcacgaacttgtcgtttttaggtagaaaagtgcataattaaacacattaaaacacatgcagaattaagcaatggaagatacaatttgtaaattattaagcatttgggaacgtcatttttaggtagaaaagtgcagaattaagagaaagaagacacaatttgtaaattattaaggagtgaaagatacaattttaaaaagtgcacgaacttgtc

SEQ ID NO: 41388 - DNA, 1175 bp, Heterodera glycines
attgaagaagaaaccgaaaatgatcaataggaaaatttaaataatgaaaacatcgctttaaaagtgccaaagcctttcgaaccaacagggataccaactctgatggtttatcatcattttgatgattttaaggtgtgtgtcgccaattttttcattggcgacgagaaggcgggtcaatccccgccgactgcacgaaatggacgggactggactcaaccgaagcaaaaagaatgagggacgtacttggagacggccggggcgaatcccgattcatcaatccgctaaaattgatcattcctaattttaccccttttttcatccaatttctcatttgcatttttgctccatttcgtaccattcactttttgcccgtttctttgtcccatttttgcccaatcgcatccctttcacaattcaaattcttttctcatcggctggctcatctctggccaactttgtgcttaacaaattgcacaaagatttcctttcaccattttctatctttcccatctgcctatttgcattttgtgttcctgtgtgccatttcctttgtgcccactttcgcttctagaattttctgcccatttttatgtccctctcacaatttgtccacgtgtattcccttttgcccgcccccttcgaaaattgtctatttaagcggccccgaccaaggggtcgcgttctctttcttctcttccttccactcccctccgcttcattttcggtctgcctgtgaccaatcctccaattcccccgtcccatcgcccaattcgatcaattcgtcgcttttattcattattcgttttgctttaataaattcgtgctgaaacggcttggaggactcggaaaggagggaaaagcaccctccacactccatcacattcggcaaattctcgtgtgtggccaaacgaaggcgcccatccccgtcttgaccactccctttcccgacagcgccctcgtcgttctcccccaatcctcccgatcccaattcctttccttttggcattggagaatccgggaattggcccggagcatcaacgaatttcaagcagttcaaactcccgcagccggagtctcgcggatcggtatcagtctcccgccagccggagcaaccgtagggacggggcgaattcccgtcgtcgacgaatccaagcagggcagtgaaggaaggaaga

SEQ ID NO: 41389 - DNA, 1046 bp, Heterodera glycines
cagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtggtcacgtctgagttcaggtcgaaaaatcaaaagcaggaa

SEQ ID NO: 41390 - DNA, 906 bp, Heterodera glycines
ttttatcaaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaataaacttttttattgcgctacaaatgcttttaagccccgccgtgaggcgggacagttccaaaatttgcaccacattttactgtggaaagtccaagtaccttaattggacaactacgcgtcaatgagcacagtcgcctctgacctcttatggagcagaaaagggtgaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaataaacttttttattgcgctacaaatgcttttaagccccgccgtgaggcgggacagttccaaaatttgcaccacattttactgtggaaagtccaagtaccttaattggacaactacgcttcaatgagcacagtcgcctctgacctcttatggagcagaaaagggtgaatatcagatggggtgcgtcccatcctaaaaattcctcttttcgtctaaccatcccctcccttttgtgcactatttcgttttcacattttatcaatttttt

SEQ ID NO: 41391 - DNA, 777 bp, Heterodera glycines
attaccgacatttgcggcccgacttttgcggcgcgacatttgcggccccgacatttgcggcccgacttttgcggcgcgacatttgcggccccgacatttgcggcccctatcttaggggtcctatcttgacagttcccagccccttaccaatctttgtgttacatacttttgcggcccaacttatgggggcccacaatttgcgatatagatcttgttcgtaactccattagctttttttgaatgaatttctcggcgcggatgtgatctctcatctgcaagcgcaataatggttccagcaattccgggcggcgagaaacaccaccaaacgcaagcttggctctggaaggccgtcgacagtgaacaaaaacgttttgacacgacggttgcgacgacacgcggaaagttcctgcgcataattgtacgatgggacattgctataaaacaacaacatggcgctggcttcgcaaatctggtcgtcgccctatgatgagcaaatgggtggcacaccgtctgactgatcagcagaaacagcggcggctaaatctgtgtctttcgaacatcgcaagacaccggagaggatatgtgctgacccggctggtgacatgcgacaaaagctgcatctgttacgatggcacagcacagaaaattgtattgagaaagaaggaggaagacccaattttggtcccccgacccaacctgcaccaaaaaaagcgcatgttgtgtatcttttggtcagtacatggcccactgtactgggaactgctggcaccttgtcgg

SEQ ID NO: 41392 - DNA, 1126 bp, Heterodera glycines
tacggtaggtgcagaaacatactgtaggaaacatactgtaataccatgcaataaaaggaagaaaaacatttaaataattaattttgtctgtcatttttttcttcgtgggcgtttttcccacgtaatctctcagactttgtcagctgtgtttgggcaattaggggcacaaagctcaaaattgaactgcaaagttgaaaatgttagccatcccatggcaaccaaaatgacaattaggacaattttttaacaaaatatgtgaatttttattaatgcttttcattgtttctaagcatattgaacgaataatgtcgcattttccagtgaaaacagaggaaattactgtaattcccattttcagaagaaaaaaaaatcgaaaaattacggtttgaaaaatcgtttatataaacactcaaaacttaattaaaaatgataaaatagtgaatcactactcactattcaatttacatttgtaaaaccggcacacctaagtgaattgaatagatttccatttcattttttaattcacattgatgagggttaattttagggggtaggctcataaatttctcctcctcccattggtgggttaattaagccacaattttttagcctttataatttaaaggctctttcaattaccgctgaaaaaagaatttgcagctgcgattttgatttacaaaatacagctattaccaacaaaaagtatgcaattatcgccaaagttataattagatttatacgcacatgattctttgaaaaatcgtcccaatttaatgccgaattatgggtgatatctaaagtagatccaattcatcaaacattgccaataatgtgctcaaatttcattttcctatttttaaaatttccaatcaaattaatttaaataaaatttcagctttgtttctttgtcccaaattttctccgatggcttcctccaattcctcgtcaattccttcgctcgattccgcggtcgtaatttgtgccattgttttgtcagccatcgaattggtcgttcaattttcggcatttctgatttcggcactaagcttttccattctgtgcacatcgtcgctgcttcatcccaatttgaagtgcattttgctgatccaaagtgtcgtcattggct

SEQ ID NO: 41393 - DNA, 728 bp, Heterodera glycines
cgaaaacctccaggaaacagttttcatgattttttcaaaccaaacgaatgcctaaccgttgatcttttcggggagcaaaaggacacccactcagcaaaagccaacagattttaaaaaggaaatgctgattttcacataattttttcattatttctaagccatttaaatccgacgaaaactgtctgaataatttccgctcaacaaaatgtctgacaaccgaaacgaagcggaggaaaaaatggcgaaagcaatataaaattaaaatgccaattttcaatttcaatttttaaattttgttttcccttttttcagttttatctccgccgattgttggctttgtgtgtacgatctgctcccggcttcacaacttggccttggaattgcactgatcagccaccgttttgacttttatgtggatgaacatttcaagactcgtcgctggactctgagatccatggcaattaaatccaaatccaaatcggatggaaccgtgggaatggatattgtcaattacgctggaaaagcattgccaattccgcaaaatccgttgccaaagaaagtcgtcggattcaaagccatttcaatgaagtgaaattaatgattctttttttctggttgtaaaacaattccatcatttttcacagatacttcaacaacaatgccatcgcttttcccggcaattttcgccaactttttgccaaatgtccaattaatttgaccatcgatac

SEQ ID NO: 41394 - DNA, 588 bp, Heterodera glycines
atttcggcactgaactgctccgtaaggatggccatcgtgttcttttgaatcattcccatccatttcagtggacgacattcaggcggcctgctacaaaatcctcgactcgctttacatggtctcccgcctggccaacagttgcgcgtcgcggcagagcatccaaattgaagtggaaaagcatcggtcggcccttggccaatgtctcagtgccttttccgcctgtttccccgtcgctttcctcgaggccgaattcaacgccaacaacaaattgtccgtgctggccaaaagccgagaccaatctgtgcaagtgcaggaaatgttgcagaatttgtcccagcacattcccatgttggacaaattgttgcaggaaattgagcaaagcgcagcaaaagggtcagtcgggggagagggggagaaacggtgtgggggtggggattgagactgatcaggccgatctaaaacagacccaatcaaaaggactacacttggggagagggggttggggagaggggggggggagaattgaggattgatcataacgatcccgatctcaccatcccacactaactacgctcggtttgattagag

SEQ ID NO: 41395 - DNA, 521 bp, Heterodera glycines
atttttttcctgttatgaatttggtacaaaaaaataataagagaaattctgagtactaatttgaagtttgtaacttattggtcaaatacaactcaatccaccaacattccaatcaacgggactcaatcctcaagcatttcaatcagtgggactcaaccctccagcattcaatcacttggactcaacccaccaacattccaatcaacgggactcaatccaccagcatttcaatcagtgggactcaatccaccaacattccaatcaacaggactcaacccaccaacattccaatcaacaggactcaatccaccagcatttcaatcagtgggactcaatccaccaacattccaatcgccgggactcaatccaccagcatttcaatcagtgggactcaaccctccagcatttcaatcagtgggactcaatccaccaacattccaatcaacgggactcaaacggaacttatatccaccagcatttcaatcagtgggactcaaccctccagcattcaatcactggga

SEQ ID NO: 41396 - DNA, 921 bp, Heterodera glycines
ttttatttcacagaggatttttatatttatactctatcccagaaaaatggctatctctttttttgagaaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgagaaattttatacctcacaaaagcgcttgcgtatgagacggagggctgtgcacaatagaccttttatttttgagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactct

SEQ ID NO: 41397 - DNA, 934 bp, Heterodera glycines
gtatatgattaatataaaaatatattttaattatgtagcggaatttaaataaaatatatattataattaaatttatttaacataattatttgcttttcatttttaaaataaataattcgttctgcttttaatttgatcatttgcacttttcggacttcgtctcagcacgagtgattttctccctttttaccgctatattatttattatttgttttttattaatttaggttccgtaatgagccgaagtgacaaaagtatcaattaattgaaatatttaaattaaattattattttaattttatttgctaaataataattcataacttagctcaagcttaagtgattattcattttttttattaaaatgtagctttacgtatcctctattatttgtaattttactagcaaaaatttacaaaaagttgtggtaaaaaaaacttccaaaaatttagattcactaattttgtccctaattttttttaaatcattaatattgttgaaatttgacagaataatagagaaatatttgggttacctaatgaattaattgaagtttgaacaattttcatgcataaacaaacttacattttttatgaccataaaaatattatgacacatttaattccttacaattagtaagttttttttcagaaacaacaaaatttaaattttcttttctcaattattctgttgatttgaaaaaattttataaattgtaggaacaaaggttgggctagtctaaattttttgaacttttttaagttacaatttttgtaaaatttttttgctaaattttttagcaaataaaattaaaataataatgaaatttcgtcaatttcataaaacaattcaaaaaaaaattacgaaattgagtaacatttcgagtcttaaatgctcattgttagcctgcaaaatttcatgaaatttcttaact

SEQ ID NO: 41398 - DNA, 632 bp, Heterodera glycines
aaatttggagagattatatcgattttagtgtgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccgaaggacttcacctcggccgcttcgcggcctcggggtgggc

SEQ ID NO: 41399 - DNA, 1265 bp, Heterodera glycines
aaatttatactgtcacaagtcagacagaaatttaaggaaaaatataggaaaaaagtatccagatatgaagaagaaattggcacgcaccctatgttagcaaacaagaatttaaataattatagaataaatatgatttaataaaattttcttcaaaaaattgaaaaaaattcaggtgaagtcaacagaaatgaaatagcgaacctacttaacaagtcattatcacttctcgccctcccccccccccatcgcccgctcaatttgcgcgtttctcctccgtttgttctgccactgtcccttccttcctcccaccaccgccaaacaaaccaaccattttcgcgcattccttccctgtcatttcctttactcccaaaaaaatcatccgtctttcaccgtttcttttggaatttccaactatccgagcttcggcaaaaaccaaacagaattgttttatccctgttttttcaatcgtttcatgaacagaacataaagccaattctcacaaaaaaatttcattatttgaatgtttgtcccccaaacgaattaaagtgaaagggaatgggcaaatgttgcgacaaaatatcacattgtgcagcagagcaacaaatttttccaacaaatgtcgagacgagaaaaaaaggcggagataggaagggagcatggatcagcaaaagaagcagggggactgattaaccagcagcagtggacacagagggtggggggggggggcgaccggaagtgttttctccggcacgtgagacggaaggaaggggaggagagaggggaagatgggcataggaagggactcatccgggggaggggtccacggggcaggtacgcatcccccagagcgggatgagggtgggcggaagaaattaaaaaacgaaaagatgaaagtagtcaacagacgaggcaggggggagaggtgatcatcggttaaaccgggggatgacaaaaccggggaccctgcatatgcaactcgggggactttaattttttttccattttatactttcaacagaaattgttaaataaaatatctttatgtaaattgtgtaaattttattcaactgaaaataccactctttctaaagcattctgctggggcaaattcaaaaatcttgtccagtaaaaagcggggtcccaacacatcacaatttttggctcttattcagtttgtcccccataatttttttttaatttctaagaaaaaaagacaaaatataggttttcagggtcgctgatcacgaatccgatatccatttcga

SEQ ID NO: 41400 - DNA, 1458 bp, Heterodera glycines
  misc_feature (73)..(73): n is a, c, g, or t
  misc_feature (100)..(100): n is a, c, g, or t
  misc_feature (1250)..(1250): n is a, c, g, or t
aaagattgtgccattggcgttgtttgacacttttgtcctcctccgccttcttgcgctcgcgctcctgcgtttngaaatagtggagtccattctaaaatanaattaagaatgaatttggtgtaatttttttaaattgttaattaaatctgaatcatgctgatctgatcggataagtggtctccacctttccttcgtccttctcctgcgaatgtaccagaaaactgtgcaccgttttgccctccgactcaatgtcaacctttggcgagcagtaattgtcaagcatcacaatttggaagcctgtgaaaattataaattgaataattgatggggtgaaagtcggaaatcgagcggaactgataaaaaatccgcaattgatcattgggtggaaaatttataaattattttaaaaaatgcttaattttcatgcgccacacatggcaaatccacttacagtattccgagagtgcgtcgcaacagttctcctcaatgtccgggagcagattgacgcgtgccgcacgctcgcgcaacacttggcgaacatacaacgcgcactctttgcccaacgggtccgcctcatcgaagcctttgaatttttcaaattatacagtataaaatcaagtgtgtacggtaaaacaatacctgaatggtacagacaagcaagcacctgaacttatttgtaaaattaacggcaaagtcagagcatgagccgcgattgtcggcttacctgtggtcctgggtccaccaccactttttggtcctgtcccggcaatttgttggtattttcgtgccaattgtctgtggcatggcaccgcgtcactgcctcttggtggcacgcctcgtactgttgagtgtccacgagtgccatgtagtgtttcacctgcgaataattaaaacagtagtagtactccattttttaaaaatatggcttttttctttttgcaatgcgtatgccgaagcattcgacactttccatagtgataggatttttagaaaataagaaacataaaatgtccctaatttttggatcttcaaatggaaagattgaattaaatgtcacaaatttagaatgtttagccaaaaaatgaaaacgcattcgcattaattgtgtcatttgccgcccccccccctccctcgaatttacaaaataatttaaaatgggggagaaatttagagagaattgaggacgacataatgttttttaataaggaaaacgatgaatgattaagccaaacaatcgaagaagcgagggngggggggggagaagccaaggccaagttgggcgagggaacggaaggaaggtggaaaaataatggcccccccccaatcatcccttcccctcccctgctgtcctccctctttctcctcttttccagcagggcaccgctttaagcgtgtaaaattgttttttatcaattatgaaacggtatttttgcctacagtatcctgctaattgcgtca

SEQ ID NO: 41401 - DNA, 1383 bp, Heterodera glycines
tttgagatttattgagttgaagagttgcgatcccaaaatttaaaatcctcatttgagcactaaaaatatttctttatcacataaactctcaaaaaaacccatttagcataaaaatttttaaacaaaaaatttacaatagttaacacaaatttttcgttagaaatacaattaattcataaaattcttgccctagggaattggtaaacgtgaatggaaaatattgttttttaaaagaggttgaaaacaaattactcagattttggtcttatcctcatgctgaaattttcgtaatccctaaaattttgcaaaaaatttctcctatttatttaaaatattttcaaaataccaatctgtaaagatataaactcagattaccctcaaaaactcattaaaaactatggtgacctttttttttcttttgaattattttagctggggactgaatgggctattcaaatggcgtcgaggaacggatgaatgccgcattgagtcatggaatatcaaattcggcaccccccccccacatttgaacttgaaaataaaaagaaacaagcaaattcaaaaacaattcagaattcaaacggttttacaggcgctgaaccaatctacgaatcattgtcagacacggaggaagttgaactgaaggttaaaaaagtggaggaggcgaaagcaaaacgcttggaagactcgcaaaaaatgctgcaaaatgaggtacaaaagttaaaaaaggaaattggttgaattgaaaaagaaggaagtgtcaaggaagagaaaaagattgatagaaactgaaaaagtggaagggaataaagtgccaacaaatgtaaaagaagtacaagagacggaggatggagaaaagaaggatgaaaaggaattaaaaggaattggaaatgaaagagatttgaaggaagttaatgaagaggaaaaagaaaagaaagacaaaaaaggaaaagaagaagcaaaaaagaaggaaattgtgttaattgattcggaagaagattggaaaaaagtgtcccaacatgaagacgaggtttcgttaggtcctgaggaggaggacgacgaggagcgaattttattcccaactccaaagggtgcagaacttcagaatttgagtttttgggaatcgtgccataataaagcaaaaagtagaggcgaaatggaagaaaagtcgagagaaaaggaaaagagggaaacgaacgccttgcgtttggcacgagccgaaattcgatcggcggaattaagcataattgaaaaaagagacgaagaaattccgccggaagggaagagaatcagaaatgaattggacattaattgcgaaacggaagaagaggaaaggaaccgaaaaaaataccgagctcatactcccggtacgggaatggcgat

SEQ ID NO: 41402 - DNA, 153 bp, Heterodera glycines
ttgatgacgacattaggaatattaaatggttttatatttgaaagaatattaaaaatcaggacatatttaatgcttccgattaattgcttaaatcaggacaaattcaaaaaatcggtatatgataatttaatatgtattttgaaaatattttgc

SEQ ID NO: 41403 - DNA, 1238 bp, Heterodera glycines
  misc_feature (1101)..(1101): n is a, c, g, or t
  misc_feature (1173)..(1173): n is a, c, g, or t
  misc_feature (1197)..(1197): n is a, c, g, or t
gggattcggtctccccataaatctgggcgcatcggttcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagaagttaaaaaatttttaaaatttaataattttcctgcaccgaaggaactcactcggactcttcgcggactcgtggtgggccttcgttcaggttaagttagtcctttacaatggagaaggcctgcaaaatttggagagattatatcgattttagtgcgctaggttcgatgaaactttttaaaatataagcctaaactttttggcctgtttnaaaaggaaattaaaatttttaaaatatttattcatctcccctttgatagaaaaagcatcagagagccttatntaacttttattaacatttggtgcngttcagagcactttctgaaaaatacttatgaattaattttg

SEQ ID NO: 41404 - DNA, 998 bp, Heterodera glycines
  misc_feature (892)..(892): n is a, c, g, or t
aattactttttatcggcaaaacatttcagattcaattgtttgtcaaaggaacacactttggccgtgtcgtgccatttttggtccaatttcacaagcgtatggttgtcaagtgctgtgtgaattttaaaaatttatatatttctaagatttgtaaaatgaaaaattgccaaactattaaaaatattttatttttcaataataaattccaaatgatttcctctctctattagttaattaattcaaaaagaatttgccaaattgtttcactaccgtagagagggtcaaaacgctgtgcaacattttcgttgagtctttttacggattaatatttaagctgtgcaattaaagcaagtgaaaaggaagtggaaaaagcagtcgatgagtgctacatggagcacaatgtggtcaaagtttatttgttagcacaatcgttgtgaatgcatggaaaacaatgtgccatggtaaaaaaggcaatgaaattatttaaaaatataattaaatattaattattatgtaaaatgatattaagcaatggttacggtattgagaaatactgtgagaaactgaaaagcgaaaatgttgtccgacaaatcatttgttaatgaaaagttatgaagtgaattagcaagataacagccgattaaccttgtcagaaaatgtgtataaagatgaaacttttaaattttgcacaaaatctgaacgaacttttgtataaattatgaaaatcaaaaatatttattaaaattctgatacttttgtagaagcacaggaaaacaaggattagaaatagtataatcaagatttgaaattttaaattgattaataatttaatgtaaatccatgaattttaatttctttactttttcaaagcacttttgttttactatagctnttaagaatgagtaacaataatgtataaatgaggtggataagaagctttaataaaaactaaattacaaaaattgccaataatcatataaaataggaaaataattact

SEQ ID NO: 41405 - DNA, 1264 bp, Heterodera glycines
  misc_feature (17)..(17): n is a, c, g, or t
  misc_feature (79)..(79): n is a, c, g, or t
  misc_feature (101)..(101): n is a, c, g, or t
  misc_feature (135)..(135): n is a, c, g, or t
tgcactgagcagattcncagatacgcaaggaatctgtgtaaatacatgtaaaaattgtttttgaggtttttcaactttntcgggaatgataattttctttntaaagatatcaaattcgaatttcaaactaaactntaattttcaagggccaaaaatttaaatactttcaaaatatacaaaaaaaattgaaaattcctgtaactcaaaataatgtgcatatttgtgatcagcagcccaaattacgtttgaaaaatatgttttgaaaaatttagagttaaaaaatgtgtgcatgaaatactttcaaaatcagttttattttataacttttttaaaaaagtgataaaaatcttggataaatacgtatatgattttaaaattaaataaattaatttacagcatatgaaaaataatctaataaaataaaaaaaataattttgacttaataattagccttaaaaatagctgaaaataaatcaaaaattgatttacaccgtccggattcgaacttcgccccagaccccctcagaataatgctcagaatccccaatcacacagggattctgaggccttaacgatgtcatatggctaatctgatttcagattcgtgatcagcgtcataaaatatccttaaagacatttttttgaaagatttttgatgaaaaaattttttcactcaaaaatactggtcagaccccttttgtcccgaagccaaaaatcacttttatttttataacttttcttaaaaaaagtgataaaaatatgaaataaataacttcttgtagagcaaaaaattgcggattttatcactattttattataccttagcgccttttttgaaatgagatatgcattttttagtggaaaattaaaatttttggctttttcaggaataacttttttccttttaacggtataaacactcgaataaaatatataaaatttgcccgatttttctctattatttaaactttaattgagcagattttgacctatttgaggggagttgtaaattttcaaaatttagtttaaattttaaagggcaaaaaattgtaaaaattcaaaaattcaaaaaaaattcaaaactccctgaaactcaaaataaagttcatattcatgatcagcaacccaaactacataagaaaatgtgtttttgaaaattttaaagcaaaaaaaatgtgtccatgaaatttccaaagcggtatccctttggattttagctacaaaatcacttttattttttaactttttcaaaaaagtgatgaaa

SEQ ID NO: 41406 - DNA, 940 bp, Heterodera glycines
ttcatctaaaaggtttttcataaaaataacaaatttataaactaaaacttattatttttaatattaattttgatttatttttattttattatattaaaatatttcagatgtgatctgtttctatttaatgaaaatacaatactaaatttgaattacagaaatatattaaaaaaaaatttaatatatttttattcatattgaaaaacagagaatttcttagataaaaaataaaaactgatttaagcatgaaatgatttatgcggctttatggcttatctttaaaaatgaagaaatttggctacaccttatgctgctggtcatgaaaatgtaaattttttattaaataaaatttagcactttgtcatattagtgaatcgcattaaatacatcacgcagaattataaaaaaaatatgattatgattacgttgtttaatgatgtcatttctcaaacgcagcatctcgagaaaattgccaaatttttaattgattattttttaataaaaaaattttaataataaaaaaatatttgaattatataatttaattcttattttatttttatattcgaaattataaacttggatgtatattaatttaattttagctggaaaaaacacaaaaaaagaacaacaaaaactgagtgaaaaagtctaaaaatttcattacaaaaaattgcccttaattttaaaattataatttttggatcaaacgtttaaccggcaaaataaatcaaggttatctcgaatcaaagcataattaaaacaaattgtgtgcttttggttgatggagttgaacatctttcactaatcagcagaagtcagctgttcctccgaaaaagcgagattatttaccaaatgagagatcggaaaaagaaacgagagtgactgcgaaataatgggcactattttcacttttttggatgtattttaatctaatttt

SEQ ID NO: 41407 - DNA, 994 bp, Heterodera glycines
  misc_feature (976)..(976): n is a, c, g, or t
agcagaaaaagagatagacgttttttcaaattttcagagccaaactcgcccagaaagaaaatccagaaaaattagggtcgtcgctattattccgaaaatgtggttggagttcatttgagcgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagcgttgagcagaaaaagagatagacgttttttcaaaattttcagagccaaactcgcccagaaagaaaatccataaaaattagggtcgtcgctattattccgaaaatgtggttggagttcatttgagcgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagcgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaattttcagagccaaactcgcccagaaagaaatccagaaaaattagggtcgtcgctattattccgaaatgtggntggagttcatttgagtgt

SEQ ID NO: 41408 - DNA, 1319 bp, Heterodera glycines
  misc_feature (1309)..(1309): n is a, c, g, or t
gctggtgggttgaatcccagagattgaaatgctggtgggttgagtcccagagattgcaatgccattgaaagttggtgggttgagtcccagtgtctggaatgccggagatttgagtcccagacattgaaatgctggtgggttgagtcccagcgattggaaagcctatgaattgagtcccagagattggaatgacattgaaatgctggtgggttgagtcccagtgtctggaatgccggttatttgagtcccagagattgaaatgctggtgtgttgagtcccagagattgaaatgctggtgggttgagtctcagagattgaaatgctggtgggttgagtcccagagattgcaatgccattgaaagttggtgggttgagtcccagtgtctggaatgccggagatttgagtcccagacattgaaatgctggtgggttgagtcccagcgattggaaagcctaagaattgagtctcagagattgaaatgctggtgggttgagtcccagagattggaatgccattgaaagttggtgggttgagtcccagtgtctggaatgccggaaatttgagtcccagagattgaaatgctggtgtgttgagtcccagagattgaaatgctggtgggttgagtcccagagattggaatgccattgaaagttggtgggttaagtcccagtgtttggaatgccagagatttgagtcccagagattgaaatgctggtgagttgagtcccagcgattggaaagcctgagaattgagtctcagagattgaaatgctggtgggttgagtcccagagattggaatgtcattgaaagttggtgggttgagtcccattgtttggaatgccggagattttagtcccagagattggaatgccggagaattgagtcccagtattggaatgctggtggcctgattttcagtgattggaatgtcattgaaagttgttgggctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccggagatttcattgtttggaatgccggagaattgagtcccagagattaaaatgctggtgggttgagtccaagtattggaatgctggtggcttgattttcagtgattggaatgtcattgaaagttggtgggttgagttccagtgtttggaatgccgaagatttgagtccccagtgtttggaatgccangagatttgag

SEQ ID NO: 41409 - DNA, 1068 bp, Heterodera glycines
tttatccaaaaatttttttttgggttttcggggcagccctcctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacgacacttgaaaaatcgattatttttgttttcggggagtccccccaaccgatgcgcccgaattatggggagaaccaatcctccggaatagctt

SEQ ID NO: 41410 - DNA, 1358 bp, Heterodera glycines
aagataatccataaaacaacaccgaatttagcctcccaaaatttcaaaacttatttcgaaaaaatatcaaagcaacaaaagaaatctgttgcaaattgcaaaaacaccaacaaataagcgtacagctaatgcattgtctattttgcaagaaaaccattcgtttttgtatctcacaaaaaatggaatttctgctgattttatcttacttaagcaaagctaatagaaaaaaagaaagaaaacgaatcggaggggagagagcacagaagaaaaggacaaaatgacaacttctgctggagaatggaagaataaacagaaagtgagaagatgaaagaccaacgaagcgtgggaggaaatgtgccgaaggcgcggattgtccatcgacaaattaccgtggcgcctgatcgcgatcgcgcaagaaatatcggctctattgtatgcagttcacacgaccataaaaaaaagacgcgaccataaaatatttttgtaaatttaatgcaacataacttcttcaagaagcacccaaattaaacattcttggtatcattcggtagccctaagagtcctttattagcttgcttgaaaaatttcaaaaaatttcgttggggttcaaaaaagttgtgctcaaaagtactaaaaaaccagttttttgaaattttctagccataactttttgaactccaactaaattttttgaaattttacaggctaatagaggactcttaggggctctcaaatgacactaagaatgtttaatttggatgcggatgcttcttgaaaaaattatgttgcattaaatttgcaaaaatattttatggtcgtgtgaactgcaatagagcgccgaaatatcacggtcgcgttctgtaaatctctggtattcattgcacgtaatttcagtcagttcattgccggtcattgtgcggaaggatgagaaaaattttaaaccacctatggacctgccgttggatgcttcaacaatttaatttataagcataaactaatgaagaaccccacccaaaaagattggagcccggggcaattgtcaaaatgaaaagcaaaatttttaaaatttggactatttgttctgtccccattttcctcatcaatcgcacactttttgtgagcggacttgggtcaagaaatggttagctgtgaagatctgatctaatacccaacctatacgaaagtccaaaaattatcagcaaattcgttcctaaatcgtttatctttaagcattaccaaaagttgaccgaatgagcaggacagttgctgctgactgtcttacaattagtcgcgagcggagaaatttttgcgttcttatttgcggagtccatttcattttaaaataacattttttatac

SEQ ID NO: 41411 - DNA, 1223 bp, Heterodera glycines
  misc_feature (558)..(558): n is a, c, g, or t
cgtccaaatcggccccataatcctctctttcggccatcactatccgtctttgcaaccaattgataagttggtccgccttatgcataaattggaagtagcgaagggaatcgcctaaattcagaggtcgtcccatccgtcgttcgtttggcttttcctttggcttttccttttaccgatttgtgcctttctttgttggcattggtcactcagctgacaaaacaaattgcgaatgtgattcatgcgggttttgaggtttgccgagtcgaagtgctcctcgcggaccttcaaattcggcgaatttccccaccaatcgctttttttcgccattttgtaccatcgtttcgcttttctctcccaatcgctttaactgatcaccgaacgttttgatttcctgctccattactccgagtcgacgaagttgcacttcggctgtgttggctgagtcgggctgagctgacgaggacaaaatgggcgacctgagcaaagggaggcgattagaacaatgaatggccgaagagaagcgaggcgagactctcgagaaacacaccccataattanatgctaattaatggtcagctaatgaccccctcccccgcttcacctctcgcgcatccaatgttcagcttccatcgcttccgagtaaaacacttgcgactgcaaagactcggacaagcgctgcgcacgctgagaagcgatttcacggaaagacgcggacgaatccttcgaaggaatgaaactgtccattcggactgggaaatgccaacctgaagtcgtgccaatcggtcggtcagctcgcccttcgcgtcgtcgccttgctctctcagcattcgttctccgtccgttaccaatttggcaatggtaggttggcggacgacgaattcttgctgcagaatttggtgtttttggatcagagattgggccgcgtggaaggaacgaccgtagtcataactgaaagtgttagggattggcatatggtatcatactgtaattgctatacttttcagcccattggcccatcacttcatcccattcttcgctacctttgcattgagctcagcttggctattagccaccccaactgatcgtccgcctgatcagcccatgcgaaaaatctgatcacttcgcgcaaattcgcctcgcggatttggcacggttcgcccagtgcttcccatcgcttgtgcagtgattgcagtcgttcgttctgttctttttctcttcctttg

SEQ ID NO: 41412 - DNA, 1108 bp, Heterodera glycines
  misc_feature (86)..(86): n is a, c, g, or t
gcgataaaaacatccgaatcaattaatagcttttgagatataagttttatcatataatttcatttaaaaataaccctcaaattatnggtatgaacgatactttccaaacatgcacgcgttttgcgctcgagctatttatcatcgggcttgtcaatccaaagcgaaacaacaaagatagtgttttgaacaaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagatagaaatgataaacttcacgattcaaaccaattttcggtgctctaattaaccgcgataaaaacatccgaatcaattaaatagcttctgagataataaggtttatcatataatttcatttaaaaataaaccctcaattattggtatgaacgatactttccaaacatgcatgcgttttgcgctcgagctatttatcatcgggcttgtcaattcaaagcgaaacaacaaagatagtgttttgaacgaataaagggcataggttatttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagatagaaatgataaacttcacgattcaaaccaattttcggtgctctaattaaccgcgataaaaacatccgaatcaattaaatagcttctgagataataaggtttatcatataatttcatttaaaaataaaccctcaattattggtatgaacgatactttccaaacatgcacgcgttttgcgctcgagctatttatcatcgggcttgtcaatccaaagcgaaacaacaaagatagtgttttgaacaaataaagggcataggttattaagaagaagtgtcaaagaacatgcagcaataagcctgcaaaaaaaaataagtggaaaatacatgagtatagaatttattt

SEQ ID NO: 41413 - DNA, 584 bp, Heterodera glycines
  misc_feature (63)..(63): n is a, c, g, or t
ttctttcggtaactgtggtctttccggaatcaatccgttcaagatattcctgaaaaaattagncaaatttaccaccgccttgcaaaaactgttctgaccaacattccgtattttctgaaaagcattctttaaatagttaaggatttatgaaaaatacctctgctggtaaaacattagcataggataacaaatctggtttcaaatttttgtctgctgatgaataataacggaattgagtaaatcgtaaaaagtttatacggctattcaatactttgatcattttctaaacttttgaaaaatatatgtgcatattgaaaattataaaaacataaacagaattcgaacccgtgaacccttttttccagtttaatatagcagcaggggttgtgtgtttgacagctcttttcaactggcagctatgtcaattcgtttcatttccattgttcctccaatttataattatttcaattgtttatttttatttttttagtattacctaattaagcaaacaaccacataaaataattggcgctatatgaaaaaaggcatattttttgaaaattttttcaaaagtgggggaccct

SEQ ID NO: 41414 - DNA, 1391 bp, Heterodera glycines
agcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaggattgcaacaccgtttttgcacggtgtcatgacgcgaaaaaggcgcgtctcttcatcacattcacgaacaacagggaatggcctgagttcaaagagaatatatataaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctatt

SEQ ID NO: 41415 - DNA, 994 bp, Heterodera glycines
acacccatatatcattgtcacttttaggctcaccattccggcttagaagaaagtatccattaacccatgcccttggtcatttcgaccgtctaatgaatgaattaccattttaataaaataaatttacaaaaaattcctctccaaagcgcccaattttatttttatggttttagttgttaacttcatttcagtaatcgtgatacaagcatcgtatattgtgaatcatatgaataaatataaattttttattatatctatctattaaaaaatgtttttcttttagaaatacaattttttgcaatattcttttgcctctcatcaaagccaccattaaaaaatagaaaaattttttttttgctggtatttgtcgcgttgccatccacgttgaacatgtgttattggcatggcatgcatatatggatttatttatttattattgtcaatctcattcattatcttttcaaattattgcattttaatttgccaatttgtaaaaaaaaaaattggatttttacatataattaaagtttcacaatcattaaaaatggacaaaaattcgctgatcatcactgttctgctggtgctgatcactggtgccgtgatgatgatttgccattgtgtgccggttaacattggcccaaccataaatgccaatccgaaatttgatgcaaatctcgctgtagcatatgcagaaattttgcaagctgcaattatgacgaagaaagaggcacaaaaaaaaattgtcaaaattttttgaaatttttttttataaattaaggctattgttactcaaattatctgctccattgacaaccaacaggtgggatgctgaggacaagctgtggagggagttcagctatgcctattatgcctaaaaactcgggcatttaacagcataattatgctcctaatttcctcaaaaatggccattttttgtctatatacagcaccgccgaccccccaaattcccctaaaattacaaaaattttgacta

SEQ ID NO: 41416 - DNA, 973 bp, Heterodera glycines
taaatagattttatagcaataaaatatttattttaaagaaatagtttttatagcaataaaaatattaattttaaagaaatagtttttatagcaataaaaatattaattttaaagaacttaagtttgtaacttttattacatgtattttaaatattcactgactcaaacaatcaaaaattattttttaaatttaaagttggtgtcgggttttccagtgtcggatttaccgctagtgtcggattttccaccggtgtcggattttctgcttgtgtcggattttccagtgtcggattttccggtgtcggattttccagtgtcggattttccggctcccgggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaattttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaattttgaaggcgggggggggggg

SEQ ID NO: 41417 - DNA, 897 bp, Heterodera glycines
agacaaaagatggtgtccaattcccggtagggatttaatatgactttcagagatagccattttttgtcaataactatttttcgtgcgttttcaaacacactattagtgctttattcaccgctacaatagaagacaaaagttggtgtccaattcccggtagggatttaatagtgactttcagagatagccattttttgtcaagaactatttttcgtgcgttttcaaacacactattagtgctttattcaccgctacaatagaagacaaaagttggtgtccaattcccggtagggatttaatagtgactttcagagatagccattttttgtcaagaactatttttcgtgcgttttcaaacacactattagtgctttattcagcgctacaatagaagacaaaagttggtgtccaattcccggtagggatttaatagtgactttcagagatagccattttttgtcaagaactatttttcgtgcgttttcaaacacactattagtgctttattcaccgctacaatagaagacaaaagttggtgtccaattcccggtagggatttaatagtgactttcagagatagccattttttgtcaataactatttttcgtgcgttttcaaacacactattagtgctttattcatcgctacaacaaaagacaaaagttggtgtccaattcccggtagggatttaatagtgactttcagagatagccattttttgtcaagaactatttttcgtgcgttttcaaacacactattagtgctttattcaccgctacaatagaagacaaaagttggtgtccaattcccggtagggatttaatagtgactttcagagatagccattttttgtcaagaactatttttcgtgcgttttcaaacacactattagtgctt

SEQ ID NO: 41418 - DNA, 859 bp, Heterodera glycines
caacaaccgtcgaatgggtccctacccttcggcacaatggccccgtttgggttttgcctgcgggtatgccatccctttcgttttgcttctctccccacagttccatcccttcgaaagttttgtgccccgtcattcgttatttggaatgcgtgttccttttcacttccatcctcacccaacttgtcgtttgcgtggaacggtcggtgatttgagctcggaacattcgccttttgatcagtttttctcctttttctctctctctgtctctcattctctccctttctctctccttttctctctctctctctctctccctttcatctgtctctcattctctccctttctctctctctctgtctctccttctctccctctttctccttctctctctctctctctctctccctttctcaatctttctgtctctcattctctcctcctttctctcaccctctccctccctctctctcattctctctctcctttctctcaccctctccctccctctctctcattctctctctctctgtcccgtcttccgttcattccgatcactttcacttcctccccccttagatttattgccattgccgttccactccatgcgcgccgtctctgttctcgcaagaacattctgctcacaatttgtgccgtttggtgcgttgtcgctttggccgccttgccatatgcgacgcataacaaaaaggcggaaaactgtaagagacggcacgcgttttgagaaggcaatccgacgattgaattgttttccgtctttcagcttttgcgtgcacaaattttcacaaggaaaagctacttttggcacttttataaatttgccgaggcccgtcccccccccccc

SEQ ID NO: 41419 - DNA, 1113 bp, Heterodera glycines
tttcccgtcagaaaattagaatttttttaatttaatattatattacatttattttttaagagtttgataatattaaacatttcttcgagcatttaatttttattaaattgggtattggacctttcggcatatattttgggcatttcaaacagttgacttattattaggcttataagttgtatgcactaaatgccaaatatgcacataaaatatgtactaaaaaccataacaatgcctaaatatgcacttaaaaatccaacaaataagctctaaaaacccgaacgatgcttaaatatgcactaaaaatcccgaaaaatgcaccaatataaaccaatgcggaccccaaattacctaaatttctaaaaattatccaccgacaagtgaaaaagcatctaaaaggccccaacctgcgttaccaaattccctgggtattcaacagaaaaattaaaattgtttgcgtaaataatttcttcaaggtttttggctcttcactggcagcactcactcatcacaaacacttgatgtttttcaaagtatttgctccgaaatttgtttttgaagctgcagattttattttttgttgtgctcttatcgtcttttgggcgattttacgggtgaaagaaccgatcaaataattttaatgtttttatttttgcaatttttaggtctcgttttgtacctatttattttagataaataaatcgaaaagctaagaaaagtaggatatgtttagaatatcatatatgaacgcggggagagtcgacattgtatattgaatagcaaaaagaatacaccgggaaacattttttataaaacgcttttactaggtcgttgcataaaaaagggcgcttttttataatggcttataaaaaattttgttgttaacataataaaatgttttatatgccgttttgttaagctaattgttgtctacaaaatagtatattgattttgttcatatctcaatttgcaaattttttatagctaaaaaaatgaacactaataaggagcacgcacataagctattacaccagcaatttaaaaaaggcgaaaaagcggcgcctgcggcgcgaaaagtgaatgaatttctcggcgcggatgtgatctctcctc

SEQ ID NO: 41420 - DNA, 1469 bp, Heterodera glycines
ttcgaaagctcttgatggggagaagctttttctaagccaatgctaagcattttgacgttatgtaaaaaagttcgaagacttaaattttcataacggtctcatgcaaaaatgggatagaaaatcgtaaaatcttatagaacattcgatgcagaatttttttctctatcgacatgcaaaatttgaagcggatttaacaagcaaaaaagttaaacaggatgaagtaaattcagtttttctctattaacagagataaagaaatagtacgccaaaaagagagatgtttttttctctgcgctctctctttattggttcatctctcgttttttgaaacggtgtgtatattaatttaaatttagtggattttgggactaaatttcggaaattttggggcttaatctgttaaacgattttgcacctaaaaaagaacgatttgctgatttttaggcaagtttatgtataaagacatatttaaattttattatttttaattataggaaattacaaaaattaattgttttaaagaatatttaaaatatatacatataaataataaaaaatttattgtgcggagatcagaggtggagtcgcggtcgcactccacccctgctgctggtggagatcgaacaatggcagaaattctgaaggtttagccacaaggctacagtaaataaattcaaataaataccgtatttatggtatttgaacccccctcaaaaggggggttctaattcaggggggggggggggggggtcaaaaaccgtaaatacggtatgtaacattgtttgaattaaattcaccaggatttaaaatttctgtgaaatgaaatgaaattaatttaaggccgtggagcggccgccaatggcgagcttgagtcgattgataaataattaggtaatacattttcaatcccggcattttcttcacttttcccttaaattcaaaagcaaaattgtgagatgctggttgaattctagggtcgggctcgtttctcgtggccgagtttttggaccataacttttttaattgttgactatatttaatatcctcgcctaatccaaaaaaaatcattatctctttattatgcttcttatacatgacataggttgggcactaaagcaactccgctgtgcttgaccactgaatttcaaataactggtaatttttatttctccggcctaatccaaaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgacaaagggtgtgcatttaagcgactcgatgtgcttgcccactgcatttcaaatagctggtaatttttatttctccggcctaatccagaaaaaatcactatctctttttttggaatattttac

SEQ ID NO: 41421 - DNA, 1145 bp, Heterodera glycines
tttttttatcaaaaagggaagatgaaataattttttaaaaaatttttaattcctttttaacaggcccaaaaagtttaggctttactttttttttcagaaactgatcagaagcgcaccaaacttttgcagggaaactccccggtaaaggactaacttacactgaaatgagcgccgagctagctgggtttaaaaattttttcaaaaatcaaagtctttcgtttttatttaattatttattattttttgcaaaattaattcataattattttttcagaaagtgctctgaaacgcaccaaattttatttacaagctattttaggcacgctgatgctttttctatcaaaaagggagatgaataaatttttaaaaatttttaattcctttttaaacaggccaaaaagtttagtcttaactttttttttcagaaactgatcagaagcgcaccaaactttgcagggaaactccccggtaaaggactaacttacactgaaatgagcgccgagctagctgggtttaaaaattttttcgaaaatcagagtctttcgtttttatttaattatttattattttttgcaaaattaattcataattattttttcagaaagtgctctgaaacgcaccaaattttatttacaagctattttaggcactctgatgctttttctatcaaaaagggagatgaataaattttaaaaaatttttaattcctctttaaacaggccaaaaagtttaggcttaactttttagtgaaaattaatttactcatttttcgagtagtgatcagaagtgcaccaggttttgcaggagcctaaaaaggtcaaggaaaggcgtctctgcgttgatttagcagtagtacctatgaatttaaatttcctatgaatttttaaaggttcacaatttatttattttttgcaaaattaattcataattattttttcagaaagtgctcttaaacgcaccaaattctatttacatgttaaataaggctctctgatgctttttctatcaaaaaggaagatgaataaaattttttaaaatttttaattcctctttaaacaggccaaaaagtttaggcttaactttttagtgaaaattaatttactcatttttcgagtagtgatcagaagtgcaccaggttttgcagg

SEQ ID NO: 41422 - DNA, 1181 bp, Heterodera glycines
aaaaaatatttaggaattaattatgcaagaaacaaataaaaacgaaagactcagattttcgaaagtttttttgaggcagctagctcgccgctcatgtgaagagtaagttagtcgctttatgaaggagtatgcctacaaagtttggtacgcttcatgctcaattagcaaaaaatatgagtgatggaatgttcagtaaaaaagttaagcaaacataataaggcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaatgttcactaaaaaagttaagc

SEQ ID NO: 41423 - DNA, 1006 bp, Heterodera glycines
cgccgatctctaattgctccacaatttgaaacatatctttatatttaaactaaaaaaatgatcaagttttcataaaagcattataattctgttttgcctcatttttagcttgctaatattatcgttttcagcttgctaatattataccttttttattaatttaaaattaattacgagtggatttatgtgtcggccaaatcgttttctgccgttaaatgtgtggcatttgggctgctcgtatttgctgatcacattcacttcacaattttccgaagtgttcaccctaattttcgtgcctttctgtcctatttttcgcaaaatggccacacccatcaaccaaaagcctcaatattcctccagaaaagcaccatttgcaatttgtgattcaaattctttgccaaatttcgataaaatcgattctcctaaatttaatacgaattatccacttaattttacctctagtttgttactatcatttgtaattatttttgcatatgaagattccattgagcttaattggattaatatctccgacaaattattgccaattcttttggaaaaataatattaatattatagtttgttcaaaattattcacttgaaatgctcagttccaattgaaaaagtcccattttgtattgagacttggatttccttttcatatttggcacaatttgtattttgcaaattagacaaatcattaagccgaaaacgccgtgccactttccaaattgaacttttatttgcaccgaataattcatcctgatagcatagaatcactctgaaaaaagtttatttagtttgattttattttatttacgcaaattaaatatatatattttttaagttaaaaagtaaatgtgttatagtaatagaaataattgcctttgacattcgccacttagcttaaattggatggttcttttgtttgtatttgccaattcaacttcacttgttttactaaattataaagaaaattcatttattttatttttttaaaaacctt

SEQ ID NO: 41424 - DNA, 1541 bp, Heterodera glycines
  misc_feature (1407)..(1407): n is a, c, g, or t
  misc_feature (1437)..(1437): n is a, c, g, or t
  misc_feature (1480)..(1480): n is a, c, g, or t
ctttttattagttatttatatttcctcaattctttgtccttcttattttcaattttttttaggatttttataattcaaaataattgttccccatggagtgtgcgttgaatatgtatgcgttcgaaatatatatgaataaaaagaatttaacaattcctatatttcttcagaaaattataaaattatatcaaatttaataaattttgtttacataaataaattttggttttttctataacctgccaactaaaagtcatttaaatcagctagaatgcagtaatattaattagatcaacgttatgaatcataatgaacagacaatcatatttatttctcatattaacttatatctttattggtttttttttaaataaaacatgaaatgctaaatttatttatttatttctcaaaaaaatttcattttgatatttctgaatttttcgtattcctaatttccatgattgcatttatttttgtatttttaacaaaaagcaactgtaaattaaaccatttgttgcactaaaaccagcgtgctaattaatattcactttacttttacaaactccaaaaggacatgtaaacaaatattgttatagcattgagcaaagttacataagtgtattgatttaaattaaaaagtatttcgtgtaatttcgaaataattttaatatattcgtgcaattttttattaatgtaattataattcattacgaattttggtttgaaatttttatatttaatttaaaaaaaaatttcttgaatttggtcgcgttttagtaaaaaaataaataaaataaattaaaatggtgaatgaatatttaagtttattttaattttatgttaataaaaattgttaaattaaaatattaatggatttttaataaattctgcttttataattatttttatctaccacggattataatgatatttctgtcttttttgtatgttttaccaaataaagaatgattataataatatttttaataatttataaattaaatatgtaatttttgatttattcgctttgctctttgtaacatttatgattagttttgacttattacttacttaattatttgttgaatttgtttcatcaaaaaatttccctttaatttaaaggtaagctaactttttaatttatttttaatataaaaagttttttcgttttagtttaatttggatatatttaattctatatattaaaattaaatattagtattttttagtgtgaaaattttttatttatgatttcaacagaaaaagagatcggtagactgtgagttttatgaatttatgtggtcttttatttaataaatttttctcaaatatttatacattatccaagagtctttcgttgacactttttaaaaaagtaaatatgtattatttcgagttcatttttanaagtattttttaatgcttttttggtgttanaatcaggaaaatacacccctaaaaatgacttgaaaattttcanaaaatacaccataagaattgaaaattttcagaaattttattttttttcttgataaaaattt

SEQ ID NO: 41425 - DNA, 1175 bp, Heterodera glycines
  misc_feature (1035)..(1035): n is a, c, g, or t
  misc_feature (1050)..(1050): n is a, c, g, or t
  misc_feature (1133)..(1133): n is a, c, g, or t
ggatcattggacctcaattagtcgataattctaacgaaatattcttgatttaaattgccagaaagagaaaactatcacctaacaaataatctgaaaattgagccaagccaaacaaatccaatcatttttctcgggtccgatcactttgcatttgattcgttcaatatttatctccaaactgatcagccaaattactgattgataaaccaggtttcatctaaaggattagacaattgattaatgggttaattcgttgatcaacaatattaatactgtcaatcatgcaaaaaatcagatcatttctcgtcgataacctctaattctttcaatttcaattaacactcaattaatgacaacatggggcagcactacagatcagtaaatttgtgctaatcacagcaattgtccaccaattttgcgtgttccatctcaatttgccattcattcccccccccccccctcagacgcgttgggcacccgcggcgttgcgccatcttcggacattgcgctgaattgtgccgtgatggccgagtactgccaggacaacacctaccgcgcgtacatgcaacgctgctgcgccaccacgtgcggcaacgcgggccaacagacgtgcgcggatcggctgggccatctgtgagaaaggcgaaataatgccaaaaatggaaacggcattttgaaataatgggaactaagtaatatgcccgtggcataatggcttaatcgcgccgatgcttcgcgggaacaaatttggggggataaaaaggcgggaaaaagtcacacgcaaattttttggtcgggaaacgttatcgcgactacgtgaaatagaaaaattttgtgcgctatcgaaagcgtacaaaagtttcgggaaaggaaatgggcctattaagattttcaagctaattacccatttaaataccataaatccaccgaaaaaattaactcattttaactttactatagaaattccccaaaagctttaattaaagcaaaattattggcgcattaattatggcacaatactgtagattccattanaaggcgatgttttanaagattcgtaagcatatgcaatttgtaagcataaaataaaagccactaattagtcgctaattgcgtgtgtttatttgccagantgtccatttggaatgcgcgggcctccttttgccaaagtcagt

SEQ ID NO: 41426 - DNA, 1628 bp, Heterodera glycines
  misc_feature (1438)..(1439): n is a, c, g, or t
gattagtggcgcttatcagttcgagaaagcattgatcagcgagaactgttcgggaaatgccaacactggcaacaattaaaagcggaaacaaatggggggttgtgggcttctcgacccgaaattgcatctttattcggaacaaaattcagcaaaaacacccatttcattagcattttttgatagcaaaacaaaagcatagtccattagttatgttaaattcactttgtctatattgaaaaatgtttcttcatatatatccatccattgatccaatttcccatcgtatttccttgtatttgttggctttaacaaagtaaaatttttcctttttttactgaaatagcaaactttgcttacgccttaacgatccgttgaaattgggcacagaaataatcttaagatggaagttaaattgtttagttccttgagttttatttgtctccttatttctttttgagaaggacatcaatgcttcattttgcagctaaaattgatttttttttttaaacaaatttttgctaaattttttaaatgtaaattagttatctaaaaggcttaaaaactgccaaaataggtaggtctgagatactaaaatcccccccccccccaacataggcacaaaaaatggaaaatatgcactaaaaagcctcaaatttagcgtataaaatggcaaaatttttgtcaaaaagcaataaaattaagccaaatcagtgttgagtctatacaatttttaaaattaaaaattattgacaaaaaaaaaataataaataaatttcaaaaacgccaaaataaattaaaataggtttttcaaaaaattttaggctttttagtagagtagagcgggaccgggtccactgcgtttcgacaatcccgatgctgcatgatgattatcagcactgtgtagactacaccccttcgacttcctccacaactgaagaaattttgccaaatttaaccagaaaaaccaaataagtacgtgatagtatgccgccccagtggagatttttcatgggggactccttggacatctcactaatgaccattttgtatccgctgaatacacttcctgacccaacggttgtggtatcgtcaccggcgacgatactctgtggcaatccgaactccacaatttatggccggcttgggatggtagcacttcatttccccagcccacaaaatttttaaaaaatctttttatatattatctgcttaattcaaaatgaacaattctgataaagacctatcaccagaagattcttagaaaatctgcacatttttttttgcttttttcttactgaataaccttgggttaattaaattattagaatttttctctgtagaaacggagcgcaaaccgatactttggcagagactgctggcaattagtgaatagcttacgtaatacattcaagcacttcatcgccatgttcacttccgnntacccctggaattggcaaaatctacgctgacgcttcgcgctcggccgaacgccgtcagtcgcctgcggtggcgccgccctggcgcgaaagaaagggcggcggaccacacagcctattgacgccaccaaaattaaccgcccaaagtctccggcatcggccgctgaacgacaaattgaaaaagggacagac

SEQ ID NO: 41427 - DNA, 638 bp, Heterodera glycines
  misc_feature (50)..(50): n is a, c, g, or t
cttgctgcttcgctatcccgcgcgaccgacacgacacatatggttcatcnggagcgcaaaagtaaaagcagcgactagcccgtttaaatcaccaattaattaattggatacagcttaaacggcaaagaagaggaagaaggagaagcaagcaagctatgtgtgctcgaaaatgtacaaattggtagcggtgaaagcgcatataaattttttgaaaatcgtgacaagaggccgaaaagcaaaaaaaaaaaaggtcgtcgctcggaggggggggggggggggggctagcaaagggtctgaggttaccccttgttatacatatgtcattgagataggttcactgaaagccgaacaatttttatacaaaaaaaaattgaatcaatatttaaaaaatttaaaatgaaaatttccccgataatttgctgctatccataggtttggaggcatttgttttgatttgaacaaagggtttaagccaacttacaatttttacagttttacgtaaacaaagcatttttcttaaacgttaaaattttttttaaaaccgactaccccaccctcgaaaacatttgtcgggggggggggaggggggagaggtgtgcagcaacaccaccattcatctgtccgcctgctgcaattga

SEQ ID NO: 41428 - DNA, 1322 bp, Heterodera glycines
  misc_feature (1311)..(1311): n is a, c, g, or t
agcatgctcttaccgcttctgatgctcggctggcaaatgctttcgcagtcgcttttggtcaggaaattgttgccactgccaccgcaacctgacaaaattacaaaataagtgagtgagtgatcgacataagcggggtaattaaactgattactctaagtggaaataattaatctctttgcgcctaagtggagaggggagtaattagcttatttcagctggttaattaagcatttcaataccgtaatattggaatggttcgcactgcgatttttccgggttgtagctccatcggtttatctttgatgctttttattggcctttcgtctcattttcaaccaaccgtaacgaatccaccaaagcaggcattgccagcagaaacgggctcctttttcaaaagaatttcagtttaaaaagtgccaatttggatttgttttcattcacccggcacacttcctccggatttgaacagcacacgaaattggacccaaaacggggctgagagcagccgtactgagatgggcacgagtcatgcgcatttgacagggcatcccccggtacacacgtggccaatgcgggcccggcacgaaggccaatgccaccctgggggcattgggctaaaaggagggagcacaatggacgaaatgccagaaagggaaattaacttactctcaaagcaaaagccttcgcattgctccaacgaatcgaaattatttgcgttgccaccgcattgcgaaaactgagaaaaacaatttaatattgaagatgcttagctctaaaaatgtacctgaaatgaacggcaagagccggttgagccgtcgaagtaaaagcgcgaaagtgccggcactccgcgcgcttggcagggaattcccgggtcctttggcagtccgcaaacgtggtctgaaatcggagggaaaatcaaacaaacggacagatcttctgataattcaggggctaaaatcgcaaattgagtgatcagccgaacagtgccaaactttgactgacctggcgatgggcagcagtactggtgcccattgttcgtcacgcattggaaattgttagggcacgggtttccccgctcgtttgagcactgagtgatgccgcccagcggactccccgccgggcacacgcctttgctggggcagcaacgcccctggcgacatccgtagcccgtaggacataaaaagcaaagcgaactcgtcaattaattaactaattaatcaatcgcatttggcatcgaaaactcacatggatcggatgctgagcacggatttggctgcatcaaaggagcttcgccgccacaaacgtctgaanagaaagctttt

SEQ ID NO: 41429 - DNA, 1398 bp, Heterodera glycines
taagtaaaaatggtcattttagaggtaggtatttttgatggctgatttaaagaaaaataaaagagatacagagccagagaaatagtgattaaatagagcaaagttaggactataagaacacaaaaacataaaattttaattacaaaaattgaattattggagagccgagactgaaagtggtctccaaaaacggcatttttcaagaccaccaagtaacataatgttttaaaagtggttttggaaattctgaatttaattaaacaaggtaaatcgggtatgttgagtttgaatatggtcttagatttggtctctgggatcgcaacaaacctatacagctcgaaattcatgcatggagttggtgaagtacaagctcaggttgaaaagataggtcccatttaaggccatattcggattctactggtctaaattgtatagaaaaactaagattttgttatatcagctttggtttttgaccataaaaaattcgagaaaaattagtgggccaattttcaattttggcatggtcgggaaaaaaggcagaaaaatctatcaatcaaataaaaagttaaacgatagtaagatattaaagaggacaccatgaagaacaaaataaaaaaagaatcatttaaataggcgcagaaataacggagttatgaatttttaaaaattggaaaaaatttgggtatcaaaaattatgttccaccctaagtattttaatttttatttgttgtagaaataatttcattttaaattttttaatatactaaatatttataaactgaaataagcttaaaatgttgaataagcataaaaaataatacagaaaaagcaattacttcacctgattcaaaccttaaattctgtaattcctttgctttttatcttggatgggaccccagggaaagggtcgttttggcacccaaattttacggatccctaaaggtccggtatttaaatgcgggtctccaaatgtcgcgccatttttgaaaatctgctcataaatttgagcttcttttttttcgttgccgagtttcgtaatcgaagttgaagagaagaattggagaaatttttattaaatttgtaaaattattaacaaatatcattcattaggtcaaattaattttctccgtctcccaaaatcaaaaatgaacagttttgggataaaattttctcgtaaaatcggccaatattggcgctccccgctcccagagaattcttccccgaggtgttgaggtgctacctacgctagatcaacctcaactgaataaatatttaataaataattgaatatctttaataaagttacttttacgaatattttcaaaaaaatttccctagcagtgaattggtaaagcatcgatttttttagaatattcctactgatgattataattgttg

SEQ ID NO: 41430 - DNA, 1355 bp, Heterodera glycines
  misc_feature (1239)..(1256): n is a, c, g, or t
ttattaatttatttatttatcgagcaaaccaaaggcacatgagtgctcttatatggtgccaaaaagaaaacaacaaataaagttggtcaaataaaaaatacaaaatgaataccgtaataaaaaaaatgaataaaaataaatcaatcaaatgttaaaaattcacaggtgataaaaatatagtgtaaatatggcaacatggaaaatcctactcagaactcattgcttttagtaaacccctgaattcctttgccttattaatttgcaccgctaccactggaaggttattccagtttcttactatcctatggaaaaaattattttgagttttgtgcgtgtggcgctttactcgcaaaagtaaaggcctcctgggcctttctgagaaaaagaaattttgctcagcctctaggctggtgaacccttttataattttaaaagctgttgttaaatcattgatttttcttctttcttctaatttgtgtaaatcagtgatttttagtctttccatatattttttgtacacaaatccacattttcgaaaagcttttcttgtgaaaaatttttgtacccgttcaattttgtctatatctttttttaaatttgggttccacacttcggtagcgtattctaattgaggtcggacaaaagttttacaagctgttgttagagtctttatttccctggtttttaagactcttaaaatctggaaaactctaagataagcgtttcgtacaattttgttaatatgttctgaaaaatgcagtttcgagtcaattataatgcctaggtcacgaacattatccgattctgaaatcttttttgagttaattaaataatcttttttcatattatttttccctaaataaagaacaaaacatttcccagttgaaatttctaacccatttatttttgaccatttttccttatcttcagctgtctattgctttatctaaatgatttgttttatcatcattttcatgggcataatataatttaacatcatcggcatacatttttatgccaactgatgatgcttcatttgcaaaaggacggcgatcttttaattataaaattaaaagaggagtggccgcctaagacacttccctggggcactcccgaaaatatgctgaaacttttttcaaatccctctcatttacttccttaattaaatacctttttttaaaagtaataaattataattttccttattcatctttgttttgaaaataaacaatggaaggnnnnnnnnnnnnnnnnnnaactgaatcaaacgccttgacaaaatcaatatagataatgtcaatttgttgattcttttgtatagaattatatatatcgtccatcgtttttaatatttg

SEQ ID NO: 41431 - DNA, 1158 bp, Heterodera glycines
  misc_feature (1145)..(1146): n is a, c, g, or t
atgtcgggccgcaaatgtcgggacacgttcccatccaaaattttaaattttttggcttcaaattctaaattttttctttaaatttaattataaaaatctgtttttttgaaaatcttttacataaaaaaatcgcatgacggtagcgataacggttggggatagtgatgaacccacttgaacaccctttgattcacgtaaaaaattggcaattgaaaattgggcctttgattttttgtgccaaaaaatgtttgtttgtttttaaatgtgccttttcacagaacaccattcgtcgtcctgcttcaacttctgctgtccctcctgtgccgctgaagatggaggaggacgaacgacggggcgaagtcggcacagacacacgacgacgacgacacgacggagggcacagcggaggaaagaagaaaggcacggatcggtcgcccacttcccgggcaaatgttttggacatggagcagctgcaggacgggggcaatcaggtgcagtttgttttttgttcgttcctttcatttaattcttcgtggaataatttgttttttcacttaatcataagtggacaggggggggggtcaattgcgtaaacagtacgagggtccgagcaatttgtaaaatttttaactaaaatcgaaaaagcacggtaaatatgggaaaattttacgaaattggaaaaaaagtcaaaagtttgtgcaaaattttttacgattttgaattgcattagttctatttcatcttttaaaaatttccatcgattttgcgtttaaaaattttacctgcttttttttcttcctcattttgcagcagcagcagcagtcgatgaacaacacgcaaatgcgcggtggtggcattgcgcagcagcaagcggctggcaatcactcgcagcaaatgctcgcctcgggcagcggcactggactgccacaggacccggagaagccgcagcagcaaccgttcaaacttaagtgagtctggtagttgggaaaatttttgaagatttgagtaaaattttaacaaatttttatcaaaaaagacaacctttcaatttttgatagtatttttcgagaataaataaggattttaggcgccaccgaagataaattttcgaatttatagcaatttgtttagacaaatttgttcanntagtttagattt

SEQ ID NO: 41432 - DNA, 1000 bp, Heterodera glycines
tccattaaaatacctatttgagtcattttttattggttttacatctttgtaaattcgcatgccaaaccttgtgatacgcggccatcaccaactcaaacggatgtttgtacacgcggaccggactttgataagtttggaccatgttttgacaataaaacgaaaaaaggagaagttcaaaaacaaaaaggaagcgaagttatgaagaaaatttacaacagaaaaaaacggaatttataaatctgattgaaaaatgatgaattaatgtttgtggatttgcaaaagcgcggtttttggaaaaatctggattgaccggtgttctggattaccggattttgagagatcggacccggaaaccggtgatttttgaaaatgccaatccggtccggtccggcgagtttttgaccggttctttccggattatgaccaagccaaaatccttcacttttgttaatcttcctttgaaatatctctttggcataatgttttaattttttttttttgataaaatccttttatcaattaaaaaattttctccggcggtgcctatcgaaggtgcacttcgtcccttccaaaaatctttaaaatttttcaatttttaattcttgaaattttgtttaaaaattttcttttttttgaaaaatttaaattctctgattactcgttgtttgtctaattctctctcaatcgtaaagtgtttttctgttttacatttttatgcatgttacaactcagtaatggattctcgcatgatttcaattgaataattatttaattatgtggcattattattcgatttttcacactcgccgcctcatcgccatttttccgtcatttcacattttaatgtccaaaataaaaaatattttttcaatttttgtagtgaatagatttgccaatttttacctaaggcataaggctaaaaagaaaatcttcgacctctaaaatttcgataaattaaaaaatatgttccatgacggatttgaatttacaaaatattttc

SEQ ID NO: 41433 - DNA, 1158 bp, Heterodera glycines
acaccctctgatcagcgatcactttagctttctcgtccctacatgcagaattggcataaaattggcggtggttggatactgaataccgaatgggtttgaaaaagtggtgcttataattcctttttaattgactgcgccaaaatagtcagttaccaatcaaattgaaccgaacgcaaaattggattggcatttttaaaaatcattttaaatacccaaattttcaaattcacaatttgcgcacaaaaaattcgtattttccggtcaaatgatggtcaagccgcgtacatgaacattataccaacggagcaagtgaatttttaaaatttaaatggcattttaaaattaaatattttataaccgtgaaattttgggagtaaattcgcggaatcgccagggaccctttggtgattttccaaagcttttagtttcgtggggacccctccaaaatcccatgcctattgaaggggtgtaatatccttttgaagttgccgccccggatattttaggtgcggcgcttgattaaatcctatgaatgggatttctgtccaaactatacaatattgagttaaacttttgccccctcccttccgccggcgttccgtcggccgcctcgcggcggtaattaatcatcatttgtcagcctaatgatgcaaaatttaaaatcgatttaaaatgcatttccagattaatgtgcaaaattttacctttgttgtgacagaatttgattttactttcgtacgttttgtttatggtagtcgtacagtaacgaatgtattgccaggctttacagtaaattttatcgaattaattcgaaataaaaatgaatataaaaaaacaaaaccaattaaggtttttccatcctttaaaatatttaaatttacatttgatgttaaaattgtggccaaccaaattgatgaaggaacaaaatattttttcaatttgtgttgcgctgaccgtgaaacgaacaattattatttcgaaacaaatttgggccaaaatgagggacagattgaatttttggacaacatttgtaaatccaataattacagaattggtttggtggtcacccaaaggaccgcagattcaaccatttttttaattaggtaaaattttgcaaaattttcgttcgaaatttttattaaaatatatttaaatttt

SEQ ID NO: 41434 - DNA, 1015 bp, Heterodera glycines
  misc_feature (890)..(890): n is a, c, g, or t
  misc_feature (984)..(984): n is a, c, g, or t
  misc_feature (993)..(993): n is a, c, g, or t
acggtatcaaattgccgactgaaggagaccatcccatttcgagagtaggaatgagaccaattccattaaacgcagtgttaattaaggattggcgttactaccaaaagttggaggaggagccggactttgacaaaccaaactacccgaagaaatggaacgaaatggccaaggcggccaaagaagccaaagatcagctgaaaatggcaaacaatggcaccaacgaaaacaacaaaaatggcggaacaaatggcaacggtgccgccaatggaaatgccaaaaatggaagtggggcgaccgaatgaataacggacgattcgcaagtgacaggcggaaattagggaccaatgcttttctgtttgttctgataaatgttttatagcaacatttctctgtattctccttttgtccaatgagttgttctctctgtgaatgatttatttttgttaattatgagcattttatatttttctctataagaaaaagggcatcgagcaatgatcatcaaagaatagtgagtttattatgacgactttaatttatcctttcttttcagtcggctcgttttacctatgaccgtcgatgagtatcaaatcggtcaactgttttccgtggccgaagcatcgcgacaggttggcacttaagcagacgaggagtgtgaacaatttatacgacttttaaggagacgggcggcggagaaggtgttcaggtgttgcgcaacgaaccttttgaaggggagagtctgttcaatggccagttctcttccggacaatatacgcataaaatttaccatttcgattcgtgagtttgggggaaggggaagtggcaaaatgtacggcaactaatccagcgttttcaagaaaagtgccgtctcttctgagagcgattatgcncaaggagttcgatgtcggtccatgaacacgcgtggaatgcgtatccgtactgtaaaaccgagctgaccaacccggacttcatgaaggacagctntttcattcngatgaaactattcatctgaacg

SEQ ID NO: 41435 - DNA, 1072 bp, Heterodera glycines
aaaaagggggtttgcaagtttattggggaaaaaagactttacaaaatatacccctgggagaagggagtgggaaccatgatttcaaaattttctattttttctagtctaatctactcacaacggttcagaattcaataaaaataacattcacggtgcgaaaaatggggtttgacaagtttattggggaaaaaaagactttacaaataatacccctgggagaagggagtgggaaacatgatttcaaaattttcaattttttctagtctaatctactcaaaacggttcagaattcaataaaaataacattcacggtgcgaaaaaaggggtatgaaaagtttattggggaaaaaaagactttacaaaataatacccctgggagaagggagtgggaaacatgatttaaaaattttcaattttttctagtctaatctactcaaaacggctcagaattcaataaaaataacattcacggtgcgaaaaatggggattgacaagtttattggggaaaaaagactttacaaaataataccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacgttgcgaaaaatggggtttgaaaagtttattttgaaaaaaagactacaaaataatacccctgggagaagggagtggggaaacatgatatcaaaaattttcattttttctagtctaatctactcaaa

SEQ ID NO: 41436 - DNA, 1023 bp, Heterodera glycines
tccccccccctttttttacccatttccttttttccttctcctgtcggtcatttccctcgtgtcccagcatttgcgcccatttttgcgcttatcgacacaaaaagaattcaaaatacatattattttccactcaaattatcattaaaaaatactgcgcaaagccaaccgaaaagagagctgaacaattctaattggcacttcgatttcctaaaaggacctcactcggcaacttatctgccgactttttccggcgaaacttgagaaagtaaaagctggcactgaccgtgccaaaattagggaccaatctgaagcggctctttcccaatgcttaatccgtgctcggcttgacttgctcccaaaatgcttttgctcgtttgtctcttggctgactttgccctttttgagatgtccgtcgacacaatggcaatcactgcgcttccgctcgactgttggcttaaggaacggctcaaaaattgggtccaattgtccgggcacgaaggtttggaggcccaacaccgccggacgctctcacagttcaggaacgattgtgcccgcctcaaatcacacgctttggaagaagcagccgaggggaaatcgggcagaggcccatgcttatgaagaaataatgagaggtggggacaaaagccgaacgatcgaattggcattcgaactcatttcagactcggaattgtgcggaatcactcccaaattttacaaggaaatcgctcacaacaacgaaagtcagtgggtcgccccatttgaccttttttctttctccgcttttcccacgccttttctcccttaagcattcatcgaaatccaagatttgctggcacaattcccaaacacaaaaagtcgtgccattatggacatcaaaattggcacacgcacatttatggagtcggaagtgagcaacgacacaaagcgagtggacttataccaaaagatggcaacattgtcaccccgacgaccccgacgagaaggaaaggccggaggggcaagtgaccaaattgcgctacatgc

SEQ ID NO: 41437 - DNA, 1009 bp, Heterodera glycines
  misc_feature (100)..(100): n is a, c, g, or t
  misc_feature (105)..(105): n is a, c, g, or t
  misc_feature (156)..(156): n is a, c, g, or t
  misc_feature (992)..(992): n is a, c, g, or t
gagagaaagggaaatgaaatgaccaaagaaagagaagagagagaaaaggaagaaagagagaagggaaaatgaaatgaccaaaagaagagaagagagaganaaggnaagaaagagagaaagggaaatgaaatgaccaaaagaagagaagagagaganatctcaaaaaaataaataaaaattagctatcggagtttctttatttccccttacctccgaaaaccatttggagaagagactgtgactattcacttccaccaaaatcgcccttttataccgttttttgcgtccgaatggccaatttttgtgccaatgccttgcaaagtgtcgttttgccagtgcccggaggacctttacaagcggaacattttgtgccaacaaaaagcaactgtttaccgtggaggaggacgagtcggttgacaggcaaaatggataaatcggcaccggcataggaaatttcaagcagagaaccctccaattttggtaaaactgtggcagagtccgaatacaaacagcgaacactttcagtcaaaatggaagcgatgtttctgcaaaaaaaggggggggggtcgaacgaaccgacggacgaacggaccttccaaagtaaattttggccatttcgattcgcttttcctcgtccatttccaaactttggccccaaaaattgtgcccattcgtagcagaaaaatgtcctcgtcaatttggttaagcaaaacaaacaaaaaaggggccaaagtgtgcgcaatttgcaggcgaaattggctatttttggcaaaatacggcggaggagcggcgaatttgtcgaacaaattttggacggaatggaaaaattcatcaacaggcataaaacaaagaatgaattattaagaggtatgaatatgtataacaaaattcaccggaaaacggtgggagaacaaacgccaaacagaaaagtgaacagaaacatttccgggtccaatcggccgaattcgacgcattcattggcaaagaattgncgaaagagtgccaatgg

SEQ ID NO: 41438 - DNA, 886 bp, Heterodera glycines
  misc_feature (852)..(852): n is a, c, g, or t
atggatagctttaaatctgcaagaaattatattggcaataagtggttgtaaaaaacttttagggtaatgaattattttttgaagttagtcaaacaccgtattagtgctttgctgtgccgagaaccggcaggcaatggatggctttaaatctgcaagaaattaaattggcaataagtggttgtaaaaaacttgtgtaaggaattattttttgaagtgaatcaaacaccctatagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtatagaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatagctttaaatctgcaagaaattagattggcaatatgtggttgtaaaaaacttttgggtaatgaattattttttgaagtgagtcaaacaccgtattagtgctttgctgtgccgagaaccggcaggcaatggatagctctaaatctgcaagaaattagattggcaataagtggttgtaaaaaacttttgngtaatgaattattttttgaagtgagtcaaacacc

SEQ ID NO: 41439 - DNA, 981 bp, Heterodera glycines
taaagaaaaattacaacagaaaacatatgacgaaatatttggagaaaaatgggaagaaaaagaagaagaaaggcgaaatgaactcaaaaaaagagaaataattcaaaaatattataaaataaaagagaaaattaagcaaaaaggaagaaaatattcaacaaaagaatggaataaaattgaacaaaaaatagcgaaaaaattgggaacaaacaattgttatattaaaaaatggattaaagaatttggtcttcaaaaacaaataaagaaaagctacaaatcaaaaactgatgaagaaaaacgtcaaattattcaaaaattcattgaaatgacaaatgaatttaaacaaaaaggaaaatattctttaaaagaatggaacaaaaattatgccgaaatttgtaagaaaattggagtaagcaaagggacaattatcaaatggaaaaaacagtttggcattagtcttaagagaataacggaaaaagaaaaaatggcaaaaatgaaaatttattggcaaataaaaagagaaaatccaaaaataagtgagcagaaaattgccaaaatgaccaacactcggcgaagaacttttggaaatggaaagccaaatttggagaagcgaaataatgaggaagaaatgaaagccaaaaaagaggacaaagaaattctcgaaattctcgaaaattcggaaaattatattttatgtgacttttgtttttgttcattaacagggctgcaaaaaatatgcaaatgcataaaaaacactttctttttttttgtgtttgcgtataaaagtcgggacttttatttgcatattttggctttatctgcatatttcatgcatattttgccatttttcgtcaaatattttccgattttttgcatattttgccatttttcgtcaaatattttccaattttttgcatattttgccatttttcgtcaaatattttccgattcgaatatctcaattttttaaatattttgaac

SEQ ID NO: 41440 - DNA, 932 bp, Heterodera glycines
actcgaactcccattcataagatgaaatgattaaactcgaactcccattcataattgcggcgcgcttttttggaaaaaaacgcaagagaaaaattctcacaagtcgcgtttaatcggtcgcaaaaattttgtcgtttctcttgcgcgctttttcttatattttttctccttctctttttttctcgaccccaccaccgtttcgtgcgaccgacgcccgcctgcaatcggcgacataaccccacccctgaatcccccccccccccctacacagatctgtaaaatagaatgggcataaaaggcgcctcttaagttaccagattcttttctgataaaattcctcgcacgtttttcgctctgccctttctcagattcagcatccgtttctctcatcccatcgaaggacaaatcagctctaaaatgaagttgaataaaaaaaacaaagcactaaaataaaatgatttgagaaattagggaaaaagtcgagttcgtactttcgcttccgtgttttcggcttttccgtaggaggggtggcggcgacttgcattcgtggcatccgctgctgttttgtggaaatgtctgtcgcttctgccggtccagccacgggctttatgacctgttttgcatctgaattggaaattattcaagttaaaaaagcgaaatgtaaataccaatgccattttcccgacccttcgctataatcggaatgccattttctatgctttccattcgccgaatcggaattgtgtgttctttaaattcttcgggtccggacttggtcaataaacatttttcgtttgcttccgcgtatttggccacacgcgttctcagtccaatggattcgaattgtggcaatggcctcaagtttaccctagcttcggattccccaaacagttcttttgatttgtccaaagaaatgtacaacgaagtgaatg

SEQ ID NO: 41441 - DNA, 1078 bp, Heterodera glycines
  misc_feature (1065)..(1065): n is a, c, g, or t
tgcgatgtgtgacagaatcttccgttttgtggttggactgctgaaggttggcattttgaagatcagctgatcgtgtcttggtttccattcgatgcctaacatctttgtgttttcgaggtcttgggccaattcggatgagtcaagagctcttttagcccgtcgatgtgactcccgaaaaattcgcggatccgcattccggctgattcaaaaatgatttttgcttctgtgaccagttgattgctgttttcacttggtttgacttccaccatgatgttgtccacataaagattgtcactgatgcgttgtgcaacatccgtgtcgtgaagtgccaggtgctccctgatcgtggcattgagtagaaatggtgacacggttaatccgaaactgactcggcagaatcggaaaacgcggaagtcttctcgtttcagctgttcgagatttgcttcctttgggttagcaagccaaaggaatcgtgtggcatcgcgatcttgttctctgacgcccaattgtaggaatgccttttcaatgtcagcaaggatgactttttccatgcgtctgaaccgaaggagaatgccggtcaggtctttcaaaagtagcgggcctgtgtgcaggcattcgttgagtgatggtgccgacggagtggatttgggttttgcagaggcatccatcacgatgcggattttggttgtggatttgtcggttcggatgactgccctgtgtggcaggtagtggactggaccacaagaatgatcagaattgaccagttcgatgatggaattctgctgttgttcatccagaattgcttggtattcgtcgaccaagtttattgtccgaagctttctgatgaggcttatgagccttgcctttgcttgatggtaattcgttggcaattgtgccactctgtcgttccatggcaatgcgatttggtatttgttgttgacgaacgacaagttttccttgaaatttttcatcacttcatcccggtcgattagcgttgaagagtcgtccatgccaatgatgttgaggccgtagaactagttgagttcttcgttggccttcaagtgnttcttccgttgtg

SEQ ID NO: 41442 - DNA, 917 bp, Heterodera glycines
acgttcgtcagatggccgatcccacttcggcggtaaacatcaatatggggacgttagtcggttcttacgccagtgtcgcgcgcatgttagatgaagtcgcaagcgtgcctggtgccgaaggcgtgctgttaaccttcgacgattttctgtcgggaatcgaaaccttcggcgagcgcattcaaccactgatgcaatgccgcgcccatctacctgcgctgactcaggaggtggcatgatgacgaccttaaccgctcgaccggaagccattaccttcgatccgcagcaaagtgcgctgatcgtggtggatatgcaaaacgcttatgccacgccaggcggctacttagatctcgccgggtttgatgtctcaaccactcgcccggtcattgccaacattcaaaccgccgtgaccgcagcgcgagcggcagggatgctgatcatctggtttcaaaatggctgggatgaacagtatgtcgaggctggcggacccggctcaccgaattttcataaatcgaacgccctgaaaaccatgcgtaagcagccgcagctgcaggggaaattgctggcgaaaggctcctgggattatcaactggtggatgaactggtgccgcagcctggcgatattgtgctgccgaagccgcgctacagcggtttcttcaatacgccgctggacagcattttgcgcagccgcggaatacgccatctggttttcaccggcatcgctaccaacgtctgcgtcgaatcgacgctacgcgacggcttttttctggagtatttcggcgtggtgcttgaagacgcaactcaccaggcggggccgaaatttgcgcagaaagccgcgttgttcaatatcgaaaccttttttggctgggtcagcgacgtcgaaacattctgcgacgcgctttctccccacgtcctttgct

SEQ ID NO: 41443 - DNA, 697 bp, Heterodera glycines
cttcagacaaacaaattaccaattaaagccatagaatattctctcagaccaaaagtttgcagtcggaacaattttccaagctcatagggcaacactcgaagttggttggagttcaagtaaaggtggcacaacgaaatctaaaaatgtttatgtgtttgaaaatggataacccgcaattggtaatccttacaaattatggttccagtggaaaataaaatgatgtttttttctggatttaaaaaatgctattcgcagttctgattgtgagcttaacattaaatttcgaaatattttagaatttctcttcgggatcgaaattgtaaaagattgccaacaatttattgaacactaaccatgtcaccaatttcggatggcaaactgcgcaatttgttgtgcgataagtccagtagtgataaattggaaagttttgctatttcgggaggtattcgctgcaacaaattgttgcccaagtagagcgcagtcaaatgacgcaaatcgaaaattcctggcgcaatattctttatcatacctaaaaaacacaagaaaattcaagttattatttgttggacaaaccgtgcacttccaactcgttccagcgagtcttacaaccgcgactttgttcttcgtcggtcagaattcggtggattcgtgcgagtccgtttgatatcacctgtgatatgcaaaagagttgtcttct

SEQ ID NO: 41444 - DNA, 861 bp, Heterodera glycines
tttatgaaaatgcaatgcgctacttgtcttttttaacaaactttgcaggtttcgtatttcgtattcaattatagtattgctttcgatattttattaaagattcacactaaagaaataaaacatgtattttgatcaaaaaattgtttaattatttaaattattattttttaaatttatttcatgctaagtcgatttttttttaattatatcgatttgacctgcagtcggttcttcaacagatgctcagaactgtgattgggcgccggacttttcaacagaggacttttcgacagcaagaaaattcgacagaaatattttaaattttaggagtgggctttcgacagtaaagaataagaacactgggagtttaggaaaacataggtaacaaagctaaaaaaacgtatccctagtaatattgatttagcaatacatatttatgtaaattaaactaaatttagtaaaactaataaacaatataatttattttaataagaaaaattgtttttattcttcgaaatttccgatgtcgaaaagtctaggagcccctgtatatatatatatatatatatttcaatcaaagttgtaaagattagtttacttgggattgtatttagcccttctcacgtctaattatttacttaaatttagaaatgaaattcaaaaatgaatatggggaggttttgtaaaaaattatttttatctttcgtataaatctaacaaagaagcggaagattttccactgcaatgatttatgttgaataaacctataattgtttttatataattattatttaacatagatttagtaaaaattagtaaactatttaattgaaaattggatttcagctagtcttaaaagta

SEQ ID NO: 41445 - DNA, 945 bp, Heterodera glycines
  misc_feature (8)..(8): n is a, c, g, or t
  misc_feature (32)..(32): n is a, c, g, or t
  misc_feature (54)..(54): n is a, c, g, or t
  misc_feature (66)..(66): n is a, c, g, or t
  misc_feature (75)..(76): n is a, c, g, or t
gatttttnaataatttttttccgttgcgattntcgcctttaaaatcgctttttntaatttattctnttattgtgnnaagtgttcttttgcacgaacgcaaactgtgcttataaaaaaagtccgggctgtactttttattgaaaaattccttaataacaaatatttgagaatttttgcaaaaatgacatttattttactaaatctaacctaaaatcaacaaaattgaatatggacgaaatataaacaaaaattttcaatgattatgccaaacactcctcgcgtcattcagagttcgaaaaaaaatgattaagaaacgaaaattataaaattaaattcaaaaaaggaattaatcccccgaaatctcgaaaaatatttctatgattagagtttataaagattaattggattggtttagggtgatttgggggaatgttttcaatcattcattgatttttgctttttcaattcaaaattggaaatccttctccgcttttcgtcgtttgttttgttcattaagaaaagggctccgcggtcggccgaaggaaaagcaaagcgaagttttatcgttcgtttcggcaaataatttaattttgagcagtgaaagtgccgcagcgaaaggcattttgttgagcattggcaaattccaagtgcttttcaccttaaattgtctgaaagccaaactttcattggctttttatttcattccttcgaatttttcgctgatcgctttgccgtccctttgctttttaaattccgcccattcgcagaaacattccgtcatcgctcttttgtgtaaatttgcgtcaaatatttcacacctctcggcttacccattcattgactgactatttatgttctcgtcgagagaatgaaaggatcaatgaatttaccctcgaggagaacgcgaaaatgggcggggaggggggggggggaagggggagagca

SEQ ID NO: 41446 - DNA, 924 bp, Heterodera glycines
tcccgtcagtatttctttacttataccccaaattgcttacttcactgatttgttgcgtcccattttggttccaatgccaacggacaatttgtgccaatggctccaaatccgacggattggaagaagcattgccaatgtccgcgatttccaatgcttggttaaagtcggttgtcacactcgtgaactcactaaaaatgggtttataaatgaaaattaaaaaatgaaattacagttcaacaaattcgatcatttcccaatgtgaagattttccagtaatcgcgaatttaccgattgctttttcgccaataataataaattcgtcaaagatttccattgtatttgtgtttatcagtcgaattttttaatttaatttagaaaacaaattttctggtgtcgttgcgtcataatgtcgccgcgtcgaaatgtcgccgcgtcataatgtcgccgcgtcgaaatgtcgcccaagctaaaatgagtcaaaatgtcgccaagccgaaaattagtgaaaaagtcagaaaattacatttttaaggctgcacaacacataattcactaactatttatcagaatagcataattaaataactaagataataaaatttgcaggaaaaaataggtatttcaaaaagtgaataaaaaaatattgggatgaattctaagcgatattcatgattgaatcttccgggttttcgtagttattcaattttcctgcgtattcttcgacctgcagaccaagagccgtcataaaatcatgaatttcggcataattgttgtatgttgcatccgtcaaaattctcatcagaatgatgacaaagacccttataaaattgaatttttctgggggtttcataagtgaaaaaatacagagaaatggaggtgcgttgcttcgagtcaattgttggtcctcgcgagcgcagtaaacgc

SEQ ID NO: 41447 - DNA, 1001 bp, Heterodera glycines
tcgttttggcgccgacgttttggcgccgacgttttggcgccgacgttttggcgccgacgttttggcgccgacgttttggcgccgacgttttggcgccagggtcgttttggcgccgacgttttggcgccgacgttttggcgccaagccataataaaaaaaagaaaaacacccaaattaaaaattttgtaaaacaacaaaaaaaacgtatttttcgcgaaggtaatactgccgatgtttggttgccctccttttttgaagaaaatttttttgttttcaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgtttctaaaatagattaaaacaaccgaaaacgttttggagccaacgatatgacaacatgaatattggaataaatgatgataccttaataatttatctgacaaacaaaatatcataaacgaatttaattcatcatttactctctaacgatttggctaatattctcttaatattgtactaaggatacgaatcattttgatgataggaaatacactaaaactaatttaacgcatgaatgcttaataatcctattgtcgtgatctacagaaataatgcttcaattacatttgattgatcattgtcagcgctaatgattctacacttaatttataagtaaggtgagcaattacgacatttttatatcgagaatcgataaacatggtatatttttaaaaaatcttacattatattaaatttaatttaatttttgacgatttttactgaatttccttttcaccttaacactttcccacttttgccagctgatggcgccccatcgggacaaaagcagagaaacttttgcccgctcttccgttatcatttttagcggtttccctgtaaagctgccaggaaatctccttcccttcttctg

SEQ ID NO: 41448 - DNA, 941 bp, Heterodera glycines
ttgggggaatcatcggaatacccatccatttctgttgagatttcccctcattttcatagttttcttattggtgggattttttcaagtgtttttggccattttcccacaacaaatgcttcctccgtaatgcgatgattaattgcattgcgttgccttatacttccgtgtccatccatcttcgttcgatgtcttccgaccagtaaaagtcccccctcgtctcccatcatcagtcattcaatttgtcaattgctcccccccccccctatcgcatcaatcggcgcatgccttgggcaggcgatcgccgcgcgtctcatcccccgggggacccttcgggcgatagtcgcgcgaattgagaagatcgcgtcgggtgataagcgaaggtcccccccccccgcgcccgcttctgtttagatgggcgcctcgcccataaatcaatcggtccgaccaatattcaactattccccagtttttgtcgccgagaggcaatttgtcatccctaaaatgacaaatgggaaacggaaggtgttgaaaaagcgaccggcagaagaggggggaaacccgggaaacggtaggcaaaaagcaaagggcaaaaggggacaaagagaggccgacggcactaggcaattacgaagcactccctttgaagacgacgagcagaagccgccggccgacccggcgacgatcgtccaacaagcgccactgcctcacagcagcaccggcacggacgaggaggctcggatgcgactgaagcgcaaattgcagcgcaaccgcacgtcattcactcaggaacagatcgaaagtttggagaaaggtgggcgaaaagacacacaatcattaattaattggtcaattaacaattaattgatcaattaattagtaaagccgcaattcttaggcacaaaaatcgcgaaaaaggaatgaattattgaataaaaattcat

SEQ ID NO: 41449 - DNA, 1097 bp, Heterodera glycines
tttccctcaaaatcctggtcacccccctttggtccctaatctcaaaatcacttttatttttataacaattcgcaaaaaagtgataaaaatgccaaataaaatttatttaatagagcaaaaaattgcggattttttaagtatttaaaatttcaaaaacacctttacagaaccgagttctgaatttttttctgaaaaatcgaaaatttccagaatttctggaataactttttttgtttttgtgctataaatttcaaataaatctcataaaattttcccgattttttgctatttttaaagctttaattcgccaaaatagacctgatctgaactgagttatgaattttcaaatattaggccaaaatcccgagggccaaaaaattgccaaatattttcgaatttttaaaaaattccaaaaattctgaaacttaaaatagacatcatattcgtactcagcaccttattttaccccaggaaaatatttttcacccccattttcgtccgaaaaaaaatttccgaaaatttctagggggcctagctcgaaaatttttgaaaattttacatcatgtagtacaccgttcgatagagcttaaaaagctctacaattttgctcaaaggcattttttggctaaaaccaacccctaacgagttatggacccgggactcaaatgtcccgctcaggccaaaaaatttttctatttccgggaaaaaatcgaaatttttccgaaaaaaataccagtcgatagagctcgaaaaactatgttttggaagtggtctccgtttttctgggaaaattcgttaaaaaatcctaaaattcaaaaacccaaaaaccgttttttaggcctagctcgaaaaattttgaaaattttcgaaattttaaaatctgaaaaaatcgagcttattgaactctacaataagtctgctggccaccctgcgctcaggtcaaaccctaatgagttattcgcctggtactgaagtgggaaaaaaaaattaactgagtctccgtgtctgtacaggtccgggatttggtctgatcaaaaaataaaaaatactggattatagaggacacttctgcggagtgccctcacagcgggaatttt

SEQ ID NO: 41450 - DNA, 620 bp, Heterodera glycines
ataataaaattctaataaaaattttttaaagatttttcaaattaaaaaaatgaaaaaattatcgaaatttttttcttggaattttcgtatcaaaaattttttcttataaatgtgtttgtaaatttgaaaaaaaattccttgggggaatcgatgcgtgcggggggggggaggaaagggaggaagagagtatcaaaacaaaaaaaatgagagtgaaggagagagagagagtgaacgagaggataaaataaaaaaactttggaaatgaaattgaaccaaaaaaacttttttatacccggcaaaggcgcagcgaggtcctcggcacccactggcggcacgttcgggatgacaccatcattgactggaaaatttaataaaactggtgccctccgtttttgaaaatttttttttgttttcaaaaaacgtgaaaacaggtttcctgtactattaccgaaaaaatgtgctaaaattgaaaaaatttttttgttgttgctattattaaaaaaattgtggatatacgagcaggatatttatgaaaatgctaataaaaaaaataaaatttgccctgcctctaagctttatgagtttttttttgaattttttttcgggggagaatgacgggg

SEQ ID NO: 41451 - DNA, 1402 bp, Heterodera glycines
  misc_feature (97)..(97): n is a, c, g, or t
  misc_feature (106)..(106): n is a, c, g, or t
  misc_feature (121)..(121): n is a, c, g, or t
  misc_feature (332)..(332): n is a, c, g, or t
taaggtagccaaatgcctcgtcggctaactaccgacgcgcacgaatggatcaacgagattcccactgtccctatctactatctagcgaacccacagnccaagggancgggcttggcaaatntagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccngatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaaggaaggctctcttaagggagtcaaatgcctcgttgccaccatgaaattaggtaggataagttcttgactttgcttttttgtccatttattccaatcgcctattgctttaaggttttgtctttgactttgcttttttgtccatttattccaatcgcctagtgctttaaggttttgtctttgactttgctt

SEQ ID NO: 41452 - DNA, 933 bp, Heterodera glycines
  misc_feature (814)..(814): n is a, c, g, or t
  misc_feature (911)..(911): n is a, c, g, or t
ttttctgtcataaaaatagctcatgacaggatggagttacgcggccctaaaaaactagaattaaaaattcgtgcacttaaaaaatttggaattcggaagtcagaattccggtagtcaagcaaagtgatttacgagcccaaaaatttatggaaggttgggcgtgaaattttttttatttccaaaaactttaaatgcaaaaaattgagaaatttaaatttacctaaattttcaagtttttctaaatcttttatttggtaagatctgtaaacaactttattaaaaaaaattttgccgcacttattctacaaaaaaaaaacaaatgtttaattttttgaaattattattttatgagacagtatgtcattagaagccgaccggttactgtaatttgaaaaaaaatccaccggttcattcactgtcaataacttttagaataattttagaaatttcaacaaacattaatattgtaataatcaatcaggtgacagacggagtaaatcatgcgacaacaaatctgagtgttgaagttttggatgtgaatgacaatggaccacaatttgttcaaccttacatcgaaattgaacggtcaatggatgtgccaattgggcacattttaacaaaggttgaggccatcgacggggacatgtccaagcacaattcacaaattcgctacacattggaaagtgctgctgcttttcaaaatttgagcactgctgatttggattggctttcttgcggccaaaataatggtaattgaccgataatttaaaaaattttaaccgtcattaaagtaattaccagtttaaccgactanaacattttgacggtaattagagtaattactggtttaactgattaatttgaaatattttaacggtaattagagtgattacttgtttacttataaaagntttgccaattctattctttttt

SEQ ID NO: 41453 - DNA, 902 bp, Heterodera glycines
attcccgaagggattcggtctccccataaatctaggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttgggtactcaaacaattatggggagcaaaaatccaacgcagaattaaagtacaggctatagggaagctattcccgaaggattcggtctccccataaatctgggcgcatcggttcggggggactgccccgaaaaccaaaaaatcaattttt

SEQ ID NO: 41454 - DNA, 962 bp, Heterodera glycines
accgcggttcagcagaagctgaaaattgaatttttaaattgtatattttaaattgccttcaagaaataaatgcattaaacttattgttagtttgggcgaagtaaaaagggatatggccgaggaggggtcatttcagtcacaaaaattatttttaaaacataaattatcaggagtttaaaaaatttaaaaaccattttataatttttttatttgtgtgacttaattaccataaataccaaattcgaaacaacattttttttattattttaataatttccgccaaattttcctgtcccgtattctatagcttaaaaccgttcaaaatttggttttaatgaacaaaatataaaaactcttttattttacttaactgtggtgtaaaaatgaaaaaaataacaattataaaaataaaagtccacttgattggttttaatgaccctttgataaattaaaaaaatatattacaattaaaataatgattttatttagtaaaatcatttttgatactgaaatgatccctctttggccatatttccactcccattggcatttaggctcaccataaggcgtcaaaatagttgtgctatgtaaaaatatgtatataaaaccaagcaataaatagcctaaaataccctatattttgtttgtttattagaataataaaggttttgaaattttaaaattaatttcgggccaagggaatttgttatttggctatatttttgaaaaaaaacaatttatctgcggtgactatgaccttcacaatttcggtgatccccgtcattatggccatttgcagcagagtgttgccgctcgatgtgtccttggcgttcacatctgcgccgccggccaaagcgcccaaaagactgccaatgtcaccgcctttgacgcggtgaacagcgtggacagaatgtctacagaaagcagaattgaaaaaatttatatagagacagctacaaatg

SEQ ID NO: 41455 - DNA, 669 bp, Heterodera glycines
taataagcaggcccaccaattagcaaacagaagaagcagatcaagttaaacaccttttgggaatggacactataatgtacggtaattggccaaccaacatgcatacggtaatgccgcactcaaaacggtagagaagacttacaatgacaatgaccttcagaagaccgggcaaagtgcgcagatagctcgtgtccagccacgggttgaactgcacattgcccccgtcgtaattgtgcactgtcggcacccaacgggcgccggtggttgtcgtgtacacgcgcgtctcctcatacattaattagggccgcggaagcggactttttcaacggggatgggctgtcggtttgttggacaggcgaagtttcactttccgagtgatggcctctcccccgtccctccaattgatcaatagcccccccccccccttcaattcatttgttccattgcgttcaatcgatcgctatttaagtcggccgaggatttcatttatccaatcggcgtttctgaatgagtgcccctccggccaatgctttttcgttggctctttcgtcagcccttcctccgcttccgttttcatgcatttcttcgccagctgttcctttcctctcagattcgtctgccctttctctccaggagaggttcgttcctttgccggtgatcaatcacgca

SEQ ID NO: 41456 - DNA, 1566 bp, Heterodera glycines
  misc_feature (1014)..(1014): n is a, c, g, or t
tgttcaaattttcaaggaatgtaatgctaaattcttcaaaatttcttatgaggatattgtaaaaattataatattttttaattgtaaatttatgtgttaaaagaaaaaatttatttttataatagcttttttacttaatgagaaatgatagttttcaacaaaaaataaataaatccattttccaatgataatgaataaaattttttttcttgccgcaactttggtcaacctaaagtgcttttgggcaccataattttgggtgacaagctcagaaagaatcctttaaaattcaacacaaataaagctgtagtaattcttcccgctattcacccattaaaataaaaccaaaacacaatttatctagtcaaaaccgaatatcaaagttaaatcaaaggctacaactaaaaactcagagacgagagaagaccaaaattataaagaatataacaaatgaacgcaaaaacaaaatctgtagagaaaaagatcggtttatatcagttggtccccgcacgtttgggctttgggccctagcatgtttttggactacaacttttattgctcaaaaagttatacataaaaattgcgaaaagtcgaaagttgggtttttcttaattaattttttacaggcaagaaaatcttttcgctttgtatggctaatagatcatgtgaagagctttcgaatgatagcaataatgttgcatttgggtgacaaagaaaaaagttatagtccaaaaacatgctggcgcccaactgacgtagaccgtcctcgctcacatcctggctctctgttttccacatctttctctcattatttatctgtcaatataaattttttctctcctttctctctcttcttttcttattttctgtctctctcaattttttgtttacctctctctatctctttccttctctctcttacactttcatgtctctctctctctctctatctctcactgtctctctcactctatgtttctctctctctctcgctctctctcattccactgtcancttttttcaccccccccccctttctctctctcgccccctctctctctccccctctctctctctcttccttctctctcgctctctctctcggtgtctttgtcacacagtcacatatccttatatactcaataaaagcatattttaaatgaatttttaattatttaaaaagttttaaaaataatgataaaaaagaaaatacagacggaaacaatacataaatttgtttatttttaaaatttctttcatacattttcttctttaattttaaaggttttcgcgtcaaaaaataaacttaattcaaaaaaaccacaccatcgaattagtatagttagatagatgaaatctttaaagatgggctattatttgcgaagagtctggaagtaaaagtaacgccttgtaagaattggctaaaccaaccgcaccctgttttgagaggtgcaaaaagaattgggacaaaacgtttattctacagtaattcaaattttatgtatagaaaaaaatctgaaaaaatccctgctaagctaacttttgatactgatcaaaaaagtcttt

SEQ ID NO: 41457 - DNA, 811 bp, Heterodera glycines
ctttaccacattgttgtaacttatcggtaaggttagtcagcccctgtcttgaatgttccctgacggcatcccctaaatcacggccctgagcgatgtcactcagaactctctgccccgcggcgagcccctcatgtcctgcactcgaggcaatattcctcgcaataggggtcaagaaacgtgccacattaccgaggaaaccgaatccccgttgatacttgcttccgacaaagtattgtttctgtcccctcccatgttgtgaagtgaaaaaagatgaccaatcaaccgactcgggatcgaaaaatacgtgtgtcatttttaaaatatacttttcttaaaatgtaatgtaagaatacaacttccccagtgaaatttaacaaattcaccaaatggcgtgtgaatttcaattgtaatttctgaaattcgtttcgactgtagacgatgaaagtactcggtgctatatataacttcactaatcgaccctgggtcattgacgacgttaactattcttaagagtggagccatctggttcccgataattgtgttttctattaaatttggtgcataaatgtatagctgccttacgcctcccgtcaaatctggcgatataattcgcctcttccgcatgaaataacctgtgttcttaaaaccgagcacataggcgaggtgttttgacaaatctatgtgggagacagcagcggaaagatagacgataaatttttgatcaatgctgtcatattgaaattgaacatcctcattggctagtctctctcttttttgtggtcctttctcagcttcagatacttgtctattt

SEQ ID NO: 41458 - DNA, 846 bp, Heterodera glycines
  misc_feature (46)..(46): n is a, c, g, or t
aaagtgagcatagaattgaccaacaaagaattgtggcagaagttcncatcgggtcaccaacgaaatggtggtgacacggacgggtcgcaaaatgttccccaagttggagttgcgtctgcgcgggttggaccccaagggaatgtattctctgtcgctgttcatgcgccaattggacaacttccggtacattaaagaccaagaaattggcagtgcaaatctcattttcattccaatgtcagttataagtaccaaacgggcgggtggtcgcccgcggggcaggacaaagccgcggcaagtcaatcgaacgaagtgcagcaccacgacggcacgtgttcgggcgagttttggaccagtcaggagaagctatgctttgaccgcgtcaaactcaccaatagggaggtgcacagcaattctttggtcagttggcacggcaaaccccgcgggtgtcaataatttaatcctcccccccccccccccaactctgtgcaggtctctctctgctcaatgcacaaatatcagcccgtcgtcagtcttttccgacttgtcgatcgtcaagcgatgcatttgtgctcatttgagccaccggaaacacaatttattgtaagtttctaatggctttatttgttgtgaaatggccaaattggcactaatgagcggggcgtggcgttgacttttaagagctaatagtgagaagtgttcattttaggctgtcaccgcctatcagtgcgaagcaatcactcgccttaaagtggagcacaatcctttcgccaaaggcttccgcgagggctcttcgcgcaagcggacgctttccccgtcgcccattttcgcaggtcgtttcgcagtttc

SEQ ID NO: 41459 - DNA, 628 bp, Heterodera glycines
ttaaaattaattttgtgttccaataatttgacaataaacaatatgccgaatgttgtgatgtgataaaagccacgattaatttgattaaatgcctgttggggactcggttggccgagcattggccggccaaatggcccgaggggacgggctgaattttcccatcatagccaactttttacggcccaatggacgggcggggcggacggcgggagatgggcaagggatgggggggggggggaatgagagggtattctcccattttggaggcgtaaattcgtctctcgtcgccgttgtggggatggcacacgtcgcccgaggggacagacggacggacagatccattttattggaatttatttatttaaacaaatgcgaaaatgccttcctcaccccttgcccccttttctcgataagcattggcgagccgaatttaaaaaacggatcaggaccccggattttcaaaaaaaaaactagacatcagggcctgggttttcgagattgactcggactgggtttcgattaaaaagtttttttctacaacagtcaagacccggaccaggattctggcaaaaataatcacctaattaactttaagaattttgcttttttaaaattatagttttttatg

SEQ ID NO: 41460 - DNA, 1352 bp, Heterodera glycines
atgaataatatgatcagagataatttaatccgcatggccattgtgcttagggctcagctgttgttgatccgcagttatccttctcagttctcagcccgatcggttcctctgttcgaaggcatcggtctgaaaacgaaggaaataagaatactgaatcataaatttgttcaactcgtccatacccaatttcgtcatctgagaagccaatggtcaccaaattcggatgccattcgctcgacacacgcggcagacgcaaccaggacatcacgttcgcttccgtgaacaccgctggacagcgtagaatcttcacagatgacacaaagccaccatccggcctttgatgcacatcgctcgacagcgtcagcttttcctccgtccgaatgttcaccatttgttcacgccgggtgtagttgacgtcgaacgaagcgagcaccatgtacttgaccgggccgaccgcacgagtgaaggactaaaaaacggaaaaatgtgatcagaacaattaaaaggcaacgaggaaaagtaaaatcccgtccgttgatctacaacaccccccccccccccacaccaccgtgatcaattcgttgacgaaatttttccccatcctgatttcccatttgctcaatttgaatacccactggacgacccatcggggcgaggcgtgtgccagcccagttgtaccagtaaacgtgtcgaccaagtccggcgaattgctgtaagtggtcggactctcgggcaaaaccagtggcgctgatttggaaaaagtttctgcgccagtcgaagaggacggtcggcgacacgtatttgtgcatcctggtgaggtgcagccgctttacgttgaccagccatgatgagtccgtttcttcgagcgaggggccaaatgtgacgtgccatcgctttccaaccacgagtttgcgtcgagccgaaagtcgaactgcgagagagacgtccgtggagaagaggcggcgaattcggtgccgaggaaattgatcacttcgagtgtcgaaatacctgtaaaatggggaacaatttaaattaaaattgggagtgttgaagaaatgtcgaccgaatgttgatgctgttgaacccgacgacgattttccggcaactgttctgtgggcgatggcgatgagaaacgggagccgtcgctgttcacgataatcgcttcggcgcctgtcccactcggttccctctgacgagatgttcaactccttcgaaccaccgttgcctttgctgcgagctgcgtgtccacgagaatggtgaagcgggcgttgaccggcgccctgtgcggagccgaccactccacgcccagagccgtgccaacgccagggggcggaatttggtcgtttaaagtg

SEQ ID NO: 41461 - DNA, 952 bp, Heterodera glycines
tctatttatctttaaatttacaaaaaatttcattgagttctaaaaaagttatggttaaaaaactctgactcaagattttttaaaattttgtgaccataactttttgaaaatattataaaaaaattttcaaaattaatattctgaaagaaaacatctagagctattgaattataccataaatattaatttggctgatattaaaccaagttatgaatttatatgtcttatcttttcttgttttcctaccacatggcggatttaggaaacgcccaatgtggcggtttttaggaaaccacctagcacccctaaaaagtactaataaaaaattttattttactattttagtgcctattcgagggtttttgtgcctatttagcgattgttctgcctttttaggtgcttatttcgcgattttttgtgcctaaaatttccatccctattaattagtaattacgattactgatttttttggctaattattttttcggcttacatccctatttatacttaaaattaaatttttaaaaatacggcaaaaagtcaaattcctcccaccgatcaaacaacaattttttacatttgaatgtgaactgttcaaacaaaacgtaaacaaaaatctttttttttctattgcacaaattacaatatgatgatgcatcgttaatgaatttaattaaagaaaaacgatggaatttcacgggagaaaaatggggggggggcaaacgaaaagctgaacgataaacaaagcacacacacattttaaaagcgggtacgcctgggggggggggggaggcggtcggttccgttccggacaatttcgtcccaaaaaagttacacataaaccaattttaactctctgatcatggcaaaaaaatatatatgatatcttctcccaactaatcccaaaaatcccgaataaagcataaccaattaaacaatattcgtttaaaaa

SEQ ID NO: 41462 - DNA, 1106 bp, Heterodera glycines
atttttcttacatatttatgtacatatttggaccactttttgtacatatttttggcagccataattataaacatgttaataagggggaataaattttattttaataaaaaatcaaactaattttttctttaattgatttgtaggttcataattttttaaaatggtttattttttgaatttaaaaaccaattaaaaagtatagtaggcacaatttcattttcttccattctttttgtctatttgaatattttaaactatagaatttttttatttttggtcaatattgtagccatacattttttactaaaaaatgaaccatttttgcgattttgagccaattttttaagaaaaattgggaatttgggggccggcggtgccgataagcgccctcgggaaattttttccaacttcattaattagtataacaaatagtgccaagatttgtatattttgaaattgcaggtcccttggcattacactgttccaattggccaccggccgattcccctacgaatgtgtgaacaacgcaatggagttgatgatcaccatccacaacaatgacccgccgcgtcttgagcctaaccaagtgggatgcatttattggagaaaaaactaacaaattttcccccccataattttaggatggtcggcaattcagtgccgagttctgtcagttcattgccgactgtttgcagaaggacatgaacaagaggccgaagtacagggaattgcttgtaagttttagaaaaaatcggttttacattgtcattaacaaaaataaaaaaatattgcaaattcacaaaatgaaaaaatgttattccgttgcggggaatcgaaccccggccttgagagtgagagtctcaaatcctaaccactagaccacaacggacatggagggaagccatttatatttcttatatacaattaattattttcgttgcaacagttgttatttgtgttttgtttcgacattttaaacttattttttgatccgcttatccaaggaacaaatgaatttcaacaagggcgttgctgttttttaatttatttatttttggggttgatttagcaattcataaatttctgtcactaattttcctcgtgac

SEQ ID NO: 41463 - DNA, 996 bp, Heterodera glycines
ttttaactcattaacgtaatttattattgtttttgcatttaaaaatttgaaatattttaataaataatttaatatgaaaaggcaatccttttgagttcccgaaccttttcttttgaatatatattttaaccgttctacatttttgaatggacataagatggtatacagcttttgaatatgtatagataattgaaaacacttcccaacttagaccttttaaaatctccaagcttaaggcattgaaaaagatcgggacgatattaagatattgattactcatgtaaaaaccccaattaatattttagtaaaaacaaaaagctttaaaatcgcaaattttgtccaaaaattcattttaatgtaatgattttattagattacacctaataagattatacattttcatggattaaaaggcttgagtatctcgttttcctcattaaacctttctcactccatttatagattggcagagctatgacagaaaattaaatgaacacctgcgcagattcgaagcgcctattttgccaacagccgccagcgaaatctttaacaaagattaaatttaaaaataatatcaggcaccgaatgtaattctgagcaggcttttgtgggattccaatctacaatgaaatattttaggaatatttgaaaaaagaatgaaaattccattcatttcaaataacacttttatagctccctaaaaaattattttcgatcaaaaagttatcaaaaaatctaggaataaatatttttaaaggtttcaaattttccaatagaattagggatttttaatatagatgaaaaaaaaaaaatatatctttctttcgaccgactgtttattaaggggtaattagtatttacatgactttaattatttttcgtaattttgcaaatttgtttaccgttctcaaaaagtttcaggaattaaactaaaattaacctttttaagaaggttttatatttaataaaatttcaccgaaaaataattttttttaa

SEQ ID NO: 41464 - DNA, 1277 bp, Heterodera glycines
agagattgaaatgctggtgagttgagtctcagcgattggaaagcctgagaattgagtctcagagcttgaaatgctggtgattgagtcccagagatggaatgacattgaaatgctggtgggtgagtcacagtgtctggaatgccggttattgagtcccagagattgaaatgctggtgtgttgagtcccagagattgaaatgctggtgggttgagtctcagagattgaaatgctggtgggttgagtcccagagattgcaatgccattgaaagttggtgggttgagtcccagtgtctggaatgccggagatttgagtcccagacattgaaatgccggtgggttgagtcccagcgattgaaatgctggagaattgagtcccagagattgaaatgctggtgggttgagtcccagagattggaatgccattgaaagttggtgggttaagtcccagtgtttggaatgccggagatttgagtcccagacattgaaatgctggtgggttgagtcccagcgattggaaagcctaagaattgagtctcagagattgaaatgctggtgggttgagtcccagagattggaatgccattgaaagttggtgggttgagtcccagtgtctggaatgccggagatttgagtcccagagattgatatgctggtgtgttgagtcccagagattgaaatgctggtgggttgagtcccagagattggaatgccattgaaagttggtgggttaagtcccagtgtttggaatgccagagatttgagtcccagagattgaaatgctggtgagttgagtcccagcgattggaaagcctgagaattgagtctcagagattgaaatgctggtggattgagtcccagagattggaatgtcattgaaagttggtgggttgagtcccattgtttggaatgccggagattttagtcccagagattgaaatgccggagagttgagtcccagatattgaaatgctggtggcctgagtctcagagattgaaatgctggtgggttgagtcccagagattgcaatgccattgaaagttggtgggttgagtcccagtgtctggaatgccggagatttgagtcccagacattgaaatgctggtgggttgagtcccagcgattggaaagcctaagaattgagtctcagagattgaaatgctgttgagttgagtcccagagattgaaatgccattgaaagctggtgcgttgagtcccagtgtctgggatgacggaaatttaagtccaaaaattgaaatgctggtgtgttgaatccca

SEQ ID NO: 41465 - DNA, 1151 bp, Heterodera glycines
gtctgttaataaattattcactcccaaatttccctaatttattgatcaattaaattgcttaacaacccagtagattttttaggtagcgaagctcccgaagcgctttttcccaggcaagacccgacgtatattacacatttcgtgattatttgttcatttttattgcaaaaaaaattttatccaaaaaacttatgccaatgaaaaaaaacaaaaatgatgcaccaaatttatgcctgtaattagttcataaatgatactttctctgcaaaaatgttaaacatctttttatactctcttatatcatatacatactgattcgtacaattttcctaaccaccaccccagtagaggaggaaaagaatgaatatcagccaaacaaatcccgcccatttgaattggatcaagaatcgaactgaaaaatacaaagaaaaacgtggaaagtatcagatcgatcaaaaattttgcgctatgaagtgctaggaaatctgatatatactctcttggcctctgtaagggttcgtacactgactagcttctttccagctctgatggggtttgaacaagcccagtttttgaaaaggaattactagattgaaagctcggcgtaaatttgaagagaaaaaaaagagtttttggtaatgatccatattttggctgtgaccgcaaatgtccgaaaatagcccttaaaaaatgggccgcaaatgtccgagacgcaaatgtcggcccgcaaaatacggaccgcaaatgtcgggacacgtagtaaacggcgtaaaaagcaaatccaccatccccgccccaaccgaaaatgacaaaaaaaaaacattttttaatgaaatcttgattttccgggacaaattggttagcaaaatgaagaaaaatgcaaaaaaaatttcccatttccagaaaattttaaaatagaggagaaaaaaaaattagaaatccaaattaatccacccagacgcatatttttaaaagttggattttttaaagaattttacacgttcttgatccacccagattgaattttagaatttattcaagccatggtggcaggcttaaacaacaaattctcacatttatagtcacacacctcccgaaaatttagaaccccaaagacgaattcgaacaagtcggaaattgattttacacaa

SEQ ID NO: 41466 - DNA, 1169 bp, Heterodera glycines
agtgcagcgggaccgggacctgaacacggacaactgagtacaactgagtaccaaggtcccggttttgaccgggaccgggaaattcccggcttttttcccgcttttcccagccaaaaagtcccggtttttcaacccaaaaagtcccggtcccggtcctgcccaaatttcccggtcccgctgcactctagttttaaattaaaagaattttagactaggattaagttccgatccgtaaaaacattgttcatggaaaaaagattaaaaaattcaccccgtctcatcgtccttatgttcacgccgcaagtctcgtgcccattccgacgtgcatttggccatgtttggcccctcctccgtgttccaccgcttcgtcttggccgagcagtgccattcggcatgaccatatgtgcccggcgggcatgccacctgtgccgtttgcccataggcggtcatgggccaactcagctcgtgttcatgaagcgcgggacaactgagtacgctgaaaaagaaagaatttttaatgttttttaaataaaatattaatttgtttttaaaatgcaggttcattaattgaaagcgcaaatattatgtattaaattattaatataaaattatttttttgagaaatgttttttttaaataaaataataaaatatttgaataaattgaagataattataatttaattaaattaaatttaaaaattattttattttgtttcattaaaaatatttttactttataatccaataattacattttataattgttatgcccatttggcttcacaatgccatagcccgcggctatctttggcacattttcagtcgaattttctgcaaatgatgcaactgttgaaacagttgttgttgtggtcgttgttgttactaaataaaaacacagaaaattaaaaaataatgtatttatttttttaatatttttcataataaatccaccaccataaagcacaacaaaaatttacaccattaaaaacgaaattcttaataagcaaacttagacttggtaataatcctttgttttcaacgttattcaaaaataatagtaataatacagtatcccggaccacgattcaagaacagacgctccgcccaagtatttttgctaaaattttcaatttttctttgtcgtaccccctgcaaagacatatctca

SEQ ID NO: 41467 - DNA, 1215 bp, Heterodera glycines
  misc_feature (71)..(71): n is a, c, g, or t
  misc_feature (172)..(172): n is a, c, g, or t
ttattggggtcaaaattttcctaaagttgtcccttcagcgcaagaagtttcaaataatgcacatttatcanaaaattattatgactcataccctttgtgatgaatgtataaatttgtacaaaattggatacaactgattaaatgcaattttgatatcatcaatcaagttgtntagtcgaacaaattgaatttagttataatttatttaaaatacgaaatgcaaaacatgaaatgatcaacatccctgatatgtttgttatctatttcggttttttggtccccaaaaatcatatccatactcaaaaaattggtttcctaatttgatgctgaatctcccatctttttgctgttcgaatttttgaattttttgagtattttgccaatgttttccatttgtttttttgcgcttttggcattctgttggattgcatctgtcaaagctttctttttggccctgccatcttttagatggaccgaattttgtgagatttctcgcccaatttcgtcatattttcgcaatttcttttcaattttgagctgcaaatcggccaattcaaataacaatttggtcgatttgactacggcattttccaattttttctcatttatcaccacttccaattctggcaccaaatcatttttcaccgcttcaatctgcttagccaaatctttcaaaaatgattttgttggcctaaaatgcaattttaacaaattttaaatataaaaataagacccaaaacacttgaacaatttttttttgagagtgccaatttcttcttcaaacaatttcatttgacataatttttgccacttttcacttgtctttgcatcaagtgatgatggaaagcttttaaaacgttattattatttttttaaatttattttattaataacggcggtaccggtactaaaaatttttgtccgttatataaataaataaatcctgtcgcgctacattgctcccgactctcgctcaacggatataataataattaagctagggttggtccccttaatcgacgcgggcttgttttttctaaaaattgcccccccccgtcgaggggtttgctcccctatatttttaaaatgcttcggccatgcccgataaattttgtcgccgaatttcatcaccgattcccgactttctctccccaagaatcggggaccaaccctaatttacactttcaattacccttctgttttcctaaatccaaa

SEQ ID NO: 41468 - DNA, 994 bp, Heterodera glycines
cccagaaaaattcggaaaaaattagggtcggcgctatctttccgaaaatgtggttggaattcttcatactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcaacatcaaactcgcccagaaagaaattcggaaaaaattagggtcggcgctatcattcggaaaatgtggttggaattcttcagactgatgatcagaaaaagagataggcgtttttccaaaattttcaacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcaacatcaaactcgcccagaaagaaattcggaaaaaattagggtcggcgctatcattcggaaaatgtggttggaattcttcagactgatgatcagaaaaagagataggcgtttttccaaaattttcgacatcaaactcacccagaaagaaatttggaaaaaattagggtcggcgctatcattccgaaaatgtgggttggaatttctcagactgatgatcagaaaaagagataggcgtttttccaaatttttcacatcaaa

SEQ ID NO: 41469 - DNA, 714 bp, Heterodera glycines
  misc_feature (702)..(702): n is a, c, g, or t
aatatggttcatagggctcagtctcaaaattaaacaaatgatatatcaatcggtagctctcggtctgtaatggaagaatccgaaagtttttttgaggcaacaaatccctgaagagttacaggcccgggacagaagtggcaaaatggctttgggactgaactgtccactgacctaaaacgcatggaaaacgacaaattagataccaatcgattcctcgcggcatgtaaagcatgaatccgaaagaatttttggacaaaaaaattgacaaaagttagggtcctcaaaaaccaccgaaaacttttgattaaacaccggtccaatacgaagaaaatgataaaaaaccataaaatttaaaagtctagttttatttattgcgctaaaaaccagcgcacactcgactaaggcggccagaaactacgggctacggaaacagtccgcgcgtgatccgcaggcggttgactgattcgcgtgggccctcttcagtccccgcagcagggctgcacgcaattacagattacggattacggattacggaaattacggggtttttggacccccgtaattacggattacgggttacggatttttgggggttttccgtaattttgatcctaactgggacttttggattacttttcgagacgatttcttgttagattattttttataaattgaatttttattttattttattaaaagaanatatgtacattt

SEQ ID NO: 41470 - DNA, 229 bp, Heterodera glycines
gtggttgtacacaatgggagcatcacagttcgttggaaaggccttgacacagcgcgcgatgtcgcatcgtcagtgtaacaagttggagctaaaatcaacattatatacacatatatacgcgcccgtcctgaggccgcgaagcggccgaatgttccccacaaaattaaaaaacgggcgcgaagctcccgtcctgaggccgcgaagaggccgaatgacccacaaaaaatta

SEQ ID NO: 41471 - DNA, 1472 bp, Heterodera glycines
ttaaagaaaataaatttactaattttgcaaaatactatccatttaaaaatgttctcgtacagaaatttaaatatcaaaatatatagatgattctttatattaacaaatatgacaacatttgaaatacaataaaatttaaataagaaaactaacttattgaaaaaaacattgcaaattaaaggaaataactttttaaaaataatataaagtgaaagaatataattacataaataataactttatattatgaaagtaatcattattagagaccggacgagcccgggggcacgccgggccacccgggcccgggcccggtaaattttaaaaaaaccgggcccgggccgcccggtaaaacgggctttttttggacgggccgcccgggcccggccaattgtctaagcccgagcccgggcccggtcattttggcctggctaaaacgggcttaaatttcgccagcgaaactgccccaagtttgaaaatttaaataattattatggcgaaatgtctttagttcaaaattaaaaataatcagagaaacaaattccaattgattttcgtacatacatgccaatctttttgtttttaaatcctttaaaagtttttcagaaatgaatgcatcaatctggaaaataggtttatttgaaaaatcaaaggatgtcaaaatcgcggagtgccgagaatgtaaagaaaatggaaagtccaaatatgaatttagcctctctgactccagcaccaaatcgctcaaaaaccatctttttcccaatgctgaattacaaatattgactgacttttgttgaatgataaaaaattttcataaaattatttaaacaaagcaaaaatagaaattacgtacctaattttctcattttacaaaccaattttcgaaattttgaaaaaagcccgggcccggcgggcgcccggccaaaatttttgaccggacccgggacgcccgtttaaacgggtttttttggccgggccgcccgggctcggccaattgtctaagcccgggcccggtcccgacattttcaaaattccggtctctaatcattatgcttaatttatatgtaattcaaaaagactataataggcgtgagaaattatttacaaaagttaaaaatatatttattattgacgcaaaaaactaaagataaatagcagcttaaataaattttagatatttgagtaatttaaaaataatagattttgaaaacaacacgcgttataatgtacttcaacaaagtaatatttgccaagagatgatctattaaaaaatatatataactttacgataacaaaaaaggcttttttatcaataaaaaattcttgttaactaattaaatggaatatttaaaaaaaaactaaaaattaatttaaataaataaaatacaaatgaaaaaagagcataatgttttaaataatgtcttttttcaaatgtttggaaatttatttattaaaacataaaaattataaaa

SEQ ID NO: 41472 - DNA, 1304 bp, Heterodera glycines
aaaggacggcaacggcacggcgggcgcaattggcgccggtagcgtcgacccctcctggacagattcgttggtgctggtcaaggccaagccgaacacggggcccagtttttggcccattcccgaggcgttttggccggacaccgtcaggtgggttataggggaaaaatcactaaccatttgggggaattttttgatttttggggacctaaatgggacagtttggcctggaaatggtcccaatttttcagtaattccctccccccttcagaaggtctttgcccgctcgttctgcccaccccgtcgtgctgttccgttgtgatcgtgcggaaccgatgttcaaccccgagttcccgctggacaagtacgagttggacagcacgtctccgcttgtccaaaacatgctcagccgacgggagcccaacctttgctggcaggtcatcacaattttggcccaaaaggggggggggggaagggcgggtgaatttcaacagcgataaacttaacatttttttggcatttttgtattgcgtctgtaaaataaaaataatacgaaggcaaaattcttgtgcgttttcatgtttataatgaaaagtttcaattttttgcatccgaatttgagtgcatttccttaccattttcaggtgttcgtcgaggggtccttcaaacagccgggaattgggcttccgtttggctatttgaaggtaaaaatacccatggaactgtgattaataattgcctagttaattcaaatccctaatccgaaggtttcggttttttaaattactatagcttacaattaggtattaggcgtttaatgaatagagatgccagatttatggttttatgatcagagtgatcccaaaaactctccgagaacaaattttgatgaccggacatcatcataaaacaattattgcaaaccaaaagagtggatttaatgattttcaaaaagcgcaaattttcaagtaatgccaacttttttaaaaatttattcccggctgtgttttgtcctattctgtcatttcttaccgtcctcccattttttaaaaattcatttcccccgttttcaaggtgtcctcctcctccaccgtcaatctgctggtgatgccttacaattaccccgaccttctcacgctgttggcccaggccaaagaagggcccgaaatgatcgccagcgtccccttccaacaacgctttgacaaatatttgaacaccgtcccgccctattattacacggtgagtaacaaaatgccacaaaaagatggcacccttttacacccactttttgtttagtatctgaaaaa

SEQ ID NO: 41473 - DNA, 121 bp, Heterodera glycines
caggaactgaccgagatgcgcgagcgcatccatgccctgcggaagggcctggtcgagaagctggccgctgccggtgcaccaaagttcggcttcatcaacgagcaggccggcatgttctcct

SEQ ID NO: 41474 - DNA, 568 bp, Heterodera glycines
aatattcggtttttttcgtaagagtcttgtcttaaatccaatgtaaaacacattaacaattttcatatttttttttttaattttagagcgaaaattcacgctgatcagtgaccccgaaaagcttgtggtcatttttgtggacggaccagccgaaacgtcagatgatttgccggaagattggattcacctttggaatgaagcagctttaaaggtaagaaagaagcgttttaatccaattaaaagcttaatctaaatttaccaattcatgatttcgcatagctctctctctattcaagaatttgaggtcgagaaaattttcatttttatattagctttgtgattatattaatttttttgtaattatcagagcccggaattgggatttggtactgtaacggggtgttggatctgacgtaataaaattcatactgaaaaatattaataatttctcaaaaaggcgaaacagttttgcctatttttgaatgatttttcaaatttttccttaaacattttttgagttcgtgcaaaaacactgactcagtaccgaaattccggtttcgttctttgt

SEQ ID NO: 41475 - DNA, 870 bp, Heterodera glycines
  misc_feature (56)..(56): n is a, c, g, or t
  misc_feature (62)..(62): n is a, c, g, or t
  misc_feature (73)..(73): n is a, c, g, or t
  misc_feature (76)..(76): n is a, c, g, or t
  misc_feature (87)..(87): n is a, c, g, or t
  misc_feature (93)..(93): n is a, c, g, or t
  misc_feature (96)..(96): n is a, c, g, or t
  misc_feature (119)..(119): n is a, c, g, or t
  misc_feature (123)..(123): n is a, c, g, or t
  misc_feature (134)..(134): n is a, c, g, or t
  misc_feature (141)..(141): n is a, c, g, or t
  misc_feature (158)..(158): n is a, c, g, or t
  misc_feature (163)..(163): n is a, c, g, or t
  misc_feature (173)..(173): n is a, c, g, or t
  misc_feature (183)..(183): n is a, c, g, or t
  misc_feature (188)..(189): n is a, c, g, or t
  misc_feature (202)..(202): n is a, c, g, or t
  misc_feature (204)..(204): n is a, c, g, or t
  misc_feature (225)..(225): n is a, c, g, or t
  misc_feature (328)..(328): n is a, c, g, or t
  misc_feature (331)..(331): n is a, c, g, or t
tgcaatgccgctcggtgtttccgattcgttttccaactactagggaagaggagganaaaganaaggaagaggnggngcttgaaatgncggggnagnccaaaaaggagggaaagagaagnaaanggagaaagagnctcaagnatttaatttttttaaanagaantggtggaaantgaaaaaggncgaannaaatggaaatggngnaggtgtttatgatttgttttnaaaagatgttaaagaagaggaggataaagataaggaagaggaggtgaaggaaatgtaggggtagtctaaaaaggtgggaaagagaagtaaatggagaaagagnctnaagtatttaatttttttaaacagaactggtggaaactgaaaaaggtcgaaccaaatgcaaatgccgccggtgtttccgattcgttttccaaagatgccgaagaagaggaggacaaagacaaggaagaggcggtgaaggaaatgccggggcagcccaaaaaggtgggaaagagaagcaaacggagaaagagcctcaagcatttaatttttttaaacagaactggtggaaactgaaaaaggccgaaccaaatgcaaatgccgccggtgtttccgattcgttttccaaagatgccaacgaagaggaggacaaagacaaggaagaggcggcccaggaaatgccggggcagcccaaaaaggtgggaaagggaagcaaacggagaaagagcctcaagcatttaatttttttaaacagaactggtggaaactgaaaaaggccgaaccaaatgcaaatgccgccggtgtttccgattcgttttccaaagatgccgaagaagaggaggacaaagacaaggaagaggcggtgaaggaaatgccggggca

SEQ ID NO: 41476 - DNA, 1091 bp, Heterodera glycines
tcctccattttactctctttctcttccgtctctcctccttttaatgttcttgcttctgctgatgttgttgtttctgctggtgttcagctgcaattttctttttcctcttcttcagttgctgctcctttttctcctccatttttctctctttctcttccgtctctcctccttccaatgttcttgcttctgctgatgttgttgtttctgctggtgttcagctgcaattttctttttcctcttcttcagttgctgctcctttttctcctccatttttctctctttctcttccgtctctcctccttccaatgttcttgcttctgctgatgttgttgtttctgctggtgttcagctgcaattttctttttcctcttcttcagttgctgctcctttttctcctccattttactctctttctcttccgtctctcctccttccaatgttcttgcttctgctgatgttgttgtttctgatggtgttcagctgcaattttctttttcctcttcttcagttgctgctcctttttctcctccctttttctctcttttccccccattttctcttccttctcctcccccttcgctgtttcctttttctgttgttgatttcgtgtcacgacatttgcggccaccagccaaaaacgacaattgcggtccgtcttttgcggcccgacatttgcgcctcggacatttgcggcccatttcttaagggccattttcggacatttgcgtcccgacatttgctgccaaaatcaaaataggtctctcatcgaaaatcctttttttctcttcaaatttatgccgaaatttactcaatcgagtaattctttctcgaaattgggcttgttcaaaaccccatcagagcttaaaagttttttattaaaagtaattatttggaacttttcgccactatttttgccactatttagttaattattttgggatttttgccactaaaaatccgatccctacttctaacatgcattttttgagactttttttgactttttttacactttttcggatttttatgacttttttgaggttttgcgacttttggttcgtgatttttttgacttattgaggcaaagtttg

SEQ ID NO: 41477 - DNA, 1029 bp, Heterodera glycines
atcgtcgtccctttgcagtgctttaattggtacaatcgctcgccgccctttattatgccattattaacgtcctcaacggcttgatagaagcctaaagattttaaattgatcataaaacagtgaaattgaaaatatgtccctcattcccaaacttacaaatgctacgaaacaatttgtccttctcgcataactgcttttccttctcaacgtcgaaacaaaatttgcgcatggccaggcaagaagaagcagccgaagagtaattttgtatataaatgttgtggggacactcgcggtcgtgcaatttacgtgcgaatgaatccttaaaatcagacacattcggcgttctggggaattttctagtttaatataccatttgaacaagcatataagaaaaagtttaagcgatttcaaagaattttagcgccccaaattgggtatttgtgttaaaaagtctcgttttagccatgcttttgacaattcttggatgatttttcacctcgatcacttcaaacaatgcgcaaaaatgcgccgcctccgtccccaacttcaactcctcgcacactctgccgaacacttcgcgcgtgtcgctgtgccttttgatgttcaacgaaagagtgttgccacagacaatgacgcgcaacgaaacgtcgacgaacggagctgacaaagcaccgccggaatcctccatcagaaactcctgaaaggcattgggaaagaagtcggaaaagcagtgccacggcacctgcacagtgtcactctcggcaatcactttcactgcgcacactttctccaagtactgctccaacatgcgtcttctgctgtccaactgctgctccgagtgacgaaatggccatttccgtggcaatttcggaaacggaaagtcggggaattcttccttgagcaatttgttcagctgcagaaattcgctgtaccgtcgtgagccgagatgccttccggccatgtgaatggaataggcggtgaattgctccccgttggcgttcactgtttgatggcatggaatggtaatgg

SEQ ID NO: 41478 - DNA, 1566 bp, Heterodera glycines
  misc_feature (348)..(348): n is a, c, g, or t
ccaaatttcaaattcaatttggcgactctctgaagaaagcaaaaagaatggaagaaggagaaattcatctaattgctgtcatttttactttatttatgtttattttttaaattcttttttttcaattttgattttggctttataatactaattactattttatttgctattaatttcgtttattaaaacgtcgattttgtgactcatttcaagtttcttcgaaaaaattcctatgaatcttaaaaattaatacgagaaacttcacaaaataatttaatttctcttaaataaggatggcatttcttgactattggttttaaactagggtttctccccgactccgagccnccccccccccccaggcccgtaccaaaggaatttttacaaatatttgttctattctcagatattaattaaatccaatttttcaattgcatttttaaataaaattctgaattggggcattcttttttaggtcatcattttgccttaatttatgttaattgaccccgataaatatgttaatataagcaactgcagaatcagcagatgttcatttattacttctccaatttgttaataatttttctcatttattacttcttcaatttgtttaataatttatcatttattaaaatttacatcttttattgtgaactttcattttaggaacttaatgaaaagtttgtcaaaatggaattggtattgaaaatcaccaaactggagcttaaaaatgtgagtgttatttaaagtgtcatttttttgaaaattaaatgggaattgctaattaattttgaaaaaaaataaattttttaatattaaatgattttagaagggactccaataaaagttgagacagaaggaaacgaatgtactgctggcgaaaatcgaagcgaaaaatgggaaaatgaaaacaaacaaaaaaactaattttgcggatcaatttttgagaaaatttcaattcttagggttgtatttttctttttattgcatttttgttaaggattttccgaagatcccaacacaattagtgccactaaaaagcaaaaagaacaccaattgttatcccaattttcatcgttcttctgctgctgaaccgtcacggcctccccaattttgcatcgtttcattatccatcggttgtccaattcctttgctttggccaatgtcagcttttcctttgtccattcgttcaccaattcaaatgtcacaattgatggcgcatgaacagtaaaatgaatttggtaactgacggaagaaatggcattggcacggagaaattgctaaacaatttggaaaataaaaatagaagtagtcaaaatcagtaatatgcaaaaaaatatgggaccataccttcttgaaattgttgacccaatcgaagtacacttgtcgttcaaaagtgtgcaacacaatcgcttgggttggccatcttttctcggtgtgtgccaaatcgtcaccaatcgcaattgcctcgggcaacagaccatatgaatcgattgaattcaactgattgagatgagtgataattgtcggcgaagtgcgacgaagcaaatttccaactgatca

SEQ ID NO: 41479 - DNA, 98 bp, Heterodera glycines
ctaccataacttttgtaatgtccgccaacttaaacattcttggaatcattcgatagagctaatagttctctattaactcacctaaattacaaaaaatt

SEQ ID NO: 41480 - DNA, 1069 bp, Heterodera glycines
ctgatcaaacccgtttttagccgaatatcctgtcaatatttccctattagaaacgatactgtgaattctttcgcctctttaattcattcgtgctttgcttcggattagtctaaaaatttcaagacgccaattttacatattagccatttttttttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtgggcatagaataggtgggttgaattatttgtattttttatgagtattatgtaaggatattttcgactaaacataaccaattccgagtttcatgaggtatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttcaagacgccaattttacatattagccatttttttttatttatgaccgcaaatttttacatactagccattttttattttattgtgaccaagcatatctttcctcgtatttctgggatttttttc

SEQ ID NO: 41481 - DNA, 1072 bp, Heterodera glycines
atttggatataagaaatgaaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaatattattgacgattatcagctcggtcattccgaaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgtcaataacctcagatttactattttcgcgaccccactttttgaattctgacattttcagctcattacgctctaaatataaacatcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataagctgtttaagtgttgcagacggatcaggttgataagcgccaataacctcagatttactattttcgcgaccccactttttgaattctgacgttttcggctcgttacgctctaaatataaacggcatcagtgttccggaaggatcgatttgaaatcgcctaataaccccctaaattacaatttcctactgtaaactta

SEQ ID NO: 41482 - DNA, 952 bp, Heterodera glycines
  misc_feature (911)..(911): n is a, c, g, or t
ttttctcgcaatttttgtggccacaatttttcaagcttttagaggttgtcatttgcattttatggtcgttttaactgtaatagggtcgggtcgtacgaaggcattccatttcaacaaaagtccgtacataggtccaaaaaatttgttttttttaatttcaaaattttcaggttcaacagtttgtgtccttcacgcaggccaacgaacagacggcaattacatgtttgacggcctccaactggaacttggagatggcctgtgacatgttctaccaaaatccgtcctacaccaaccagcaagcgggcgccaccggtggggcggacagtcggaaaatttgtcacctgttcaacaaatatgccaccggtttgttcattttattattgatgataattccggtgtgcccttggaccgtaaaaaaaaaataaaacggttcggaaactttgaatttacaactttttgttcgagtttgcattagtagggattagcaattggtcaaaataatgttgtcagagaaccgtggtcaacaatcctgaaaccccaaaaccaattgatgatcacaaattttgttttttatgctccatcctaaggtcgagactacatatccctaacaaaacaaaaagcaatttttcctaccccccccccctcttttttcagatccaaaggacaaatctcagaaaattggacccgatcggatcggtcccaatgggatggttcgtttcttgcgcgacttgaacatcgagccaacgagtcgggcagttatggttttggcgtggaaaatgggtgctcagaaacagtgcgaattcacactgcaggagttcggcgacggaatttccacactgatgtttgtgtctttattttaatggggagaaatgcagttttaaattttttaaaattgacaaatttcagaattnttaaggggtttttgagtcgagaaaatttttttctgcatttt

SEQ ID NO: 41483 - DNA, 1229 bp, Heterodera glycines
tcctttcaatttctctttttttattcaattaagctaatattaaaaatgtccaccgacggggagtgaccaacggaacggcggcaaaagatgagggggatcagcagcagcaaaactgcgaacagttggtcacgcttttcgaggggatgaacaagttcttccgggaggaggcgatcatccagggctcggaacattcgtccgttttggtcagtcgtcccaaatggatttttgagttttccgagttcagtttggcattttgattctgtccgcctatattttggtcatcgcttttggcgccgttggcaatattttgactatttttgtggttcttcgcaacaaacagatggtctatttcatggcaattttcaattattccgtacaaatttgactttcagcgatcagtgcgcaactttttcattctcaatttggccatgtccgatttttttgtgtgcacagtgaccggtgggatttttttttagaaattttcgcttcccccgggcgattaaccattaaatgctgattggtatcggtcagctgctgctgatcagtccgtgatcaatcagaaactactctttcagcacccaccactttgtacaccgttctctacgtgttttggccctttgggacgacgttgtgcaaaattgcgggtagtctccagggattcaacatttttctctcaactttttcaatcactgcaattgctctcgacaggtgaaattttatcattgtctttctctaaataaatattccgatcaactctgatcactcttcaattttaaacaattgatttactttccatttgatcatatttttcaattttacacatactttggatcataaaagggaagaagctttggttggacggttaaaagccataaggcggggttgaaaagactcattaggagagatggctaatgcgtcttcagtcggcgggagagatcccacgacctccgccggtgcggcgattgctctcacccaaaagcaatgccatggccttccatctctcttaggtctctaatgagcattttaaaaccctaaaaaggtattttctcgtcattttcccgacacggcatcagtgtcagcaacgcctttcgctgctgttcttttcaatgatttggttggcctccgttctgttggccgcccctttgtttcttgcggccgacttgcgacccgttttccagcaaaaaagctgccaaatcgaattgaatctgtgcagtgagcagaacgaacgg

SEQ ID NO: 41484 - DNA, 1504 bp, Heterodera glycines
aaaaaaatttcaaaaaattctgacaaaaaattgatttttgaaaattgcggatgcgggattacggattgcgggaaattgcggggtttttggacccccgtaattgcggattgtggatttccgtaattgaaaatccagttgcgttgtatatgctgtattcgttgattatacttatagtagagaccgaacttttaggcacttggacaatatagaaggccagggtcatcaaaaggcgaatttacggtaaattaaatttcatttttttatgcgttataattccataagaagttagcagaaaataaaggcatatgccacaaaacccattctctgcttattaattctgggtacaattaattcaaggacaataattttttaaggacagttaaaagaggtaaaatacaagtgatttattcacagaaaaagcaagaataaagtttacataaattcattcacttaaaaacaagaatgacgcttacataaaacttgaaagtggattttctgtccaaaattttttggcaaatatttttctttcggtgccaacaaattccatcttctgtcacatagtgatgtcatataattcttcatcatcatcatgttgtgtcttggtattcaccgctttgtaaactacttttgtgtgtggatgtgtccgcgtgatcgttgtcagcgttcccctcacaaatggtcggctcgcgtagacttggacgtcgcgctttagtggcatgtgccgccgacaacagcagattgggttgtggaggtggtgcaagaaaaatgctacctttaaaaataaaaaattgttttcttccaagatactccaaaaattttttatttgccatatatgtcaaaattaggtaatactgtatactcagccccatttttagaaaaaaataaatttaaaaaaattcatataaaacgtttttcctgagacgagttcgctaatctcgaatcttacattcaattctagtaatcccgaatccgaattcgaacaaaaagccaaaaattcaaattttcaaaaactcacttttgtgtgaaaatttattaaaacaagctaaaatttgtcacaaatcattgaacttaaatggtcatcctatacagattcgaatgtaaaaggaaatcttgaacattttgtttttcgactttttgttcgaattcggttcgatgttcggaattcggaattattaaaaacggatataagaatcgtgataagcgaccacgaaaaccccagaaaagaggttttaaatgattttctcaaatttttatttttttttctaaaaatggggggtaggtggtacaaagtactgaattacccaaaattatattaaaaaaacttcatttttttttttaatgcctttgcttggtaacgttggaagcacatcatcctggaaccaccatgaacgtgtcttgaagcggagtgttctggacattgccgcaaagccaaaattgtgggcggcaaacacgcatacaacatatctttaaatcttttattattaaatagtgggggggggggggg

SEQ ID NO: 41485 - DNA, 1328 bp, Heterodera glycines
  misc_feature (25)..(25): n is a, c, g, or t
  misc_feature (161)..(161): n is a, c, g, or t
  misc_feature (1190)..(1190): n is a, c, g, or t
  misc_feature (1242)..(1243): n is a, c, g, or t
ctcatctttttggtattctatcgcntacacaaaaccgatacatttatccaaacatttttgataagaatacaaataaaataactaattcttttttaattcaaaatctcttgcaactatgtctgaggtctatctaaagttgtttgacccgtttttaaacagtntaatgtatcagggtcattaggattgcatgtaaaagtaacaaaaagaccgggttttccagttttattaacaattgccattgcgatccattagatccgttaaatgttcatgcatatttcgtggcacatcagtaaacgttggtggcaatattaccttttttgatttctgtgccaactttttcagctttatttttaatgaaaatcttcaacatttgagtaattactgctgcaaagttctgcttgatgtgatttgatctattgaagtctatcccattcaacttttgcagcagaatctattaaacattgttgaaataattttttggcataaaaatggggaaaaaatgttctattttctcggaaaaaacaagtttttagctatcacaaattgtaactctttttcctatttggtctccaaaatgatatcctttttgaccacatggatacagtaatgatatgtcattggctctacaaatttatctagtgggtataaatctgttaatttttttattcggttttcggataaacaataattctcgcagggggaatatcagcagttgaatcgcaaagcataaccgcataaacttcatttgtatgaagaagattataacaacagtaaatctgtagcgacacttgtatcgataaaacaagtctgttgtgaacacgaaaatttacggagattggaaatgccaaaaaaaaattatgaatttttccaaaaaaaatgggtgttccaattactcttttttgataactcacaaatttcctagaaactacaaaaaatctgaaaaaattcatgtaagagtaactttttatgctaaacagattagtcagttgcgctgcgataatcagaacactccttcagagtggtctgagaaccagaaaaatggcttaaaaccggggatattttggaacaaattcctaggcggcttgagtaacacccattttttgagaaaattttcatattttttttgacattagcaaactccttaaaatttcttgtacatgtttttctacataagcccattaattttccanattacagctaaagctaatgaatcgattttgtgcccaatttcttcgtccatcnngcttagttttgcctagggatttccaatctttcagcattttcgtctcactcatcattgaattactttttcttattcctcacttctt

SEQ ID NO: 41486 - DNA, 1337 bp, Heterodera glycines
aacagtgatcagaagaggtccgtttttcaaattttgttgggcttgggcgggcgcttcgcgaccggtttttaaatttgtttgcgccagacctgcccaattgccccgagcgcaagccgcgccgatagcacttcagacacatctgccattgcattagtggcccccccagcgttacgccccgtcgatcgatgcagacagcgtggtcgcattcagtgacgacgcctttaaattgcacaacgcgatctcgcgaacgagcaacaaataggcaatcatggtgggatctaatcctttttttcataggcccaacgccaaaggaacgctggcaaacggtcaacgccctacgcatctgtgtaaacgacgttacgcattccaatggtgcgtatatgataaaaggttcatctggtatgttgtaataaatagtgttccaccaacaacatcgcggctgtcggaatcggttgagcgaatcgacctagccatgactcctacaacgagtcgcgccccggtcccccactttccaattcaccagcagcgtcgcgtccgaattgttgatgtaagaggcgatggagcttgcttcttccggtgaatatattaatgcactaccaaattacaagttaccattatgtagggccattgtgttcgccattgttggccgtgacgatgtcaacatcgcattcaacttgcgtcagcaaatgtttactcttttgcgacaatttgttgacgacccaaactgtttcccgcgaggcttctatgccaatcgcgcgcgtttcatgcaatttattgaagcactccttttggacgatcaaatcaacaactttgacgcttacatcgcaagtcgggaaggcgcaactgcttgggcagacgcatctgatgctctgatcgcggccgtcttactcgggcagacaattgttgtcgtgtcacctgtagatcctgacaatgtccgccgtgctacgagcttttatgacgacaccgttcgccatacaattggagtgtttttcccagacggaaatcatatggtgacaaatattttcaaggcctacctcatattgctttaaaaacagagaatggagcaagactttccacatgatcagctgcaaaacttcactgtacatggtcatcaaggtcaacaaaggccggtacagaacccggttttgatatggtacaatggactcaaccacttccaaacaatcttggtcagtttctcagtgtatgtcaattggagctcagttcatttggtgtttcagggtcctgaacagctgaactaccctgccgcacacaacatcgtgacgaaccagcagtacgtgactccagcgcatctgttacaggatgctatggatgtcggg

SEQ ID NO: 41487 - DNA, 238 bp, Heterodera glycines
ctgcggacatctacatttttgaattgaaaaaaaattcgttattactctttctttttctccatattgaccatcatactcatactccccccacccttttcttcttccgccaccctccgccctctcttgatagtttaaactgaaggcgggaaacgacaatctgatccccatcaagctagcttctgcaggtcctgctcgagcggccgcccggggatcgatccccgatctagtacatagatga

SEQ ID NO: 41488 - DNA, 1335 bp, Heterodera glycines
aaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaaagaaaaagctggcggtgcccgagctgacactcattgagtcttaagccacgtgctaggccaagcacgggcactaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccagccaagcgaggcggcccgccaccgacacattgccacgcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagc

SEQ ID NO: 41489 - DNA, 1150 bp, Heterodera glycines
  misc_feature (1060)..(1060): n is a, c, g, or t
  misc_feature (1117)..(1117): n is a, c, g, or t
atttattagacattttcagggcaaaaaaaatctgtacttctagggaggggcaaaggaaatgtggttttcaataacaatattaaatttggcttccacaaaaaggaccgcattttgccctattcctcaaataatgcctttttccacccaaaacacgtgcctctgtcgaattgttgtcgcagttttctttgttgccggtgccacgggcggcgttcggtgtgtcctccgcaccggagccggcatgttcaggaagttcacgaggaccaccgctgacggagcaaaccctgggcccggcagcactgttctgcacaacaattcggctgccaccacccgctggcccgcctccgccggcctccacaagatggccgactccgccaatgacggcggaacccggtccagcagggccagtgttggtgctgttttcggtggagttttgcgtggacacgaagttggtcaacatatataatttttattgtggagttctatgttgtttaacggtaaatttttaaaagttcagcagaaaaatcccgtatttgtaaattatgtgatatgtgggattaaaacgcgagatcacactcagcaaaactttgagtataaatcaagggtacgcacgttcctttttgcctattttaattttgttttccaatatttctttggtactgaaatgtctattttcacggggactcaattttcccggtatccagatggcgtcatttcgatttttagacttagttcaccaccagttaggggtgaagcgcgaccgcgatatttggatccgcgatccacaacaatttggaactccttggcaattttggacgtttaaaaaaaattattaaaatttaacaaaataaagcctaagcttaagcctaggcccaagcaagcctaaacctagacttaacctaagcagttgtacgagttgttatgacaccaagtagggatcactagacttctacgcgtaaaaacaattgcccaaaaatggataattaagcaacaaaattttaaaattaaatacaaaatgacaaattaattattaaaagttggaccttagaaagcctcagataanttatgttggctttgttcttcattgttttggagcaaaaatacataatagacccctagntggtttacatatatttttgatgttaaatatttt

SEQ ID NO: 41490 - DNA, 940 bp, Heterodera glycines
cataaattgaaaattgccaaataatcaattttcactcccaccctagggtttaactcaatgataaattttaatttgtatcttttgcaagtaggcaatctgttttaattgttttcataaaaacatacttttttaattaaacgctgagacaaggaaatggccaataaaatccgcccattaattcgttaaataatttgattttttatttttttgccatatacaaaatcaattaatgcgcgtcattcagttatgaatattcattcgtataagtgtgtaaaacagagaagaaaaagccatgtcgctaattgattttaatgtatgtaaatttttagtgattatattaaataaattttttatttttatacaaaataaaattcattttcattttcgtttagaaatggatagcaaatttttcctttctatttttttatattttacattatatttctcttcaatagcatttgctaaactaccgaactcattatttggttagtttttttaaaaattaattttggactcagaaaaatgattaatcgaaagctttttactaattgcaaaaaaaaatttttgttcatgttttatataaaaaagaccacgaaatattcaaaaaaatatatttttgtggccatttttgccagattttatattttattgaaattttgcagaataaacaataccaagaacttaattttgttaataatgaaaaaattatggtttaaaattgcctggtgatgtattttgaccctgggctaaaaattaaataaattcttttttaaataaaactttttttctccgtccgttatccttatattaaattgcaccattttgattaaaacgtgaaaatgtttatcgaactttacgcttccaacaacgcttttcctttttgagatttgcataagcattgaaaagagaaggggtttaaaagacaaattaatcatttaca

SEQ ID NO: 41491 - DNA, 972 bp, Heterodera glycines
atattataaatttagttaacttaacaatagaatccatttacattaattatttgaattaaactttactttcattgataaatagttaaatagttttcatgcatttttttaattttaatccttatattgtaatagtgaatgcaatatttcatgaatttgtaagtttttaatttgaaatttttttaaattctataactttgatttattttattatagttagctcagcttggaaattggaccatttatattaattttaacacagttttttattgtcttaggtacatttttatttaatttgtttttattaaataaaataccgataaatttttttatattctttttggtaatttaaataaaaataccaataatcttttttattttttatattcttttgaaagttttatttgaaaaataaaatcttatatggtgtttaccttcaatttaattatattaactatttaatctttcatccaaattgaattaacaaatatgttttaaactcatctcacagtaacgggtacgccctgcttcactggctactgaagctccaacacaaatgagcggcttcatcattatgtaattttgttttttattacttttcaatataaaatatattttgtcaggagaatatttaatgaatttcattttctcattaagaatttcgtataatttaataaagtgaatattatgtaattcttaaaataattcaatcttttgcttagtttactctatattcttaaaagatatttttaaatgttttttttaatttcatacattaattttattttgtcaatctgcttattattagacatatttttaaactttgttattaattttttatattttttcataaatgtttagttcgttttttaattaattagatatttattttagcatatattatacctttatcttattttctgtataatttataagagcataattattggggattttgtatctatttaatccctt

SEQ ID NO: 41492 - DNA, 734 bp, Heterodera glycines
aaagtaactaacgtgacaacgcaattgtgacgaaaagccctttaaaacattgagcagaatacattttatttgtaaaattactatgcggcgaaataaatttttaattaaaaattggaatgaattgggaacaaaaattccatctcaaatttataatggacatatttaatgatgcaaaattaataaatatgatcatcagtgatgtttatctattttttattctttgatgattgagacaaaaaatggagaatatttttgattaataattgaactacttaaaagggaaattagacgccggtcgcagatcgagttcgcgtctcacctctggtgcccgattggcctaagatgaacaaattaaaagtgcggagaggacaaaatctcatcgaatcctttatcgcttccgcgacaggcaccgtgcatttattcattgaatatcctactgataggcgcagccagaaaaattttggattttttgcaatttagtaacagattttgcaccaaataatgccataagttgataaaaatttggtataaaacttcaaaaaattgcaacttttgaatgttttatttcgaatgctcattttcaaggacatcttgaattaaagaatattttcaagtgagagggcccaagtttccaggacgttcttggcattcaaggacgaatccgaaccctgctctaattccagtgtccaattttctggtgtccaattttctggtgtccaatttaccggtccccc

SEQ ID NO: 41493 - DNA, 1030 bp, Heterodera glycines
  misc_feature (646)..(646): n is a, c, g, or t
  misc_feature (662)..(662): n is a, c, g, or t
  misc_feature (675)..(675): n is a, c, g, or t
ccccgaaaacaaaaaaatcgattttttcaagtgtccgtctccccaagtcaaacaattatgggggagcaaaaatccaacgcacaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctanactttttggcctgttntaaaaggaattanaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaatttttggcatatttaaaaagcaattaaaaaatttttaaaattt

SEQ ID NO: 41494 - DNA, 557 bp, Heterodera glycines
gaaattttgataaaaagtctaaaaaaacacaaaaagaaaaagtccagaacaaaaaagtcttaaaaactcatttaaagattcttccatcttatttcaagtgcaatttacggggaccggtaaattggacaccaagcggaaaactggacagcgccagaattttggacaccgaaggaaaattggacaccggaaaactggacaccaagttcctaaaataaagccaggaattgggggtgaaaaataaatttatgaagggtaaatggattaatgaattaaggcacttagagaaaatcagtaaaaatttaatcattttacgttttcttgtttttttaatatttttctcttcacttttctttatttatttcatggcagctgtcccagacgagttggtccggcaactttgaattgtttaatatttttttataattttttattatatttataaatgcttaaatattattattttttaaacttttttaattgaaatttatttattttttctttttagatattatttttgatgcttatttttactcctaacttctctttattttaaatta

SEQ ID NO: 41495 - DNA, 629 bp, Heterodera glycines
ttccttttctttacattttggacacggctccgctcataaacaatttgttcccattgaggttcctgtcactcaaaacttttttttaaaattttcttttttcaatgcgctgagaatgtgtgaagccgccattcgtcaaagagaaagatgcgcaaacaaagcaaaacaaaacagagaggaaaatcgatgatgtttttgtgattttcaaggatttttttaagcgaaattgcattgccgacatttttttttgtaacggcatttttgtgttaataaaaaagcggcgtccaatcatttggattcataatcgcaaaaagttggtcgacctcctctctaacaaaaacctaaaattagagaccccgaaaaccttgggaaactgttttcatgaccataaaaattgtcaaaattaggggaaaattttggatcatttgacaaataaagaaaaataagaaatttgcaataggacatagggccgaaaacactaatcagcgtaaattgcaaaaaaatatacatgcatttaaggatgactcatacggacacattttttgggctcataaaccgcaccgaaaatgacagtaaatgtcaacaaaaactcgactgttacacgagcaaataattgttgttcacaacaagaa

SEQ ID NO: 41496 - DNA, 836 bp, Heterodera glycines
  misc_feature (24)..(24): n is a, c, g, or t
  misc_feature (31)..(31): n is a, c, g, or t
  misc_feature (34)..(34): n is a, c, g, or t
  misc_feature (38)..(38): n is a, c, g, or t
  misc_feature (40)..(40): n is a, c, g, or t
  misc_feature (63)..(63): n is a, c, g, or t
  misc_feature (71)..(71): n is a, c, g, or t
  misc_feature (89)..(89): n is a, c, g, or t
  misc_feature (91)..(91): n is a, c, g, or t
  misc_feature (112)..(112): n is a, c, g, or t
  misc_feature (114)..(115): n is a, c, g, or t
  misc_feature (117)..(118): n is a, c, g, or t
  misc_feature (120)..(120): n is a, c, g, or t
  misc_feature (786)..(786): n is a, c, g, or t
  misc_feature (811)..(811): n is a, c, g, or t
attttcatttcttttttacaattnttaatcnttnactntnaccatcatccaaaaaaacccttnaattcacnatttctttactttaaccntnaatttttaattaaattttttntnncnncnaatttctttgctttttaacagcgctcacaactgaaaattttaaaaatcggcgtaattattctcatttgggataaaaaattttaaatttgagtgtaacatgttaacagattttcattaaaaacgaccaatttgtgaatttaagcgaatttattaatgaaaaaataattttggaggcccggcggtgccaatagagcgcggccgggaaatttttttttgaaaattttcctcgattttttttttaatttgcatttctgttcttctataatcaagcaggtttcacaaaatattactgcaacatttttatttatctttatacccgtttcatttacttgaaattttatttatatttaaatttattcgatatatttgtgtctttttatgacatatttctagtctattgatgtctccaggttatcaactatttgactcaagttatctttcttttcttttgtattttgtattaggaaaaaattaatagtataactattgtccagttctcattgacttaatgcagttatgcttccttataaaagtcatttttaaacttacattgataatattggttttataatattttgtattaagaaaagttgatttacttcattttgataaaattttaatcataattttttggttttgttttatcattttgaagcatatttttanatagaagaggatatattttatttancaagttctttaaattaaatttgcat

SEQ ID NO: 41497 - DNA, 1040 bp, Heterodera glycines
aagcagcgccggccctctaccaaccactgaactcatcccttcataagcatctcgccaaattcctacccctcccatttgtgcctcatcgaaagcgtacacagcgaaaagtaaataaaattcaagacgaaaacgacaatacacaacattactgttagaacaacccataaaagccataggattggaattgaggggatttaacaaaagtggcattttgtctagaaaacaacaggttcaagtattttatcgagtaccgaaaaccttccaattcccacttttaaattttcattaaaatgagaaaaataaactaccacttttcggacggcgaattttgcggtcatcaaattttgcggtcatcaaagtaatggcacagcccactggaaaataccaaaaatttaactatttaagaaccaagcaattgaattaaatataaaaaaagtcggaagtcagggtcacatgggttcctttctagagaccggaattttgaaaaagatagacccggatttcagagtcgaacccggacagtatttcgtgataaactgtgttttctttgttattgcgcgcatcacctaacttaaaaagtcaaacccacaaaaacctttccaaatgcaaaggtaaatgaacccttttaatagtaaacggccgccatttagagaatttgtctgaatttgttgtatttgcgccgctaaataattttgttgatttttatgggagtaccattattttcaataaaaaatcatttttttgggcggggcaaggtaaatacgtaatctactagcagtataagacattttgtttcatattccatggacgaaaaaaaatgccgaacctccataaaagatgaagcttgacacgcctttgcgcctgtcctcagtcacatgagacggttgcgctgggtctttggtcaattcgttgcgatacgcgtcaaagttggggaattggacatcgttgtgcactgcttgacgaccaagcggaagcgcgttgaccgactgttttcgaaggttgtgcaacagcagaattgacgacgaattgggcaacataat

SEQ ID NO: 41498 - DNA, 1011 bp, Heterodera glycines
ttacaaaaaaaagaatgtgtggagggcattgaaccaacccccactagtgatcaacgatcgcttaggaaaatcagtggtcgactgctcagaacaatgggacaaatctgcgcagtccgtagccttccgattcgtacttttttgcccggctttgctgggaagcgtcgaacaatgatttgtaaatgccttgagtgattacaattaatagccagtcaaccattttgctaattgaattgggttttccttcgaccacttacggctcaggtgaagattgtccgggttctgcgcaaatggcactcggacgacaagccttcgcttctgtttggcttcgccggatgcagtcgccggcactgaaattgggctgtcctcctccgtctcttccgcttcgtcgtcagttggttcagcagaaagagcggccgctgggggcgaacggaacggactgaaacttggcgccagccccgaggccgatctccacaggggcaggtgcaactgctggtggtgctgctcgtccagcaagtcggccatggaagtgaacactctgccaaaatcaaaaatgaatggaggggaaaggggagaatgaccgactgacctcgcattactcactgcgatcagtgacagcggaataagtaaagccaaggccggcattgtgattctgcaatgactgaacgacagcgacgactttggcattttggacgggcaaaagtatggggaaagcgagaccactgaataattctaagtttaacggaattgacgaaattacaagtggagggggggggaggaaaaaaccaaacggagggaaaaggaaaatggacgaatgaacgacggaacagaccaaaggacagaagcgaaatgaaaagcaaagaatcacacggtaaaaggagtgttcagtgtgtgaattcaaattccttttcatttgtcacttttcccaactttcgagggaaagcggcggacgaaagggtcaaagagaggcggacaaaagccaatgaatgccatcactttggctcctgctagaaa

SEQ ID NO: 41499 - DNA, 1074 bp, Heterodera glycines
aaaacaaatcggagtaattaatttaatctgactttatagataaatgggaattaaagcgaaggattcatgcagaattataatctatagaaatcttctaaaaagtagttcctcgcagattctgggaccgtttctataaagctagagacatatgcgctaactataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatgcagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcgactaaatttgctaatcgatttatggtgtacaggatgtttgtcgaaacaaaactcgtcaggcctttaagatagacctgccattgctattcctgcaaatatggagtctagtcagcccaatcgattgctattcgaatggtttggggtcgttggcccaaacaaaagtggtgctacttcttgcaaagaagacttagcctactgtaaacagcaagccaatcaaatgcttcaatgtaaaaaaaaattacatttggatgcaacctttatttttcctcgcctctcttttcgaaaagaaaagctattagcaagcgtggttggaccattctaaaacaatcggggtaattatttaatctgac

SEQ ID NO: 41500 - DNA, 881 bp, Heterodera glycines
aaaaaaaaaaaattgattttttcaaggggtcccgttgggggtctccaaacaatttgggggagccaaaaatccagcgccagaattaaagttcagggctatagggaagttttccccgaaggattcggttctccccataaatctggggcgcatgacttcgggaaaaactcccccgaaaacaaaaataaatcgatttttcaagtgtccgttgggggtactcaaacaattatggggagcaaaaatccaacgcagaattaaagtacaggctatagggaatctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgaaggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaatcaataaagatttcaagtgtccgtttggggtactcaaac

SEQ ID NO: 41501 - DNA, 141 bp, Heterodera glycines
aagctgctgtcgcagttcaaagccaacgactccggcaacgccccggtcctgctgatgctgggcggcttcaagttcagcctcaacaccgcggtcttccgggagatccagcagtccaacgagtatcgctggcaggcgcaggac

SEQ ID NO: 41502 - DNA, 1100 bp, Heterodera glycines
ttttgagcgtaattacgatttttacttgaccatttttttctaggcttagatcacatgcgattttcggcactctgataattttagcgctcataatgggatgtataaaggcgattgtagaaggaattggaagcgttaaaattgtttgagaagctttttgagcgtaattacgatttttacttagaccatttttttctaggcttagatcacatgcgattttcggcactctgataattttagcgctcataatgggatgtataaaggcgattgtagaaggaatggaagcgctaaaattgttgagaagcttttgagcgtaatacgattttacttagaccattttttctaggcttagatcacatgcgattttcggcactctgataattttagcgctcataatgggatgtataaaggcgattgtagaaggaattggaagcgttaaaattgtttgagaagctttttgagcgtaattacgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgttaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcctaatgggatgtataaaggccattggagaaagaattggaagcgctgaaattggttgagaagctttttgagcggaattacgatttttacttagaccatttttt

SEQ ID NO: 41503 - DNA, 552 bp, Heterodera glycines
taaaattttttgatttggtgaaggtttttagtgcatataaaagcatattttgggggtttttgagaataaatgcatattttgccacttttccatttttagagcatatttcggtcatttttggcaaattttcataagaaaaatgcgaaaaaagcgaaaaatacacccctaaggatggattttttgagaatttataaaaaatacctttaaaaatcgaaaaattttgaactttttgtgaaaatttttgaaaaaaattgtcaatataaaaatgtaattttgttttagcataaaataaaaattctaaattctaaatttcatataaaaagttttaaaattaaaatgttttgtaattgtctgaaaacgctctttagtcattgttttggtgtttttaaagtcaattctgaatttttacacaatttttggcatttttttgagggttaaaaaccatttttggcagtttttaaggcatattttagtgcatatttaggcatttttcgggtttttagagcatatttgagggatttttagtgcatattttatgcgcatatttggcat

SEQ ID NO: 41504 - DNA, 1021 bp, Heterodera glycines
  misc_feature (51)..(51): n is a, c, g, or t
aaatttaaataattacgaattaatttgttttggcttttctccctatatttntggcttgtattttttaatttgttgatgtgtgcttctttagttttgtgtgtctgcggtagggccgaaacacactttttttcttattttttgttttcttttggaagagcaccgcactgacgaggcccactcttccattagaaatttttataacaaaaaaaatttttttcatttaattttttctcaggaattgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtcccactgcgatcccaaagggtcctcctctctttggttatggtcagttgcccgaactgcttggtgcttttgatgggccaaatgcaatttcttcggctggccacgcgttgtcccaatggttgcacactccgagagaaaatggccaacagaagcgattgctttgtattcagggctggacgtaattacggattacgtattacggaaattacggcctttttggagttacggattacggattacggatttttgggatttttccgtaattttgatccgtaactggctttttagattatttttcgagacgatttcttgcaagattattttttataaaatgaatttttttttctatttttattaaaaggctacccatatttcgatttaatctgacttattcttggtaatttgtagtattattaacatacataatggggagggaggctagcaaaggggaaaagaggaaatgctaaaaatttggctattttttaacaaaatcgttaaaattctgaaaaaaattttcctcggcggcgcttatcggcaccgcccgccccaaaaattcctaattatttttaaatattagctccaaaatcttagtcatttttagacaaaatcttatagcgaattgcataaaatttttcaaaaattttt

SEQ ID NO: 41505 - DNA, 1215 bp, Heterodera glycines
aaaaaatggggggggcgttcaaaatgccaaccattcaaaaaacggagtgagtgccaaaaacaaaaatatcatcctttcttccctaaaatgtcccatcgcataaaacattggctgcttgtagaactcgccagctctggcattcacaatgatctgcaaaaaaaaaaaacaatagtgtgccaattacaaattgaaaaatggaccggcgctacagtaacccgatgtgtctttttggattacggtatgggggaatcaaacattcattaatgatttaattactatatatagtgatgctcgagaccaaaattccccacattcaaactctcgagactggtggccccaaaaatttcgacagactttcccgagttaagacgcaaaaacaaaaaaaaaaaaaaacgggagactctcgagcaccacctaataattggagttcgaatacaggtcggaccgtccgtccgtatatgggtttttacgggcgcgcaacccgtattttttcggcacagactcgagttttttagcacctgtaagtccgtatctgctatttgttcgacatggcctatggatctatcaaacccgtaagtccgtaccccgtataggttgcccagtccgtaacccttacccctcttcgtaaattcgaaaaatttcgacaaataaaacaattttttttataatttaataatacggaaaatattttcctttttacgctcatagaaatattttaatttttgataaataatatattttcatttttatttaaaattatttaatctattttttgtatgaaaattaaaaaatccttctcctttatacacgcataaattcgacttaatgtttttcttaccggagagtcaacaaaattccgtgccaaattgggcccgccctccaaatccaaaccttgaaaatttaatttaaaaaattaaattaaaattattatttttatatatttttaaaaaatggttttacacatattccagtcagtccatccgaccacccaattgcgcaaatcgttgagaatgtcgcgggcataagctcggccccgggaccaatcgcccagcaaaacttttgtgctcaaaaacttcatagccccgtgcacgccttagggcaaaagaaaattggggacaatttaaatttaatttttattgcaaaaacaaattggcattccgttcatacaaaaaattgccgggatttttaaaatgggtaaatttaattcccgccttg

SEQ ID NO: 41506 - DNA, 1236 bp, Heterodera glycines
tagggcattgggtggcttttgagaggaagaagacccgatgaacaaaatgagaacgtttctaattttctcttccaattaaaagaaaattctttggaacatgaattttttctttttgttttcaaccgcaattgatcgtttttttaaattgttttgaattttttagttgttgatctttggcgggtgaattaaaaaatgcttacaaaattaatgagggatgtcattaaacttgaaatcaatcagtcacatttaaattacttaatttacataaaaataatggaggacaaataaataggggtaaaagaaaaggaaaaggcaacgcacggataattataaaagaagccctatggaaaaaaggaaatatccaaataatttaatgaattattgctgggggaggggaccaaaaaacaaaacgaaaattaacaacaaaaaggaggtggtcagttcaaaagtggagaaaaaggggaaggtgagttagattttaccagcaaatttataattaaatatgcaatacagcccaaacgcagcagtctgatcattctgaagagagagaaacattgggagaatggaaggagaaagacaatgatggatgtgttgcgacgaaattggcaaattatgatgcaccaaagtccaaaggatacgacttagtgaaaaacgtcaatttgcttgctaatgactttggtgcataatttgacaaagagagaatggcgaaagaggaggaataaaccgaatgaacatcgctgacaagagaagcgaaaggactgttgcatttccaacttaacagtaacagtacctaaggttggggtgccggaggaaaatgtgtggaattatgcgtgcgcatatttcgtctttgggatgagttgttgcccgtttttgcgttgtccaccagctcacaatcagacatgcacctgggtctcgcgattagcctgtctctgatggtaaagaagcatgtcctgcccgttgccgcccgtcatcatgttcaagccgctcatcagtgccgttccgcctccacccgtggtccctcctccgcccacacctccgacaattgttggcggagtcccattgacaaagtgtgccaagttgtgaccgctcgcttccaaacgctgactgattcgtgcgatcatcggcgccattcggttcatcatcagaaagtgttcgttgactgtgcgaacgtcacgcgcgctgtcattgcgtgacaaataggtggccgtctgcagcggcgtcttcggtgccccgcgg

SEQ ID NO: 41507 - DNA, 1517 bp, Heterodera glycines
  misc_feature (158)..(158): n is a, c, g, or t
  misc_feature (164)..(164): n is a, c, g, or t
  misc_feature (177)..(177): n is a, c, g, or t
  misc_feature (213)..(213): n is a, c, g, or t
  misc_feature (1391)..(1391): n is a, c, g, or t
  misc_feature (1512)..(1512): n is a, c, g, or t
attttttcagttttaagtgcttatttttgtcattttagatttttggaaacggtcaaaacgactgtttttggggatccaatcgaaacggctaaagtaaaatttgggctgggacttattattttattctaattgtaagcagtaaaattgtctttgtcatntcattntagcctttgcttntaaaaatttccattttaattctttcaattttggatntaacattgggttgtgatcagtggtgatcagaccaaaaagaattaaatgtcccctaaaaggtgtgctttccctccgtcatttacctcatccaaaataacctttattacgtcgctctttcaaatttggaatcgacgacttttttggttggatatttttggttcattaatttcttctctgttttcccttcgccgctcctttcaggtcatttaccagctcaaaattctgaccacggcactgcttctccgcttttttctaagttttcttctgtaaatcctttttttttgtcccattttcaattcttttagaaaaaatgctttccccggcccaatggttggctttgcttctcctggtcagtcagtcggtccattcggtcgtcctttcccgttggcttttcctttccccccccccttaggtggtcggtgttagcattgtccaatctcagtacgatccccctccctcgtcccacttaaaatccgttcaaaatccgttgctcggcttcgtcgccgtcgtcgccatgtgtttcacttcttcctttgctggttaaaatattcaaaattcgggctgtttgtcagctaacgtttgctcttctgaaggtgtttacctcgaattggtgctaaagcaaagcaaagtaattaatggccgggggaagggacttaagaaagcgactgatgaaacaaattaaggtcgatgtttggatgcagaacattcggatggcattgtttggccttttcatcggtttggcattggtattggccaaagaccgagaacaaattcaaaaaggttggaaatgaaaaatgaaaaaagcaaccagcaaatgagcatgagctaatacaattaagaaggggctttcatcggttacgaccctttggtttggctaatgaccgtcaacaattcccttggggggctgctaattgcgagtgagtaaacaaagcaaatttatttaaccaacaaattcagtggtgattaaatatgcggataatatcatggtactatcgtctttttcctccttttctccccttaattcgttctctttcccttcagaaggcatatgcccaagtcagtgtttattccccaagggcactgatcaaaaatcgctttttgatcaatgcttttttgcctaggcaacggccattttgggcgccgccttcggctcttggcttttcttcaattttgtcccnaaattgcctcttcgcctttggtactgcgctggtgacactttccgtataccttttcaacagatttccaccaaagcgaaaggaatcaaaggattcaaatttttatttggcacttccaaattgntaaga

SEQ ID NO: 41508 - DNA, 1215 bp, Heterodera glycines
  misc_feature (72)..(72): n is a, c, g, or t
aggcatattgcacaatacataaatgtagagcagctcaaaatagaggaataccaaagattaaaaattcgtgtntatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactgctttggctggacataactcgccagagagtggagatagaccctttgttgttacatttgaaaatgtagagctcggctagcgcattcgaataacacaaaatttgttttcatttgcccccaaacaatccgcttatgacgggccgaaagaaaattcacaaaatttggcaccggaaaaactccatttttt

SEQ ID NO: 41509 - DNA, 248 bp, Heterodera glycines
aatttaaaatgaattttttaaataatttaaaaaaagttaccgaattaatggaaagcaatgtctcctcgtcaagatgcaatttattactgttgggaacatattgaagggaattttctgtcttataataaaaaagagccaagaaaatttttatttttttccgggaaaaatttttaatttagaaattctttaaatttaatttatcaattttcgattataaattggttgattacattttgtcaattttcaaa

SEQ ID NO: 41510 - DNA, 443 bp, Heterodera glycines
aacgggcacaggacttggccgaagaaggaggacttgccgaaatgatggacatttttcgcactaccacggcagccgaacgaacggaggcggtggaacgttgaagggtgaaaatgacatttttaaaattttcactgactgatcaaatgaaaaaaaaggaaattcattttcatatagcaaaacgacggacgaccaacagcagcagcagatggacacggcactgacaatgatgagagggaattgcggctcacaaacaatcggacggatgtgattttatattcgatcattttccatgtatggatacgtactacatatgtatgttttatcgccatatatattttgatattttgcttgtcacgctcgatatttgctgctgctctgattgtacatatgttttgtattattgtgcctaacaacattaaatactcgataaataaattgtttgt

SEQ ID NO: 41511 - DNA, 840 bp, Heterodera glycines
  misc_feature (42)..(42): n is a, c, g, or t
  misc_feature (84)..(84): n is a, c, g, or t
  misc_feature (124)..(124): n is a, c, g, or t
  misc_feature (128)..(128): n is a, c, g, or t
  misc_feature (135)..(135): n is a, c, g, or t
cagaaaacaaaatgagacggaaaatgaatggcaaagaaaaantggagggaaaagaaaatgaatttggaaggggcgaaagaccanaagggacaaaagtgtacaaccacaggtggaggaacactgncgancggcagnagcgaataatggcacagaaagggaattggtggacgggggggggggacagtcgtcaaggagacaaacggacaaagttggcaacaaaatgtgaagcgggcgacactcagtgggccaaatggaagggttaattgtttaattggtgaggggggaaaagggtggaggcaaatgccgagacaaacggacaatgtcaaaatataacaaaaagcaaatatgatagggatttattcttagttttcttatttaagtcattatgagaagttaggtgaaacatacgtattatgataaaattgataaggactttagataggaactgaacacagttaataaatgggtctttagtcggtccgtctttcgcttcgtcactttttcgtccttcgatttgtccaatcatttcgacggctgctccaatttcgcggcgaaattgacgagcgaagttccaaggtccttcagaagcgcggccatcaactggcggttgacttcttcgctttgctgacacgaaacgcacggaccctttcctaaaagtttccgcgttaacgtatcgttatgcattgtgtccaccaccggcgataccaacggatgtaagggtggtcggagtgacaccaacggaaaacgtatcccttcttgatttcacgaatgggcggcgacaagtcaacttcagcggggggtgggcatgggccacttcaattttgcacggggtgggtcaga

SEQ ID NO: 41512 - DNA, 1292 bp, Heterodera glycines
  misc_feature (60)..(61): n is a, c, g, or t
  misc_feature (950)..(950): n is a, c, g, or t
gtgataaaaaactcaaataaatcccataaaattctccttattttgctctatggtaaggcnnttgggcctgtaaaattgatcaacccttcgatttgttatgaatttccaaatattaggtcaaaatcccgagggccaaaaaattgccaaaaaataaagaatttttaaaaaattccaaaaattctgaaacggaaaacaaaggtcatattcgtgctcagcaccttaatttaccccagaaaaatattttttacccccattttcaacccaaaaaaaattttcgaaaatttctagggggcctagctcgaaaatttttgaaaattttacatcatgtagtacaccgttcgatagagcttaaaaagctctacaattttgctctaaggcattttttggctaaaaccaactcctgacgagttatgggcccgggactcaaatgtcccgctcaggccaaaaattttttctatttccgggaaaaaatcgaaatttttccgaaaaaaataccagtcgatagagctcgaaaaactgttgcttggaagtggtcttcgtttttctgggaaaaatcgttaaaaaatcctaaaattcaaaaacccgaaaaccgttttttaggcctagctcgaaaaattttgaaaattttcgaaatttttaaaaatcgcaaaaatcgagctccatcgagctcctcacaataggtctcgccggccaccccgcgctcaggtcaaagcctaatcgagttatctcaacggggactcgaactcggacaaagttggtactcgaatttttcgtagaagcacacaggccagggggttagagatagaggcctcggaattttttttaactctttagccaacactctcactcacagcgagcatcttttcgatttgagttttaggaaaaaagttatcgggccccaaactcgcgagaaaaagtaagaaaatcctttccctcggggactcagtcgntccgcgctcgaattttttttctaatagttttcccggatcgcgccgtgaaaagttgtaagaaccaatcgcacaacttttcagaacccctcaccgatagccgttctcgagattttggttttaagggatgagtttgccttggtcaatattaacatcatatatcaactaagggtggcacagtttggctattggtggtgcatggcgtggcttgggtaatatatggccctcatttgttattttaaaacattaattgcatctagtgtgatgttttaaagcgcttcgggctattggtgagaacgcggctaagcccgcgtcgctagaaagtgatgtaatttagaaattcat

SEQ ID NO: 41513 - DNA, 132 bp, Heterodera glycines
ccgtctccagcggcgcaaccagcggtggtgccagtacgctcgaccaggctgccgcagcagcacgtgcacagatggacgcggccagcaatgtaccggccaccgacatcaagttctgcgcgattgacgatcccg

SEQ ID NO: 41514 - DNA, 1181 bp, Heterodera glycines
ctgtcgaatgtcctttgctgtcgaaaagtccggcccccccattttacctattaaattaatatgtaacaaaaatcaaagcaattataattaattaaaatttaaaagatttccatgaaattggaaagtgaacaacaaaactatgagatattaacatataagtaattatttaaaagattgagttatgcatatgtttatatttttaatttaaaagaaattttattaaatattatttagttattttatgatttacgaaattctctcaaaaataatgaaatttgaatctgagatccatttaaaaaatataattatgctcaacaatttataaaaatttgattgcttttgtgctaatattgtgattttaaaatatatttggcgttttgttatttaatttgtttcatttttgtttgtgatttttgtgaagtgttagttgttagtttatgctgtcgtcagtttttattgattgtcttcgccttaatttatttgaaataaataattatcttcggcattgggctgtattgttttgtgtttgctttgggctgttgtcttttgctgtgtgcagtgcaacaacattattaaaagctcctgacaacaatcctcttctgttttgtacgacttggcgctcctggcaccggtgaatcagcagtggataaaaagcaaattggacgagcctcgaacttaaaatagggaaattaaatccctcgaccttcttgaaaaatcggaaaaagggaaaaaaaattccaacaagagaagagcctaatcaaccgactgtggacagctaaaaattgtaatcgggtaaagtaaaacccacgaacagacgagccatagcgatagaagtgactgaaaaacgggacacaaatccctcaaatttcaacggactgtcgaaaaaaaggggtgaacaaaaacccggaaaacgaatcaagaagcagacgaacaagacggaattttttttgaaaacgggaaaagcaaatccctcttcacttcaaatctcagcatcgggaaaggaaattgtgaaacaaatcacaaaatttgtcagttcggtaaaatccttcgacaaaactgactctcaaacagggaaactaatcccatttcgacatgcagcaacttctccaaaacaaaacatcggacaaagggcatcggatggaacaccgcagaagcaagaagacacaaattggcgcgttgga

SEQ ID NO: 41515 - DNA, 1437 bp, Heterodera glycines
atcaaaataattgtaatttgacatcgctgagcgtctcacaatcagcgaaaagcccatctttttaaataggaggttttcaatcctgtaaattgttagtatttttgaagcgagttcaaaaaatccagctgtcgttgggttttgcaattcaagcaattaaaaaatttgaatttaatttttaaataaacgcaatttggcttctcgaaacttcccgatcaaaactgaaccaactaacaaataagtccgtcgcgtttgcgttatttcatccctcttaccttcctttttttttgtttcgcttacatctgtttactgatctgttaatgaacgacctttttggatcaaggacagagacgtttggtggatctttcctttctcgcttcacttctctcttcgatcgcttaggattttcatctttcctttataatcatcttcggttgactcctcataaaattggctaattcttccaacaatttagattctgatttaaatttttttgatctccacaaatatgggcaaggactactataaaatccttggcttatccaagggagcctcggaggacgacataaaaaaggcatatcggaaaatggcgctaaaataccatccggacaaaaacaaagaggcaggggccgagaataggtttaaggtactcttttgcttttcaccaaatgcagttttaaataaactaatccgttttttatgatgtggcggaagcatatgatgtgttgtcagaccctaagaagaaggaaatttacgacaaatttggcgaggaaggtctgaaggctgatggtgctgctgggcagggagcgcctggtcgtgcgggcggataccattacacattccagtgggtttaatcttctttattttgattttctattaaacattgtggtctaacagtcactaatcgttttttaataaaataaaaaaacatgttgaattctttgagattgcatgaaacgccttaaacagtctgtctttattaatctcctgcaatagttgccagttatatacatgaaaaatctctaaacaaagttcacttccaattttgttctaccattttcaggggtgatccgatgcaaatgttcgcgcaagcattcggtggaccaaacggaatgttcagcgagttcacttttggtggtggtggtggtggaccggaggtcgaaaaatgaccattctcgcaatcaaattttaattattcagaatttcaggtgattttcggtggtggtggtggaggtggcgacgacttattcggcgggttgggcggtttcggtggcttcggaatgccgcgacagcagcagcggatcaggcaggacacggcggtgacacacgaattgcccatcagtttggaggacctgtgcaaagggtgcacaaaaaaaatgaagatcaccaagtcagtgggaggagtttgtttactcaccagttaggagtttagcaaaatat

SEQ ID NO: 41516 - DNA, 657 bp, Heterodera glycines
aaaattataccacaaaatacagtgtaagaacgaaaaagttcgccgacagggaaaaattaaactcaaaaaattcacggtcacatttcacgggttttctcagtcacggcgcacctctactaattggataacgaaaaatccaattgcaaatgcgtcaaaattgagcaatggaaatatgaaacgagcaaagagtgtattctgaaatgattaatatttaagtttaattattaaacatttaatatgctgaccaaaataaagcagatgagttcacttgccatgagaaaactgacagaaaattcaattttttcgtttgtgccgaaactaattatttaaatttacattatttaatgcgtcaatgccaaaaactcgttaaaatttggttttaataaaaggcaagactttgtgttgatcgtgtccaaatgatcagcccaatcaatacgtatgacagaaaatcggcaaaatataaactaaaactgctaatgtcaatgtaagaagcagtttccgattgatggttagggttaatttggccagtaaatttctaaagcatcgttcatcactaatctttttgaataatttttttaattactcgctacgcagaagaacgcacgacaaacgtcatggccattctcacaaagaaagaatcttttgattgcttgccat

SEQ ID NO: 41517 - DNA, 1042 bp, Heterodera glycines
ccccccccccaccgccaaactattcaaagagtataaaagatcgctccagggaagaagccgaccgccgaccgactgactgactgtgaaagaatgaatgggaaaagaatgaatgggaggacggcggacggacgtacggacggattaggatgggcattgtctggggaatttgggttgggagcgattcggcttttgggattgggttgcaatttggagcgaatttatttacgcatgccctcgaaattgggagaatcggcttctccgcaatgatccatccaaaagtatgcattaacacgctaattactcatcggcagtcgaaatcatctccaatcaacctcaacaacagctgcccaatcgtcagaaacacaattagcaactaatttacattaaacaaacaaatgcagttttttgttgaattttctttttttttgtccgtccgttagtcaaaaattcacaaaatgatttccttaaaaatcaatttttgattgagcaaagaccgaagggccatcgatcactccgatcgatcagctcagtgagccgttgtaattttaattcattcagcagcttaaaatccattgctgctgaaatggcagttgaccacagttcaaaagcgatttgtgacgacagtcgcattcagacaattgtcctctatcggcccccccaaagtcaaacggaccaatgccccgccggtgacaatggccaaaagcagcgccttaagcgatgccgttcttccgctgaacttggcttcaccatcgtcggcggcattgattcgcctcgggggcccatgggaatatttgtgaagaccattttcccgcatggaatcgcttcgaaaagcggactgttgcaaaagggtaaatccgttcaaactgcggggggggggggagacttcaaaaagatgtttatttctttcaacaggtgacgaattgctaagtgtgggcaacatttcgttggttgggatgactcacgctgaatcacttcaggcatttcggaaaatggccaaaggccgagaagtgatcatttgcattcggagggggcaaaaagaaaa

SEQ ID NO: 41518 - DNA, 1038 bp, Heterodera glycines
cagcggagcggagacagcacagcaggcgaggggcggagagtgtggggcatcaaaagcaaagaggaggaggaaacgagagaatcagaggacggcggagaaagtacagctagccaaacggaagagacggagaaagacaaagtccaactgatcggccacgcggtgcccagggacggagagctgtgatcgaaattcagaattctatacatgcatatatttatttatttattcattatgtgaagaccaccatcctgttacttttagtttcatttgtcagttgtttctttcctatctcgtccacatccatttttctgatttcgatacatttctaacttcgggaaaattgtttttcactttatgatatttaaatttatgaaaatctgatacctagcacataatttggaaggatcttttggaatggggaggggcaaatttacaaatagatgaaaatggcacaactgttccaaaaaaattttaaaaaattgcttccatcggttcgtcccttattcttttccactgttttccgctagccattgtctgtacgtcttggcctccgtcgccatttcagtggcactgcgtgccgttctctcattctcgtgcccctgcagttcggtgtaaaaacggtccatgtctccgccaaaatcgctggccttgcgcggcaccacgtgcacatggacgtgctgaaaattaaagaccatggaatggaattatcattcttgcccttcatacctccaccgtttggccggcgtgcggaccgtcctggacagcctgggtgaacgaatcggtcccgtagatatttgtcaacattttctgaacttttttggccaccacaaacaagtcggctgtttccgcgtcgctcagttcggtaagtcggcgagcgacacgcagcggagcgaccaaaatatctgcgaatttgtaaaaatgtaatggatggtggggtgggggaataaagcattacataagcaacggcgtaaagccataatttaaattttgaacaattcatatgggaaaaaaacagagaggctcataagaacgaaagta

SEQ ID NO: 41519 - DNA, 604 bp, Heterodera glycines
attgtcctaaaaagagatagccatttttctgacccccaagcacaatttccgcagctcttgcggtaatggaaaacttttgaagaggctatgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgtggaacggattaacatcggggttacgagatagaaaattgtcctaaaaagagatagccatttttctgagaattaattcacaatttccgcaactcttgcggtaatggaaaaaattttgaagaggctctgcggaac

SEQ ID NO: 41520 - DNA, 825 bp, Heterodera glycines
tgcgttggttggcattgtgttgaacggcacagttttggtggtcactgccaaatccaggcaaatgccatggcatttttaaattacaatttaattaatttctgtttaccaatttaattcaatttctcatttttcagttccctccgcggctccgccaattttttgatggcactgatttgtctttgtgaattggtccaccaaattgggcacactttttttctggttgttgtcatttcgggcacaaattttgtcagtttgctcactgctgacttaattatgacgttaaatttaattttaaatatttttttatttttaattaacgcccacaaaaccctaattaacaccaattaatcctttccatttaagcctaattaaaactttaattatttatttaatttgttttttagacactcctccattttcacccaatacaaaaaatgcgggaatgtatggcgcaattcaaaaataactaaatttaattaattaattattaaatttaaaatttatttaagtccaaccaccggtgttgtggccgaaactttgctgggccccgttggttataaattcttcgccggcacattcattatttcattgggtagcacctgttgttatgtgtccatttttatgttcatccgatgcaaaaatggcggtaagttttggcattcatttgtttggcattttattttgtgccaaaattaaatctaaatgtttttacagtaacccaacagacgaacacacgagttttacggtcattggttatcattttgtccattaacattggcggatatttgttcaattcggcgatgtatcaattgttatacgcatttg

SEQ ID NO: 41521 - DNA, 659 bp, Heterodera glycines
caatttttatcatgaaattgcaagaattaaatttggctttggaataaatgtgccaatttgtgtgcccacctgaacgccgcccggtacaacccttcgatggtcaaatcgtatggactctgttggctcaggtcgtacgccatttcttcctgaacgctcaaaacgtcccaggacttcagtgccggctgaacgaactcgccaagaacggagatcgcaacgggagacattgtacgaggcttaatttgaaaaatatacaaaattttcagggcgtaacagggggaaagtggcaaataaataatacacatcatgaaaccccaactttcttgaaaaaataaaacaaaatttggttcaaaaaccacaaaagtctattttggaccaaaaacagaaaagttgacacaatttggcgcaaagttgggaagcagtctgaaaaaatgaaatttgaaaaacaaatggaaaattgaacctaattttagcgggcttggtaataacggagtacaaaaaaagtattcataaaatccaattggaaaattggggtcacctttttcacatcgtccgcagtcactgtcttcagaagggcaatgaaatcgtcgggtgtcagtgcggtgccctggccaacaattgggacgcctgggattatgaaaaaaaatcaataaaaataatgg

SEQ ID NO: 41522 - DNA, 1180 bp, Heterodera glycines
  misc_feature (59)..(59): n is a, c, g, or t
  misc_feature (66)..(67): n is a, c, g, or t
  misc_feature (1171)..(1171): n is a, c, g, or t
atttgataggcgtatcagggggttgttggcttgtcaccttttaagggattggacggagnataaaanngggagggaagccttactactaccaaaaacagtcctcaaaacgtaaaatttggtcttttttttgaaaaatctgttaaacaaaaggaattaaaatttttaaatttttcctccccccaaaaagtttttttttgaaaaagtgagccgcaaaaaagtgccgtgaaaaacaataaaaaatcttgccgtgttcgacatgattataacttctccaataatgttaaaattggtaatgagtgggctgaaaatataatatttggcacatttttgtttttaaataaattgtaaaataacccagttttacaaattgttaagatttttgactcaaaaaactgttatttgagccctaagttctaattttgtcgaattatttttcaatggcacgactttttcacagtttatgcaaaaaataaattaatttaaatcggctggaaaactattggttatagaaagtgatttcgatcacttaatactcaaattcatagccaaattttggtacattaaaataaaatatgttttttaaatcattaaaaaatgaatgagcgtcaagcatattgaccatatttatttataatttgggtaaacaaattgggcgaatgcgtttcgatcagttttttgttttttgttattcctatcatgatttgagttacacgaagcgtaatatttgattttttgattgaataaattgtaaaataacacagtttttgacccaaaaatctgattttttgatcccgaagttccgatttcgaacattgttcgtgacacctctgaattatgtcccatctttaagttaaataattaaaattattttattttatttcatatatttttcagtcttttggtgaaaaattttgattaataatttatatgaaaaaaaaaatttgttttttgacggaaaaaattaatcggcaaaatttatttttcgcacatattttggtgtttagttcatattttactcttttttatgcaaatattccaagccttacttactgaagccaacaaatttattcgtgcaagaaaattgcaattattcgcatgttagcaagaattttttgagttgacaatgagcggggcggcgggagggcgagggggagtttattaaattcaccanaaaattatg

SEQ ID NO: 41523 - DNA, 1642 bp, Heterodera glycines
tcactaaaaagttaagcctaaactttttcccaaagtttcatagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaataaaaaaatcgattttttcaagtgtacgtttaggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgataagtttctgaaaaaaaaagttaagcctaaactttttgggctgtttaaaaaggaattaaaaatttttaaaaattttattcatctccctttttgatagaaaaagcatcagagtgcctaaactaaca

SEQ ID NO: 41524 - DNA, 935 bp, Heterodera glycines
  misc_feature (14)..(14): n is a, c, g, or t
  misc_feature (19)..(19): n is a, c, g, or t
cccccccccccccncaganaatcaacgggggatgaagtgacaatctgagggtggacataaaactgacggactgaaattgtaaggaagcggccaatttaacagacgccactgaacaaacgatggctggggccacagaaacgaaaagtgcgctggacactctcagcagcgaattggactccgttttgaccacaacaaaggattttgagaaccaagttggcagaaaaaatagtcataaatacgagaagacaattaataattaggcaatttccgacgcggaacgttccaacgaagtcgcgaaaaaagcgactctctccgaagcgactgcaaattcactgcaggaaaagctgagtgactcggacacaaaacttacggaagcattggcccaactcagtcaattgatttgcgtttgttttgtcgaaattttatttttattttaggttccttagacaatgtggacgatgcgcaattggacaccgtggagaaactgctgaaagaagcggaaaatcgtttcgattcgagcggcaacgaagtgaaaatgcgagaacggatcatacaagcggagaccaaagcggtgaagcagaagaggtgatcggaaactaaattactattttaaaaggcttcgtgttttgtgcaatattttagaagaaaatcttattggctagctgaccgatttaattttctcatcttctacagggaaatcgatacattggcaaaagaattggagaatttgcgtcaaatcagaggttattttcgccctgtactctttaacagctgccattcttccacctttcagattcattgccgactcgctgctacaattatgtaaatttggaacaggagggacaacgatgaaaaggagcaattgggccagaagggacggttcatcacaagtggaataatcccggcttttttaacacattccccgtcagaagcaa

SEQ ID NO: 41525 - DNA, 971 bp, Heterodera glycines
  misc_feature (902)..(902): n is a, c, g, or t
cggcgcatatggcaaaaatggcagcagagccacacaatgaccagaaaatgattggttcagaacccgttcatctcctcagaaaacggcaaatcgaccactgtcccgactgtgatgcagcaattatagatctaccgcctttcacaatcatttgttttttgtttaatatatttcatattaaaatacataataaagaagtacataatttcctttggtcctccatggagagaattcattgatagaaaaagagagagataagggacattttgtaatttgttgctctttctacgcttcattttccctatttccgcaactatgtgatgccagcagaggaagcggattgtgggagaaagtgggataaagaaaaaagagaacctccaaaagaaatgcccgtcgtggatacgagtcacaccggtgaattttaccttttatgttaccgctacacggactcgatcagttgggtcccggcacgtttgggctccggactataacttttttctttctcaccaaatctaacattgttcgtataggcttacagtatggctgtgatcgcattgcttttttggaattggtattaaggaagttgtgtctctcaaaccctttttggactaagtctgaacaatttatgatcacacacagaatttttgagcaaatcttaatgtgaaatgagaccattaacaaatagccctttcaagattaatattaaatacattcattaagtttaaaagtatataaattcgaaaaacccgtatttcctaaatgtatgattggtcaaagcgaagtgaccattcttcacaaaaagttttacttggttgaacttctaactactgtaaaaaagcattatctagtcattttttcccaaaaagagtccattttcctttgatctctaaaaaaagaagaatggnattgaatggatgctacaaattcccgtaatttagctgatcatgcccactcacagggtcatttccatcatt

SEQ ID NO: 41526 - DNA, 270 bp, Heterodera glycines
cacacgacgcaaaaatgacgacgactcatcatcttcaatttcacggcggcgcctcagccaatcctcgcgagccctgtggagaaaatggaaacatttgaaatctatgtaaaacaattttttgtggaaaggtgaaaaatttttccaaaaattgaaaaaaagaaataaaattggggaaaattatgcaaattttctaggcggaatgtaattttagttcttaatttgagaaaaattattttgagagcaagttgcaccaaaatctaggcccattca

SEQ ID NO: 41527 - DNA, 1091 bp, Heterodera glycines
cgacattcgccttttccgaccggcggacattggcaccctttgggagggagagtacgcgcgggtgttggcggaaccaccgaaaatagggggacgaattgccaaaagtgacggaacatttggaaaaataatttgctctgccgccttaatttgcccattaattatttccttccttttttgtcgtacttttgccattaatttttctttttcaattcccttttaattggacccattttcccctaagaaaagaagaagaccttttgcatttcttaaacaaactttggcatatttaagctcattaattgcttttaatttgtctgattttgcgtttcgaattgtctccgtttgtttgcgacacataactcattattttgcgtcattcagtgcgtcacattgccacaaacttttcttttttgaacaacaatcttcacttttcgtgccatccgcttgccctcttttaagcccccccccccaaatgccgtgccatttgttttaccctcttttttttgccatttctcccccacttcgcgtcatcctcctccaatccgttattatttattcatttcccctcgggcatttcccccattaaatggccaaattaaacaaaagtccgtcaccgttttcttttgccatttttggtctgtccatcacttttcctccccttctctttttgcatgcgtttgatttgcttttgcattgccattaattacttttctttatttgctctcccaaatttgatcgataagagaaaagaaaagggaatgattttgattttgatggacgggcggcggtgttattattctccgactataaaaaaataatttaaaaaaataacaaaatgatttttcaaatttaaaaccgacaaaattcccaaatccctccgtccgttaggccaaagcctcgctctccgatggtgttgctgttgttgctgccattgtccgacctgctgttcctcaccagacactgctccctctgctccctttgttctccccatattgatcccccgaaatgaccgtccaattgtccgcccttttgctccctctcctcattatcactttgttatgcaattttgcgatgggcaatttgattttcca

SEQ ID NO: 41528 - DNA, 547 bp, Heterodera glycines
agcgtaattacgatttttacttacaccattttttgctaggtttagatcacatgcgattttcggcactctgataattttagcgctcataatgggatgtataaaggcgattgtagaaggaattggaagcgctaaaattgtttgaggagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgatttaacttacaccattttttgctaggcttagatgacatgcgattttcggcactctgataattttagcgctcataatgggatgtataaaggcgattgtagaaggaattggaagcgctaaaatttttgaaaagctttttgagcgtaattacgattttacttacaccatttttttctaggcttagatcacatgcgattttcggcactctgataattttagcgctcataatgg

SEQ ID NO: 41529 - DNA, 747 bp, Heterodera glycines
  misc_feature (9)..(9): n is a, c, g, or t
ccccccccncccctcattgatatttcaatgcctttttttgagatgttccgcatttgtgactctcatgaccagctagaaatgttcacgaattctgagcgtttgcgcaaccattacgtcggtcagcagttgctgcgtctgtccttgcgtcggaagagtgaacggagcattaagcaggaactgatcgaacacacgggggacaaaaaagtgtacgagaagcttttgtcgacactaagtgtttggaacatccgagccacctactacgacttcaaactgaacattttggagcagagccccgaaaatcaaccggccaagacgagcaatgggaaccaacaattggccagttcttaccaaatggccatgtatcagcaggcgctgttcaacaacgtggccaatgcttgtcatttgctgttcaaagagcatttgctgagagacattcattgtgaagatttggttagaagccgttggatatatcatttatctcataacgaaatttgtctgacagaacactgtccagaattttcgtctttcggccgtgaattgccattggcctaattgctcctctgataaacgctttgccttcgccgtcgccaccgacgacgagcaatccccaaaatacgctttggtgtccatggaacagttcggccatgaaggcctatttcttgaaggttgttgcggacaatcttagcatcgcaaattcggacggtgccatccaatacgagcagcttcttaattaccaaccctttctga

SEQ ID NO: 41530 - DNA, 858 bp, Heterodera glycines
ggttggtctaaatctgtgcgaaaagctcatttattttcttccttttaactgccatttacccaaacactgatccttcgtagctattcgacgatttcttttgctggggacccactgcccggtcattatcgaaaaatcattgaccaaatggccatcattgctttcaataattctcgattagccaatctttacctcatgcatcgatggtttcgggggctgtggcgtattataaaaccttccaattgaaacaattatgcacggcaaatgaatgagaaggattaacggaatgggcggaccaaagtgccgaaagcattgccagcggagggtcgaggcgggttagcaattggttgggctgttgcagaaggtcgacttcaacgccttcagttcgaagaaaatgccgaaactgaaaaatccttctgatcgtaaacgattcgacagttcgacctgcccgtaattataattccaggaaagctaaacgaaagaaaagatgtcgtagattggcttatttggtggcgtttgcctggaggggtcctcgcccgaagtaacagccctcaaaggcactcgcattggcactctccgctctttctttgcaggggtaccttccgtttctgtgattggttcgcattctttgccattggcccaccaaaagtccaattccggcgatcttttgcagtaacgtcccgcctcaacacatcggtccccgtctttgaaagtttttccgtcgcttctgccggggaaaagcggtgagcgggggccgccctcaaagaaatggtaaaaggcgcctctgtaaaagcattcggaagccacgcgaggtgaaagtttcgaggaggaactgctgaggaatgaagaagcattgaaaga

SEQ ID NO: 41531 - DNA, 971 bp, Heterodera glycines
tttcacatacattttcagatgcctataaatgtgttccctcacttagtgaaaataagttttaaggggtattgggggtccctgatcacgaatacagcacccatttttgttaatttcgaacccctgatccgaactcgaacaaaaataaaattagaaaatttgtatggataatatcctcatgggcatcttgccaatgaggatattattggtacaggaagcctataaattctttgtccttgtacagctcatgtagtgaacggtagcgctgaactgagcacgtattcgtgatcagctaccctaaaaaccccttaaaacttattttcattgatttcaaaaacacatttataggcatttgaaaagtatgttaaaagtacgccctgaactagaaaagtactcttttcatatttattttaggtgcctattcaaatgtcttcttcaataaatgatctggcaaatgaaacaatggtgcgttttccagggatttcttggattggttcatctcacttatactcattcgtttttcaatttcagtctcttattttccaatatcttcctccaaatgaaagagttcgtattgaaagagtgtgccgccgttggtgttttgtgtcgcgagaactcagttggtacaaccaaaagacacttctgctggatggtcaggaactcgcacaaaattttgatctgacggttagaaaacttttcagtggtcataaattattagtttagcatgatatttggtagttatttgggattgtggttccgctgatcgtttgtcttacattcgttagaaaaaaagttgggctggtcacacgtattacaattagagatcggaattttgaaaaaagcctgtacctgtacctgtatttcccgattggcctgtacctgtatttcctgtagaaaagtacaggacaatacaggttttttcgtgtttagctgtacctgtacctgtactaaattctaaagatggctgtacctgt

SEQ ID NO: 41532 - DNA, 468 bp, Heterodera glycines
agaaaaacaaattggatatgctatttaatttaggcttaaagtaattgtaagtttacgcgaacataaaactcagaaagaggcagcctaaactgcagactaattgagaaagaagccttatttgttagatctatcgactgatgataaattagtgtatcgtatccccatcctttttcttcatacagtaaatcgcttcggcttggacacggtagtgatcgctctgctcgacctcttcgttctgttcatatgccttggctcgctgtttctgtgcgtgcgcgcgctggtcaaaggacacttgttgaaaaatgttttaaaatgaaaaagaaaattaatttgaaatttattttgttcaaaagaccacacatgaatacttcgaccgggcatttggcattcggttaagcattcaagacaagtgggagttcatcaacatgtggtacgccatgattgtcgtggtaaggcatgccgtaacaa

SEQ ID NO: 41533 - DNA, 918 bp, Heterodera glycines
ccagaaaaatggctatctcttttttgcgagaaatttcgtaccatacaaatgttcccagcatgggcagaggggcgcggagagcaatgtccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttacgagaaattttgtaccatacaaatgttcccagcatgggcagaggggcgcggagagcaatggccattctattctacagggaatttttaaatttattctctatgccagaaaaatggctatctcttttttgcgagaaattttctcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttacgagaaattt

SEQ ID NO: 41534 - DNA, 987 bp, Heterodera glycines
  misc_feature (916)..(917): n is a, c, g, or t
  misc_feature (934)..(935): n is a, c, g, or t
  misc_feature (973)..(973): n is a, c, g, or t
atccattgcctgccggttctcggcacagcaaagcactacttctaagtttgactcacttcaaaaaataattccatacacaaaagttttttacaacaatttattgccaatctaatttcttgcagattgaaagccatccattgcctgccgatactcggcacagcaaagcactaatagggtgtttgactcacttcaaaaaataattccttacccaaaagttttttacatcaatttattgccaatctaatttcttgcagattgaaagccatccattgcctgccggttctcggcacagcaaagcactaatagggtgtttgactcacttcaaaaaataattcaatacccaaaagttttttacaaccacttattgccaatctaatttcttgcagatttaaagccatccattgcctgccggttctcggcacagcaaagcactaatagggtgtttgactcacttcaaaaaataattccttacacaaaagttttttacaaccacttattgccaatctaatttcttgcagattgaaagccatccattgcctgccggttctcggcacagcaaagcactaatagggtgtttgactcacttcaaaaaataattccttacacaaaagttttttacaaccacttattcccaatctaatttcttgcagatttaaagccatccattgcctgccggttctcggcacagcaaagcactaacagggtgtttgactcacttcaaaaaataattcaatacccaaaagttttttacaaccacttattgtcaatctaatttcttgcagatttaaagctatccattgcctgccggttctcggcacagcaaagcactaataggggtgtttgactcacttcaaaaaataattccttacacaaaagttttttacaaccacttattgccaatctaatttcttgcagnnatgaaagcatccattgnncctgcggtctcggcacagcaagcactaatagggtgttngactcacttcaaaa

SEQ ID NO: 41535 - DNA, 1279 bp, Heterodera glycines
ttacaaagtttagggaaaacaacacaagaacggaccttactgaaccgattcaaaatacggccgagcggagtgatgtcgaaaaatgcaatcggactccgcaaaatactccgaagcattttttcatgcagcgaataactggcaaaaaccctaaaatttgtgaaatgccaaataaaagtgaggaatggaaaacagacatcccaagagacattacaacggagccaagcgccaaaaaacaggcttaaacggaattattaattggtaaaaaatggatggaatgaccttgacccattccaagccccgtgtaaatgccgagatgtgtgatggtcgccaaagaaatggtgtcattttcgttttgcaactgaaccgaagtgcaggttttgtcgtccgctgaaaagcccttttcttacctcttgggcatggtctgaccaattagcaagccaaaggagacacgagacgccgagaatactggaggagaagaagatgagaaggcatagaaaacaggtgcagaggccaatggcacgcaaataatccaaataaacgctgaatgagtgcctcagggcattggtttgccaacctccgcttctcccacctgtacttcaccttccccgtgaacaatgcctctttctcgatcagtcctttgccttttgtctccccattttgctgcttctcttccgcttctttttcgggttgtgttgttccctttgatttggcttctttcgtttctgagaaagacgaaagtgctgcgctttgttgtgacaattttcgctccaatccctcgcccttttccgactcttcgggtttcattgaggtcaaaaactcctgaacaacagcgtcgtcgttgcccatttctcggttggagggattgcgattggtgaggtaatctctgatcagatcggagaaatcaccagaaccagccaataagtcactgtaagtgccaatttgcgcgacagaaccatctgagaatgagtgcgttttttattgtgactagaagagtgctttcggtgacctttgatcacgacaatttgatcacaatgcttaaggacagagagggaatgagtgacgagcactcgcgtctttcctttcagaagtccgttatcggaaccttagaatcaaaaaagtgtagtagattaaaatagggagggggtcaaagtcaagattttacaaaaacagaaaacccctccccccttcctccaccggcagaggccaaatggtgctgatttaccacaaacccctattcaactactagtatttaacaccatactgataagtttgtcgaaaa

SEQ ID NO: 41536 - DNA, 996 bp, Heterodera glycines
cgtatccaactgagaatctgctgaatggggtttttggctttgctgaacccaaatttgatgccgccgttgtcatacgagcccaaataattttttaggaattttattgtacctgtttcgaggtaggctttaaaattaggcttttgccaaattagctctcgagactgtagccagacggaagcagggcccagccgttcgtccagttgactttttacagaagtttgcggtggtatttttaccaatcagttttttatactgttattgatcgtatccaactgagaatctgctgaatggggtttttggctgcgctgaacccgaatttgatcccgcgattgtcataggagcccaaataattttttagtttcgaggtaggctttaaaatgaggcttttgccaaattagctctcgagactgtagccagacggaagcagggcccagccgttcgtccagttgactttttacagaagtttggggtggtatttttaccaatcagttttttatcctgtttcgaggtaggctttagaatgaggcatgaggcttttgctaaattagctctcgagactgtagccagacggaagcagggcccagccgttcgtccagttgactttttacagaagtttgtggtggtatttttaccaataagttttttatactgttattgatcgtatccaactgagaatctgctgaatggggtttttggctgcgctgaacccgaatttgatgccgccgttgtcataggagcccaaataattttttaggaattttattgtacctgtttcgaggtaggctttaaaatgaggcttttgccaaattagctctcgagactgtagccagacggaagcagggcccagccgttcgtccagttgactttttacagaagtttgttgtggtatttttaccaatcagttttttatactgttattgatcgtatccaactgcgaatctgctgactgatgtttatgcctgcgctgaacacgaattagatgccgccgatgtcata

SEQ ID NO: 41537 - DNA, 1600 bp, Heterodera glycines
aactagagttgtacgggaccggaattggtactgaaaaaacgtacaactgagtacctaagtcccggttttgatcgtttttgaccgggaccgggactagtccatgttttttcccggttttcccagccaaaaagtcccggtttttcaacccgaaatgtcccggtcccggtttttctcaaaattcccgatccctacaactctattcaaaaccccttctggggtcaattcaaaaaatgtccaataaaaaaagatttctgggggaggggctgatttttttttatatgaaataaaagcaaaaatgaaatgcccgtaccattcatttcacattgtgccatcttttccacccccaccccaatcgacggtccatactctttttgtcaaataaaatacactaactttttttctcactttttaaaattcactaactttttttccaattccactctcgtctcaagaagcagttttccatggttcggctttattgagactgccaattctctgtttatttccagaagaatttcttcaaagtcccacaatttgcacaggtcagagtcggccaattccggcaattttcgctcaatttttttgcgcaattcgtcaaatttcgttcgcatgttaaccatttcaaattcatttttatgttttattgcgaaatttgtcattttttttgtgtgttcgtcggatgggcccaattctctgcaaaaagaaaaagcatagaaaaacgcaaaaattagcattggaaaataaatcaattccccagacaaaaatatatagctaattcataagcgcctgcttaataaataaacatcaattaaatggtgctaggtcgaacctaaaaaaagtatcaatgataataatatttaatttaattatttttttaaattttgtttgcagaataataaatcataacttagctcatacttagttaaattaataaaattggtattctgcgatagctctacgtgtcctcctctgtttatatatttttaaaaatctagcaaatttacaaaaaaaaaattgtaggacgggatcccgcgtgggtttttgcgggatccggtcccacattttttgggtattgcgagatttggcgggattaatcccgcatgatcctgtcccgcaagcttttgagtctcaaccccgcggctgaatccacaaatttgattttgtccgcggcattccgcgttacattttttgaaaattttaaatggcaaaatgtcatacattttctttaataaaattacaaaaattaaataaaagctaacgcttttttgcatcgcaaatttcatccaaaatttgtgaaaattttcccaatgtgtctatcggcccgccggaccggcccccaacttattacttcttcaaaaattaaagcgaccttttttccgggctctattcataatagtataaaaaaaacttcattctctgtccaattgtccgcttctgtccaatgtccggggtctccactcagaaacagcatttttacaacgaaataaatcggacttttaaacccaattttttaagtttagaaatagtgtgatttgaatatatttaagaagacagaattttagcatataattaatatgatttgcttggcctttccatgcct

SEQ ID NO: 41538 - DNA, 773 bp, Heterodera glycines
attattattaattaattttaagcaatttaatttttttataataataaattctcaaaacaaaaaaatcacttaaattgtgtttccatgatgtcagatacgcgattttgacatcacatcatgcaaattgaattgacacagaattacatcatattcacgatttttcgtcgtatttacgatttttctcccatcttataaaagatgatcctaaatacgatgagacgtcgtgaaatgatgggaattgaaacaaaattttacacgatatgacatcatatcggagatacgacgggaattgaaataggccccagcacgcgtctgttcactgtatgccctctcacccgccgctgcccgcatagacagacaatcagacagtgcactattttcccacctttccctcactatacttttttcaaattcatttttaacgcaaaaaataaacaaaacgctacacaaattcaaacactggacacacacatacagacactcaactttattatataagattactttgtcagttctctgccaatgttaggtcaccaatttgcctaaaattctttttcccattgatttgtgtgccatcaacggcagaaaatgatggtcattcattcattcactttcactttcatttacataaaaactatttgttataaatcggtcattaactcattaatagtgaaggaaatcatctgaagaataatatttttttatttttggaaaatttgtaaattttagcaaattaaaattttgagaattcgctgctgaacggaaaccaaaac

SEQ ID NO: 41539 - DNA, 991 bp, Heterodera glycines
  misc_feature (43)..(43): n is a, c, g, or t
  misc_feature (59)..(59): n is a, c, g, or t
  misc_feature (71)..(71): n is a, c, g, or t
  misc_feature (114)..(114): n is a, c, g, or t
tttttaaatttatctttatatcccaagaaaaatgactatctcnttatttgagaaaattntatacgttacanaagcgctcgagcgtgagagggagggcggtgcgcaatcgccatntaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttctcagagaatttttaaatttatcttatatccaagaaaaatgactatctcttattttgagaaattttatacgttacaaaagctctcgagcatgagaggaagggcggtgcgcaatcgccatttaatttctcagagaatttttaaatgtatcttatatccaagaaaaatgactatctcttattttgagaaattttatacgttacaaatgctctcgagcatgataggaagggcggtgcgcaatcgccatttaatttcacagagaatttttaaatttatcttatatccaagaaaaatgactatctcttattttgagaaattttatacgttacaaaagcgctcgagcatgagaggaagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgtcatttaatttctcagagaatttttaaatttatcttatatccaagaaaaatgactatctcttattttgagaaattttatacgttacaaatgctctcgagcatgataggaagtgcggtgcgcaatcg

SEQ ID NO: 41540 - DNA, 1139 bp, Heterodera glycines
ttaatattttagccacatttttaattttttggcaatactttaattatcccaaaaaaattccgttatttttttgaaactcgaaaggatgaatgccaaaaatgaaattaaatataaaatcgacaatcctgcccttcttttttaattcatccaataaaataatttaaaattatttgaaaatattttttcccaggatgttgatggcggtggcaaatttgtgccggttggccaagtcgggcctggcgaaacgtcgctgcagctcaaaggactgaaggacaagggcaactacaaattccgggtcaaagcgctgaacaaagagggcgaatcggagccattggccacggacaaacattaccaaatcaaaaacccgtgggatgagccgggcaaaccggtaattaattctaattaattggcctaatctccgaatggtcaattttgccactgttgcgctcattcaaattcctaaaataaaatataaatttaaaaatgtaattccctaaatatttcattaataattaaaaaaattcatcaaaattcacatatgaaaatttttcacttaaataagttttgtggcgctagtgtcaaagtgttaaaatttggaatttttttccaattttataatgtgtcaaattttgcttgtaaatccattgaaatatgtcttgaaatggatccctattaagaaattaaaatgtaattcaaatttataaaaaaaataataaatattaatgatatattataaaaaaaactggaaaaaatttcaaatatttatcattttaatactagcgccgattttgttcttcaatttttaaaattttattaaaaatatctttcctttttccccaagggacgcccccaaatcaccgacgttgacaaggactttgtttcgctccaatgggacccaccgatgaaagatggtggtgctccaatcgaaaaatacttggtggaaatgcgtgacccaaagagcaaggaatggaagcaggtcagttaacggagtggcaaattagttaaaaaatgaaaaatatttaaaaaagttttctaaattttgtcaggtggccacttccgaaaaacccgaagcaactgtcaaaggcctggaggagggcaaagaatacccatttccgggtgaaagcagtgaacaaagcggg

SEQ ID NO: 41541 - DNA, 976 bp, Heterodera glycines
taaacacaccgtttcaaaaaacgagagatgaaccaataaagagagagcgcagagaaaaaaacatctctctttttggcgtactatttctttgtctctattaatagagaaaaaccgaatttacatttctatgtttagtttttttgtcctatgttaaatgcgcttcaaattttgcataaagatagagaaaaaaattccgcatcggttaataggtcaagttaatattaaaataggtcgattcgagaacttattcaaaaaacaaaatttcgaacgctcatatcttttttctactcattcaaatcgcttagcatttgcttagaaaaagcttctccccatcaagggctttcgaatgataccaagatttaccaatttggttggcaaaaagcttcaaaaataattcccaaaattcgtcattttttaatattttggacaaaaataaataaaaatattcatgttgcacaacggactcgaaccaccaccctttgtccctttactatcttacaaaaaccactgcgccacacatgcaaatctttttggaactgagaggccaaaattgaaacggtgtgtatatgaaaaaaatgaaaatgtgtacgaaaaaattgcaaaattttgaatttttgggggcattaataaaaatttccttaaaaatcatcaaaaattgcaaaatgtgtaaaatatgtatttacataaaattagtagccctatatattatataaataaatattttgttaatattaaaattataattattcgtcctattcaaaaacgataccatcaacactcgccattgttaattgcatgatattatatattttatatatttttttgaatgaagctttggttaaaaaaaacatattcttagtaataaatgaaacaaagattcccaataaaaactaaattataaaagagaatagtgaaggaagtgatgagcggggaaatatggaaaagatgaataacatcgattggccaaaaagggaaa

SEQ ID NO: 41542 - DNA, 566 bp, Heterodera glycines
tataattcagttagttttcttaaaaatttgaccctaaactttctagattcccactgtggggtcctaattttcgtttatctagatttgtctttctcaaatttaaattccttttccagcaaccggcgcatttgcttccatccactgtcgccagcagttcaaatcaacccatccgtcggacttttgccgatgttgtcgccgcaattcctccgacaattggcgacacacatatatatgtagctaaagctcattttattttattttgttatttttgtcaattagtatcggcctgaaacattgacttgtcactcaatcgagttgtattgggctccgctaaaatgtgacactgaccattacgtcgtcgaagtaaaaaacaaaaagaaggaatgggaagcgacgaagcataaggtgaggtgtttcaactatatttgtgtataaaaattacacaaaagacctaattttgtccaaatggagaaatttaaaaaaaggtttggtcaaattcgttaagtaaatttggaaataacaaacttctgaaagaaaaaattttcattttttttgggggggggggg

SEQ ID NO: 41543 - DNA, 916 bp, Heterodera glycines
  misc_feature (60)..(60): n is a, c, g, or t
  misc_feature (75)..(75): n is a, c, g, or t
aaaaattgtttttttttcaaaaaaataaaatttttttaaatcgctgaaattttttcaggngggaagagctgctcncaatttgtatgccatgctttaaattcttacctttctcggtaatcaacaaaaacaaattttattcaaaaaattgaagaagccgtcaaaacggattatctaagccagtattttttatattcaccgttataatgttgatttatcaaaaagcgtgatgaaacaccaaaaatgaaacaataaaaaaagaaaaaaatcggccaactgattttgaacaaaggttaactgatcatttgattaaaaaatgggaattcctcatttaatttttttagtgtaaaaagtgttaattgtctgtgtctgactgatgattagaatctttcatgacggttgtaattagatgaaaaagcgaatcgtttaaattacaagcaaaaaattttgaaaaaaataataattacagtaacccaaaattaaaaaaaaatatatatatatggtaaatggtataaattcaaatttatgtgtcttaaaatgataatttgagagagcgaaaaaaatccatagaaatattcgccaacaattcacagaatagacaaaacagaagaaagctcaatatggaggagtggaggagagaattgtgtgtaaatgatctttcataacaaaagaaatgagtacagtatacgtgtacaagacaggaaaacagttacagtaacaggtttgccaaaaaaataaaagcaggaatttgcagctaatttatgacattttggggacaaattttcaaaatatggtcaatgtgggtgttctggcaatgccttatttttcaaaaaaaaatttgccattttttggaaattttttaatttttcattcaccgggagggaggggggggagaaattccaccccctggctcaagagt

SEQ ID NO: 41544 - DNA, 1060 bp, Heterodera glycines
cccgaccacaaattatttttttaaagacaatggtgccaattccctttttttaatttttctcagtcagtgacgaaatgatctgttattgttggaactaacctataatggactgcagttaatcactatttagcattttgatttttgagaaactcattaacaatcataaacaagcacattatgtattaacagttttattcttacctcgcaaaaaaaaaacaattaattaattatatattataagtgcgataaggtcggcatataaaagaggacacaatgaatcagtgaattcagtgttgggcatgaaacaacacccgaaaattaatacaaaatcataaaaaggtctgacaaaaaataattaaataaaacagcaaaaaggaaaatttaaaaatatacaataataaggaagttcagttgctgaacaaagtaaaaagagagagactcacaaaaagcataagataaaaaatacccgaaaatgaaaaccaaaagaaaagaaaggaataagaaatggagtgccaataagaaaagaatgagcattggacttagccttcggcttcaagtactaagcctagcttcgcccaccccttgtcagaatgattaacaaagtgggaaattgcggccagcagactcgtaaccagagaaaaaaaggaactagggcagagtatgcgaagatttatctgcttttgtcaaaaataaaaataaattttcatgtgtcgttttgaaaattaggcggttaggtgccaaagaagaaaaagtaacattttgtgtttgtagagagatggggaaatttctaaaaaaaataaataaagtgcattttcacccgagggcattccccccccccccccgctttatcccctttggttacggtttgaggtaaacaatcaattcgataatcaaagctcgttgtctttagtgctcatcggtggaaatttgacaaaaggtctccgtgcaaaagtttttgcctttaaaatgctttgagccaccgcttttttggcgcgtaacgaagccatctcatgtgccatgtaagtgagcacaatttcatcggccaattcagtgaaaaaat

SEQ ID NO: 41545 - DNA, 862 bp, Heterodera glycines
aaaagaaaaaagggcttggggattgcaaatgggagaacgctttttgtgtgccaggcgcagtcagaccgttggaagaccctccgaaaaataatggaaagaaaaagcaacgcaaaaatggaaagggaaagaaaaagaatggtggtaaaaaatggttccactttttctgaaaacaaagttttggcaatgacaagtttgtttatcatttgatcagacaaattgtcattaccccacttaccgtatccaccattgacagtagtcagatttagccctgatcccccgacattgacttagcaaattttccgtagattacactcaagagggcttcaagtgtatggtgtaaaatgaattcccatgagtttctataaattctaaggcatatcttttttttcaaactttccaccattccccgatttattcggatatgctggtgcttgatcccagacttttcagtccccgagttcaggactaaatctgatttatccgtccatcagtctgtccaatgtttcttcttctgtcattcttaaaattctgtccttttgtagtatattttgatcatttcatggctttccttttccatttctgtcgtatgtattatttattctatccatttgtttgtttgtcattgatcagacaaattgtcattcccccacttaccgtatccgttgaccgtagtcgtcggatttagccccgatccccctacattggttttgcaaaatgtgtatggcattttatgaattccttatgaattttagagtatttaaaaattatctgaatttttctttatattgtatccctgatatattatttttaatccgccagccatccctgacatgggttttgccaatttgctttttatttcaac

SEQ ID NO: 41546 - DNA, 677 bp, Heterodera glycines
tttgggcatcaattatttgcaaattgattgattatttttccaaaaatgggcatgttttgttcattttgatcacagatgcgtccaatcagccgagcacctcttccaatcagccaatttgggcacacaccgcggggtcagatgacgggagcagcagcaagcggaggaggggcaggacgagtcgggtgggtacacaaaaagtgatcggaagggggggggcaaggctgaagcagcataactctgaccagtgatctgtcgtcggctgcaattgacaaaaaatgatcaaattgacgaacgcggatcattttgatcaatgtttgactaggaaataaaatggtcaaatggagaagaaagcatttatatccctgatcaccgatcaattatcatatttggaatttgatcacaaatgttcaattgattgtgaatcatgtgttttgtgcgctgatcactggttaaaattaaaaatatgatcgatcgaaccaagcaaaaaatatttgaataaaatacctgagttctaatcattaatcatttattttggaaattgaccgaaaaaagattaagtgaattatctcatttataatcccaaaaaattaatcctcataattacgatgtcctgatcattgatcagaagcagagtttttttaaatacctaattagcattttcctttttaattggtcaa

SEQ ID NO: 41547 - DNA, 538 bp, Heterodera glycines
tggacatggacaatgtcaagttcgccccgttcagcgacctacacagaaagcgcgaaacaattaaacaaatcacatacataactttaaaaagtcattttaagttatcacttagttttattcatatccagcagattatatcaaaaatagaggctgacgggattggaatcgcgtccaaattttctagtggtccacatcccgaccttttgaaaaatggcaggatcactatccggcaaaagcgggatttgaatccatcagttgacgcgattaagatcccgataaaaccgggatttgaattccgttaatattatccggcctaattcccaatgatctagacttgttcaaaagattaaactctttaaagataccaatatttaaaaatataagtctacaaatacataatatatacataatataattagaaaatgttaggcgacttctctttgttgaactacgcaattgaaattgctgatgagaattatgcgctgggtcaaatgatgttggcctacaaaaaggtgcagcactctttttaccgtacttt

SEQ ID NO: 41548 - DNA, 991 bp, Heterodera glycines
  misc_feature (875)..(875): n is a, c, g, or t
agaaataaaaattaccagctatttgaaatgcagtggggcctacctagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaaaagagatagtgattttttctggattaggccggagaaataaaaattaccagctatttgaaatgcagtgggcaagcacagcgagtcgcttaaatgcacacccttagacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgagacgtaaaatattccaaaaaaaaagagatagtgattttttctggattaggccggagatataaaaattaccagctatttgaaatgcagtgcgcaagcacagcgagtcgcttaaatgcacaccctttgacacgtaatatattccaaaaaaagagatagtgattttttctggattangccggacaaataaaaataccagctatttgaatgcagtgggcagcacagcgagtcgcttaatgcacaccctttgacacgtaaatatccaaaaaaagagatagtgattttttctggat

SEQ ID NO: 41549 - DNA, 1386 bp, Heterodera glycines
  misc_feature (51)..(52): n is a, c, g, or t
  misc_feature (66)..(66): n is a, c, g, or t
  misc_feature (78)..(78): n is a, c, g, or t
  misc_feature (105)..(105): n is a, c, g, or t
  misc_feature (651)..(651): n is a, c, g, or t
tttatttaataggtaattttaattattttaccgagatctaaaaaactttanngaagaatgcgtatntaagcatcaatntaataaaagttaaacatatttttaatntaaaaaattgataaaaaaaatcatcaatttacagctgctggcatataatttaattgtcgctgctcaaatttgatttgtaatttcttttcgcatgccaataattttgtgttaattattcatttaatttttatcataaaattaattgaaaagtgttgtaaaatttagaaattgaattatgaacgcaatatccattaaaaatgaaactcttatcctcttatgcattagattgttccattttgctcatcacaaattctaaacaaatttgcccaacgtttggcacataaaaaaggaatcgaacatataaaagttaattattttttggtcctaataccatttctacgaatttatattaaacatgatttgtcttcgtccagattagagtagagcgggaccgggaccaaaacacggacaactgagtacagaaatcccggttttgaccgggaccagtcccggtttttccaggttttcccagccaaaaattcccggttttttaacccgaaaaggtcccggtccaggttttgccaaaattcccggtcccgctctacntctagtcagatcctcaactcaggcctaggcatttttggttttttgcaaccttggactttgctgagaatggcttttccccgggaatgtgcctatcggcgccttccagcgccccctcttttaaagatttttttggaaaaagctcgccgcaagagaaaccttaatattttttaatttcaaaaacaatgaattttttaaaagattcttaaaaatgcttaaaaaataaaaacttcaaaacgaaaaaaataatttttaaaattttgtaaaattcagtttttaaaaaattaaataatttactttaaagttgcctttgtagtggaatttcgtattttcattcaaaaaattaacttatagcaatacgaaacgccaaaataatggcgatattattccaattgcgaaaataaaaaattgtgaatccgtgcactttcaaacaaaactcagttattattttatcagctgtctggcggttgcctcactgggggttttgttgaacttggctttgtcatggattcggaaaagacttggattaaccgacctgactggttccaaccttgaaaaatgttccaacgaacaacaaaaagcatcacagaaattaaaaacaaccgaacactggcggaagaaatataaattttctggctaagtcgggttttcaattccatttggaattttctctgtttttctcttcaattgggctgactaacgggggacctggtcttgtcattttcaacgaaacttgta

SEQ ID NO: 41550 - DNA, 945 bp, Heterodera glycines
tttgagaattttatacctcacaaaagcgcttgcgtatgagacggagggctgtgcacaatcgccattttatttcacagaggatttttatattagagggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatactatcgagcatgatagggagggcggtgcgcaat

SEQ ID NO: 41551 - DNA, 1365 bp, Heterodera glycines
aggtcagaggcacaaatgaatttttattcgaagcactcttacagagagtctttaaaaacccgaaaatgtaaaacaaaaatcttaaagttaatcataattattgcttaaaaattcggtaagttaattttaaatgaatgtaaataatataaaaataaaaaaggttaaaaataaaatattacttcataaatgctaataacaagttaattgaaaaagtattcataaacttacataagtaatggcaaatatgtgaaatttagttacatgaaaaatttacttaataggaatatatgcaaaaattaataacatgctcttttataaaaccgaaaataaacaaataaataaaatatcaatctaaatatttgctttctataacaacactgaaaatttattacagcttaaagcagtataaattaaatcattattcataatattactaaagaatttactacaaatgcctgctgagtatagaatttggcaagatgagaaaaggtaataaatttaaaactatttttaaatatatgaaatcgaataaaattcaaataaatgcttaataaaaaatcaatttagtttaacattttaatcatatattataatgaataaaataaactttattctaatttatattttaaattaacatggaaatattagaagataccgctcattgtgtcaactgctcaatgattttactacaagagctgcttttgaaagtaactcagacctaaaattcaaatgggcatgcttttcattattaaaataagaacgtttcaaaattaaaaaagaaattaaaaacttaataaactcgaattctattaaaatagtttttaaaaatcaaaaattaaggtaatttaaaataataacattttcaattaattgatcattgtataattaggaacattcgaaaaattataataatatttaatgatgtgatgtttgaattgaatggaaattaaaaattaacgagaaatccaacaaaaatattgattaaacttttgtcataaatttaaaatacaaaggaaatctaaaaatgcgatagtttaattataaaaaagaattacaattattagattaaatttttaatccttaaaatgataatttaaaaaattgattaaaatatttcaaaataatttaatcattaatatagcaaaagagtgaaactgaattaataaattattttagcaaagattaaataaaaattataatcattttcgatatcgattaaatttataaatcagctaaattctttaccttatatgagtggattcaaaggttattataaaaatataaattcagtgaaaaaatttatttcatgaagtgattgagaccgagcgggaaagaatcacgaatgaaggagctaaatgcataagg

SEQ ID NO: 41552 - DNA, 1384 bp, Heterodera glycines
  misc_feature (44)..(45): n is a, c, g, or t
  misc_feature (60)..(60): n is a, c, g, or t
cgctttctgtgaaatcctttgacgtaatttctatatttctgttnnggtcattttgtcttnacgcacttttaaacgtaatatttgcttcgctatatatatatatatatatatttttgttctcaaatcaatttatctgcatttctgataggttttagaatttccaatgacttccgccgatggttccaatatgagcgagggttcgttagtcgtttcgtaaattttaattgtttttactttcagcgattatgcaaatggtccgtcccgccgttgaacgcatggacgaacaggtgaagaacaccaggaagagtcagctgttcttggccaatcacatcgaccaaacatcagaaagtgggtgagcaattaaccatatcaagtcaaaagagagtcgtgtaaatgaacatttttaaaacgttatggtgtaattgttgaagcaaaaaatgctgaacatatttagagttaaagaatttggtggatgaacagcttttgccctatgatttggacgcgtacgtgcgaaaattggatgagagtcgaaagcgaatcaacggaatcggccaaaaacttcaggtagaattctaattctctaattgaggcgatatttatgtcccatttagatactccaaaatcgaatgggccaattacagcggggaattgcccgagagacattcagacagaaacaataattagcttttatgaataaaagactaaaagcatgtgttattcctgccagtttcgtttaccgttttcacagtctcgcatctttattttctttttccctattttatttgttttttatttaattaaaaatttttgcacattaagaaatgcacagaacttcaatttatgcgaaactgcaggtgaagtatagtcgtcgtgccaagtttaccccgagggttgctcgcccgtggcgtcagcgggtcatcgcctgggccggccccgacgccttctcacgcgaccggtcagtccaacgcctatctttggtgtttcttcgatttggcaatctgtttacagcttttatgaactagactcgtggtacaaagcacggattcagagacccgaactgctgcccaagttgcatatcattgacccggatttaatcgtggacaattacgaaagcaaaattcaacgtaagacgaggggacgagagggttacattcatttgtattttgaaggacgcaaggaacggacccttgacattgggtttagaaagaatgaggcggcgcctgccaaagtgacggaggaagcgatgcaaaagttggaagagttgtccgcaatgaaccaatgtgagtgcgtgaattgagcttgtccgctttgcattcattgttcggctgtgtctgttcagtggtcatcgatttggactccgtcgactcgtccgaccaactgagtc

SEQ ID NO: 41553 - DNA, 153 bp, Heterodera glycines
ccagataggcggccttgctgcgctggctccactgcccggcctggctggccgagaagcccggtgcgccgttggaattggcttccaggcccgcggctgcgcccggacccaccgcatacgaggcggggtcaccggcgcgcacctggtaggtctcct

SEQ ID NO: 41554 - DNA, 1526 bp, Heterodera glycines
  misc_feature (42)..(42): n is a, c, g, or t
  misc_feature (1497)..(1497): n is a, c, g, or t
ttgccaagtacgaattgggagacttagggaaattggaaaatntaaaattaaaattaatttaaaataccccaaaattgaaccaaatgcatacagcaactgatatatggccaaattggtcagatatccgccaatattaatagacaaaatgatgaccaatgaccgtaaaactcgtgtgttcgtctgttgggttactgtaaaaaatatttcggtttattttttttggcaaaatgcctaagaatttaccgccttttttgcatcggattatcacaaaaattgccacataacagtaggtgctacaaaatgaaataattaatgtgccggcgaagaatttatgcccaacggggcccagaaaagtttcggccacaacaccggtggttggactgaaaaaataatattaattaattttaatttttgatttaattgcgccatactttcccgcattttcgaatgcaaatgcgagcacataattcagtgtaaatgcaccgtaaattacacaaattaacagatgactaagcaaatacggtaatttgtatttagtgaaaattgaggaatgtctaaaaaaggaaaaattacaataaataatctatcaaagaattaattagggttaattagtgtttgttgaattaatttcatacttaaatggcgacacaacagcaaaaagtcggtcaaaagcagcacaaaacattgccattaagccacaattcaaagcaaaaatcattggctaaaaattgaaaaataaatcaaaataaaaataattgaaattcagaatttaccgtcataattaagtcagcagtgagcaaactgacaaaatttgtgcccaaaatgacaacaaccagaaaaaaagtatgcccaatttggtggaccaattcacaaagacaaatcaaagccatcagaaaattggcggagccacggagggaactgaaaaatgggaattgaattaaaaattggtaaacagaaattaattaaattgtaatttaaaaatgccatggcatttgcctggatttgacagtgaccaccaaaactgtgccgttcaacacaatgccaaccaaaacaaccaaatacagcgcaacggccggcacaatcaaatcggcggacggaccggcgaaacggtaggccaaataaagctagaaataaatgaaaacatttttatttatttaaataaatcttggtttaatttttccaaaaataacttaaaatagttaaatcctttgtttttaccgggtcatttgagctggtattaattgatgccattattgatgtaaaaataagttttatgaaaatttgtctgcttaaaatatttatatttatttgaaaattttggttgagtaattcagttattttacaacattttatattattcataaaaaaatttcttctttatttcattaattaattttaatcatttaaaaaatttaagattttgtaattcagagaaaaaaattatcgcaattaatttctttaataaaagattttcttacttaacggaagtgggaaaanaagtgaaaacctgaaaattatattgtgtg

SEQ ID NO: 41555 - DNA, 1080 bp, Heterodera glycines
tgcatataattctactccctacctatcatatatttttttataaaatactcaataattaaattccattttcttcattctcgacccactttatcgatgccttacgtgaacgaaagtaagacgaattcaattgtatagggctctccatcttataaaaaatttaattctggcggcccttaaaaaattatcactttttcagggggtgagatgcaggacggcgccagcttttcaatcgtccggtcattttggagcctcgtctacttcttagcattcttgtaatcattcgcagcccattttaacgccattaaactcaatcattttactggtttaagttattttcggcaaaaagtttattaatgagcaaattttttttgcaaaaaatggaaaatttagaacctagcgtttttcaaaaatttcgatttaaaaattgtatcattggcacctcaaaaaacgatcattttgtttgcaacttttttgtcataataaattatatttgcggggattttctggatcgctgagtcacgaatcagacttctattcaaaccaatccaaattcgaaaccataatttactaattagaataaaaaaaaatttttattcgcgttcgggtttgagattgatgtcaaaaaatggtgttagattcgtggccagcaaacccccgaaaaacactaggaattaattcacccgatttatttttcccggaattaaacccctaattttccgtcggacattttctgacatttctcaaaaaaaaaatcagggccccggaaattttgagtgaatctgggccttgtccgggctttacaaaaaatagcatttatcagacccaatttttgcatttttgtcagcttccgttccgttggtcggtccgctcattgacagtgcgccgcgctatgacccggacagcgactcgcggcatcggtcgctgcgcggcaacggcgggggcggcggttggggtgggggcggaggaagggggaaggaagaaaggccgcgcttggaaaacccggttacaattcgggaacattttggggcccgttcaaattgtattgaaactcccaaattttttgaaaaaatcccaaagggg

SEQ ID NO: 41556 - DNA, 728 bp, Heterodera glycines
atgtgttcaggtgggaaaatgtgcccaggagtgtaatactttaaaccaaaaaaatatgacagcgaaattcgggattggtcataattagagctcgacctggacctggatacaggcctgaatttttcctgggtccaggtccaggacatttttcggcaacctgggtttttcatggacctggatttttgtccagaaaatccaggtccaggtctaatgtgaaaaaaaaatccaggtccaggcaaaacacgaaaaaacctggatttcctggacaaaattttagaatttattatttcaaatgattgatgtttttttcaagttttcaaaaaatgattaaatagatttaaaaacagattattattgtaaattacctatatatttttaaatgttcccatttgtttgcttttaaaacaaatttcaaaaaatccatggccaggtttggatccatatgcctagaagagccttgactctcttgcactttctctctcttctcactctctctctcccccctctgtatctttccctctatatttctcctttttctttcacactctccctttctcttttttctctcacactctctcttcccctctatcaccacccttctctttctctctatatctatcctttttctccacacactctccctttctgattctctctctgctccattctcactctacctctcccctctctttctttctctctccctctcgtccggtctctgttttccc

SEQ ID NO: 41557 - DNA, 360 bp, Heterodera glycines
agttaagagcagggtagccagatctgaggctttagcctcattttgtggtttttttataggtcaatgaggctaaattttcaaaatgaggctttgaggctttttgtggttttttgagaaaaaccgcaaaataaagaatttcttaatgaaaatatgctaaaaattcttaatttttcccccggcggcgcctatcggcaccgccggaccgtaaaaacccttaatttacaagcaaaaatttgctcaaaatcgcaaaatttggtcatttttcggacaaaatctgtcaacaaatcgcattgaaaatttcagaatcccaaaaaatgcttatttctaacaaaaaaatgctcaaattgatcatggacaatc

SEQ ID NO: 41558 - DNA, 1042 bp, Heterodera glycines
attttattatcaaaatatttgaaatccttttaagctccttccagcccatcaactcattttgaggaacgcttctgatgtatttgcagcaatgtttcgttttgactcacaaaattcaaatgctgaaagtggtaattgaataaataataactaaagattaatcactagttaattatcttaattaaattttcaatatcctttactatttacaaaataataataattaatctttaattagcattctctgctaattgccctgtggtggtggtgcccgacgttgaagcagcagttaactaaatttttaattagccaaaaagtaaaacatccctggcttggttgatccatgtttggatattcccatcaccgaatttcaaaatgttttcttggcttattcactgactcgccttttcgacttggaggtgagaaagtcgattttataattttgaaattaatcgaattttattttgaaacttaacgaaataaagttttgatttttttattaaagattttttgttttgtttaggactttgtccatcgttgtctggttacattgataaaaacgcggacactttgctcaaatcggatgaatttttgcaaattgttatgctaaagtttggaacgtgacgaattgcaaatccatgaagaactttcaatttgggaagcagtaaattaacaaatttaattaaattatttataaatatttttaattgaattttaattgttttccggcactccgttgggctgacacgaaatgccgccaaaatggcattgaatgctccgcagagaaacgccgtcaaatgcttggcccggcactgttcaaaattcgtttcccactcatcccaaaagaaaaatttacgaagaaaattggtaaaaaaaaaagactttaaagttaaaatttaaattctatctgctgaatttttaaatttttttaaaatagtttaaaaatttttgttttttttaattctgtttttttacagttccatcggatgtgttatcaaaggatgaagtgatcgccgtttatcagttccatgcccttccaaattgt

SEQ ID NO: 41559 - DNA, 556 bp, Heterodera glycines
  misc_feature (22)..(22): n is a, c, g, or t
  misc_feature (494)..(494): n is a, c, g, or t
ataaaataattttcattaattntttttacaaaattcattcttcttttccactttttttaatatttttagaaaattcataaattaattttcttttcttttttttaatttacctcgattccttgaccagttttgcatcaacacatgacagccaatctttgacataagcactgaatttgtcgaagcaaggctttgtcttggttggatccacaagcttaaaaaaataattattaattttattttaaacttttttaaattaattttacaaattctctcccaaaagaaaaaaaaagttttttttttctaagtttttcattaataaattttgttaaattataatgagcaatttgagagtttttgtggtcaacatttaagcccatttttcatgaatttttcttttttttttgtttctttaaatggagttgtagaaagtagagaccggacaactgtggtcggagggatcccgatgaaatcccgatcaatcccaatgaatttanaaaatcgctcgggacggatcccgaggtcgggatcccgatttaatcccgcaggatcccgatcc

SEQ ID NO: 41560 - DNA, 1092 bp, Heterodera glycines
tacaagccatttgaataaatattaaccattttgcattgcatataataaaaattttaaatgtccttgaatttcatgaattttccccactatgtccttgcaaatcagcatacccgtccttggaaaccgacttcggacgataccatccctgtcttaattcataattagattcaaaaaatttatgatgaatcgtttttaaatgatcattttattcatgatcataaataaatttttataatgagaaatgttttcaaaaactagtaacaactatacaacctattttcgaaaaatttttaacattgcacaaaaaaatctatttgatgaattgtctactgacggattgtcccttaattatggattgtctgtccttcactgacggattatccgttgacggattgtccaccgacggattgtccctcaatgatggcttttccttcactgacggattatctgttgacggattgtccagtgagggattgtcccttaatgacggattatccgttgacggattgtcccttaatgatggattgtccttcactgacggattatccgttaacggattgtccactgacggattgcccggatcccataaaaatgaagacgccaaaattaagttgacttaaaatacagctggaattttgaatttaaaaaacccggcttaggatcaggattttctagatggaccaggatttgaacaggtctcccgccggtccttttcatttttacaaaatattcatgaccagacccgaagaaatcttatacatactcctgtccgggctctctattaaaaactgctggtagtaagacttagataaaaacttaatcaatttaaaaaaaaaattatgaatttactttagatattttttttcatattttagaattttcccatttcgaattattcaaattgaggcaaatggccaacatttgtgggcccaatttttaagtccagctgctcaaaattggaaagaattcaattcggagcaactgcaatatattggtcgggtaaagccaaatattttcgtatttcttaaacaatatttaaaatttcggaattttttcagaaaattttaaatttatttgtcaactctctgaatt

SEQ ID NO: 41561 - DNA, 591 bp, Heterodera glycines
cgggcggcttcgcgaccgtttttaaatattagtgggcttgggcgggcgcttcgcgaccgttttttaaatttagttaggcccagtcgagcgcttcacgcccgtttttcaaattttgttgggcttgggcgggcgcttcgcgaccgttttttaaatttgtttgggccagacgggcgcttcgcgcccgttttttaaatttagttaggtctagacgggcgcttcgcgcccgttttttaaatttagttggggccagacgggcgcttcacgcccgtttttcaatttagttggggccagacgggcgcttcgcgcccgtttgatcgttttttaaatttgtttgggccagacgggcgcttcgcgcccgttttttaggggtacaacagtgattcattaaattaaaatgaaaatattttttaacaaatttaattaaaaaaatacatgaaattctatcaattaaaaaaataattaatttaaacttataaaatttatttatcaaaaaaaattaaatataattttttatttattaactcaacaaaatattttaaattaattaaaatcattgaaaataacgtaaaaatgcacagaaaaataatgtta

SEQ ID NO: 41562 - DNA, 1032 bp, Heterodera glycines
attagcatcggggttacgagatagaatattgtcctaaaaagagatagccatttttctgagaattaattcacaatttccgcagctcttgcggtaatggaaaaaattttgaagaggctctgcggaacggattagcatcggggttacgagatataaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaatattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaatattgtcctaaaaagagatagccatttttctgagaattaattcacaatttccgcagctcttgcggtaatggaaaaaattttgaagaggctctgcggaaacgattaccatcggggtta

SEQ ID NO: 41563 - DNA, 1175 bp, Heterodera glycines
  misc_feature (61)..(61): n is a, c, g, or t
  misc_feature (1027)..(1027): n is a, c, g, or t
tgtaatatgttgaaggcaagccaagtgcttcgatttcccatcttctcttggagtgtgcacncatttggataaagcttggccagcagttgcaattggccgatcaaaaaagacaatccgatcggggaacagatcatatgtgttgattgatttcaactgattgagatcagtgagaattgtcggagaagtaaaaagacacaaattgtccaaaccatcagcatcgtgaaaaaacattgtacgaatgtttggtgcaaaaatgggccaaatttcacgcacaaaaaacttcccaaatcgactggacatggacatcatttccaaataaagaacattgcggaggggtcttgaggggggaggttatttttttatgacaaacatcggtactttcccattatgtgaccgcaagccaaactttttctgcaagaaaaagggataatccatcaatacaggccccccattaattactgaatttgaagtttcgcaaaacaaattttgttgtgcagcggacgatccggccaaggaaatggcacagaattggcataatgaataaacacagatagttttggcactttcgcgccagtgtcttttttaatttcaatttctcgccaaattgccaattcgcttttgccatcgaaatacgtgcgaaatcagtgccaatttgaggccgagttgagcacggtcaaaaaatgggaaaatgtccaccaaaacatcgctgcaaatccagcttaaattatgaaaatttatctaggaaaatgaaaaacttgtcctcatttcctttaccgtcggttcatttttgttgcattttatcacacttttcctttttacaattgattgatgacagaataattgttcaattgcagtacaactttttctagccacggaaatgtaaaatgcgaaaatgaattaaaaaaggggaaattaattttgtctatactctcaactatgaacaaaagcattaaatattctcgattagactggaaaggaccagggctttttctcaaaatagtgaagtgatgccgatatgcgccgatgngatttatttttgctcaatttgtgctaacaggttttcttgagacaaaaaatagaaatacatcattgattgcattggatgagcagcaactggcagagacgcagatggccacacaccagggatgggccaaattgaaaataaaaagcgaatg

SEQ ID NO: 41564 - DNA, 1035 bp, Heterodera glycines
ctatctctttttctggctcaacagtaatagagaattccaactcgcacccgcagaataattacgccgatactaattgttctggaatttgtttctcgacgcgtttgtttgggaaaaatttggaaaattggctatctctttttctgctcaacagtaataggaattccaaccgcattctcagaataattacgccgatactaattgttctggaatttgcttctcgacgcgtttgttcgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattacaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcgacgcgtttgtttgggaaaaatttggaaaattggctatctctttttctgctcgacagtaataggaattccaaccgcattctcagaataattacgccgatactaattgttctgggaatttgtttctcggcgcgtttggttggggaaaaatttggaatattggctatctctttttctgctcacagtaatagga

SEQ ID NO: 41565 - DNA, 952 bp, Heterodera glycines
  misc_feature (39)..(39): n is a, c, g, or t
ggaaaaatttggaaaattggctatctcttttctgctcancagtaataggattccaccggcattctcagaataattacgccgatactaattgttctggaatttgtttctctgcgcgtttgttggggaaaaattgggaaaattggctatctctttttctgctcaacagtaataggaattccaaccgcattctcagaataattacgccgatactaattgttctgtaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaacgcattctcaaaaaaattac

SEQ ID NO: 41566 - DNA, 1125 bp, Heterodera glycines
agagccgttgttggtcgttttgtgccgcaacatcaccaacaacaacaaatccaacggtatggtggtggtgttggtcatggcgtcagcggcggtggcatgggacggcacgcgttgacggatcggtatgtgtgcatctgctgtgtcaagacccatgacactcattgttgggatgctatcgtggccgagctttcgacatattgaaacttttaccccctggaggtgtcgggttttcggtgaaattcggcaacactagttaccgggtttccgtttacgttttgtcggaaaatcgcttttttcatcatatttatgccggaatgttcagcttagtgggcgaggctctccagctgggcccctaccatgaccaacgggtggtggacgtggcacgacgcgagttggccgaggcgtaccaattggacgagcgcagcgtaagccgatggcattgaaattttcctagggctcactcaagttacgagacattgagaattgatcccccgagacttgagaaaacccgaaactttctcatcgatattcgtgttcgagaacagaacacaatcatttttatttgccgcaacaaaatgaatgatttttgtcgcgtcagatggactcggccgcctattcctacctgctggagcagcaccttggcggcgtctgtccggaggacatccaggacatcaacacgtactcccaggttggttgtgctcccgccggacaatccgtcggcgataaaatcccatccattttttaaaattaaatcgaacaatcgcaatcgcaaattttgatcatttctcgaaaaaattttttgcaaaataatgtccactgacggattgtccattatgaccgattgtctgaactccgctggttggttggttggtgatggtgaagtctcaaaaatactatttttaaaatcaaattttaaatttcattcttcagcatgcactgatgaggccggtccaagtggacgaagaggaggaggaggaagaagaagaactggtcgaagaccacgacgtcgaacgacgacaacaccactaccagcagcagcagcagcggaaatactgggtgggacagcagcaacagaaggtcgggggaagacgacctttttgctggtcacacactctgatcagttgc

SEQ ID NO: 41567 - DNA, 677 bp, Heterodera glycines
  misc_feature (580)..(580): n is a, c, g, or t
agacgattatctaattgaatttaaaaaccgaattttattaaaatatttattttagaatattcaaataacaattaaataattcttttagcgatgttcgcttcggtgctgttatcggaaaagcgtataaggtaaaatgggagaaaatatttcaatggcacggaccctcggaaaagggtaaaaatgccgagagtttagagtcgagaaattccattttcaaaattaatttgcacaaatttaatattttttgttgtaatttccgaactttaagggcacaatgtgctcctttgagttcagcggaggtgtcatcgttgaccatgccgaactgccggcatttgttgggctgaccgtagcgcatgaaatgggccacaattttgggttggcacagccaattaacgctttttcaccactaaaacttattttcttttcagaatggaccacgatgccggctatcccgagccttgcaaatgcccggcgcagcaatgcatcatggcaccggccagcagcaagttgctactgttttttggataatttaatgatggcattaaatgaaccaatctccaaaaaactgatgaataccttncactcttttttggattgatttattaattcatccgcatagcaattagtccatctggacaaaaaattgaagcaattaaaatgcatttaaactaattaat

SEQ ID NO: 41568 - DNA, 826 bp, Heterodera glycines
atacaggattaccgggatgggtgggttgggtaccacggagtgtagtctttcagtgtcgagtctgggagatgttgccacgggatgaatgagtgtcaggaaaggctctgttgcatttcaggcacccaatcggcttttaggcgtccaatcaatgacaatcctcgcttttttggacataatttgtttcttcattgatcaaaaaagcccacattttggtatcaaactaagaatttttgtgttacttttagcccagattttacttttataaaaacttcaagctccatttgattccaagaatgtgagccttggtaaaggaacaaaaaaaagttatggactaagaattgcattattatcttatgcataaattgtaagaaaaatcttattttttggtgattcaatttccaaattgttaaatttgtgcccattttttgtgattttccgttggtttaggctcgtccgacgatggaccgttggctgcaggagggaagcctttgggtgaatttttgtttatacccaaattgtggtgaatttggccatttctttagtgggaatactctggtatcatctttaatgcctttggtaatgtttcaggccgattggaccttccgcggcaaacatttgggcgtgtacgaattcggcacggacctgaacaggtccgactgggtgctgatccataagcacgaggagaagaagttcacggagaacaggcagcagatgggcacgctgaacattcccagcactttccctgtgcctcctttgcaggtgaccccgtcaaaaaacggcctcggaaatgcaaacatttgtaaaatttctggtcaccgacatttcg

SEQ ID NO: 41569 - DNA, 971 bp, Heterodera glycines
  misc_feature (18)..(19): n is a, c, g, or t
cgcaaaaacctaataatnntttttggtaaaaaccttaactcccccccccggaaattgtcaaaaaatttccccggcggcgcctatctgtaccgccagacctcctggtccccaaaaagttttaggaaaaaacgcgcccaaaaaagtggtataaatagcaaaaaaaaagggtcttcactgggcaaaataagcaaaaaatggtcgaacgtaggaaaatggggctctgaccccccccccccccccccatgggtgggtcaaagtcgaacgtaacacccaccacccccttgcaatctgatgatattcatattaattcatcaattaatggggaagcatttccaagtatgcccacaattaaaaatgaatgctttttaccgtgtcttgcgtaagatgcgtttcgacactgtccgggtagagatcaccgctcagctaaaagccacgaaaatcatcgcccgaaaatagcaatcaaacaactttagtcatgagttgagcccggaattttgaaattgccgggaccggggccgggacttcgagaatggaccgagcgggatcccgggaccgagactcccgttttccgggactccaggtcccggtggtttgtcaaaaaaaaaaacaggacctaggccgggagtcttggcaaaatcccggcgtggctccggtcccgtccgggctctagtcatgagtgagaatttttggcaataattaattgaacataaatttgttgggaaaatccagtaatgaaagggcgcccattggcaccgaccgaaacggaggaaaagctctccgtctgattggcacgggtccaccagtcgtagggccacgggaagaagcgcacatgcaattcgccgttcagcttgatctcgtagaagaaggcgtacaccacaaaatgcacttgcacataacgttggctttgcgacaccaaaaagcttttgtcaatgacaccttttatttccaccatatttggatttcttctgaaa

SEQ ID NO: 41570 - DNA, 958 bp, Heterodera glycines
tcacatggcgatttttcggcactcctggataattttcgcgctcatcaacggggactataaaggcgatctagaaggaatcggaagcgctaaaatcgttcgagaagcttttcgagcgtaattacgatttttacttacaccatttttcgctaggcttagatcacacgcgattttcggcactccgataattttagcgctcatcacgggacgtataaaggcgattcgtataaggaattcggaagcgctaaaattcgtttcgagaagctttttcgagcgtaattacgatttttacttagaccatttttttctaggcttagatcacatcgcgattttcggcactctgataattttagcgctcataatgggatgtataaaggcgattgtacaaggaattggaagcgttaaaattgtttgagaagctttttcgtaattacgatttttacttagaccatttttttctaggcttagatcacatcgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacacatttttttctaggcttagatcacatgcgattttcggcactctgataatttta

SEQ ID NO: 41571 - DNA, 739 bp, Heterodera glycines
caaaagccaaccaactaatgcagtaagttatgatttcctctttagtgttttgcgcttggcgatcccaacttggggaggaccttcctttgtcactggaggtggtggtgtctccctcccccgccccttcgctttggcttttcctttctcacttttggcattgcttttgttgtcgcttaggctggccaaattgttgttgatttgcacttcttcctcgtcgcttccactgaacaaaaagcaatcgtcaacttcatgaaatcgatcgtatttatattattgttgctgatataaaattaaaaaaaaagaatcgcttaagcaaatgaaattaaatatctaatattaataaataaatttccgtgtgattttgatatatactaaaatatttagttaggcattgtgtagattttgcaaaaggggaaacgggccacattaacggcgaagaacggcggcattaatagaaaatttattggaaaacagcggcagagatttccaaaataatacggctttttttgtttttgaatgttttgccaaataagccattcattcctccgttcatttaataccatatccatcagttattagtcatctcatcacaattgcatcagtcaaagaaaaaaccgaaataagtggaaattaacgaaaatgtgagaaattgtaaaatttttcacttaactcataagtaaactaactgcttgatagcttcaataaaaatcaggttcctgtttagcgctataattcctct

SEQ ID NO: 41572 - DNA, 639 bp, Heterodera glycines
  misc_feature (565)..(565): n is a, c, g, or t
  misc_feature (600)..(600): n is a, c, g, or t
aattaattcaaataaaaattaaaattaagaaaaattaaaataataaataagattaagaattaaattaaaataaattaaatttaattaaaaataaataaaacccaaagccaaatcctattggagaagggaagggtaggcgaaggggagggagtcagctgtcgtgccaatgggggaggggaaggaacgccaggccagctgaacgctcgcgtgtgccatttgagcacacgcaggggccatttgagagcccgcttgtgataatttgagcgattaaaattcaggttaatttaatgttgaaataaaatttcaaattaatccaaataaaaaataaacttaagaaagttaaaatcaaaataggattataattaaaattaaataaaattaattaaaaagattaaaattaaataaaatgcaaaataggatgaattaaaataatattaaaattatggtaggatttaaactaaataaaagataaataaaaataaaatataaagataaatctcagagaaataaacaattaaaagaatcaaaaattttgaaaatggtgcgggtataaatgcagggctanacggtggacggttaaactgtccttttgtgccgcgntgacaggtaaaatggcctttaagagaagagctggacatt

SEQ ID NO: 41573 - DNA, 936 bp, Heterodera glycines
tctctctcctcctctctctctctgtctctctctctcctctcatcgcattctctgtctctctctcctcctctctctctctctttctttctctctctctcctctctctctctctcctcctctctctctctgtctctctctcctctctctctcctcctcttaccaatggaaaagtatttagggagttagagttaagtaagtaaaaatggccattttagagttcggtatttttgatggctgatttaaagaaaaataaagagatacagagccagagaaatagtgattaaatagagcaaagttaggactataagaacacaaaaatataaaattttaattacaaaaattgaattattggagagccgaaactgaaagtggtctccaaaaacggcatttttcaagaccaccaagtaacataatgttttaaaagtggttttggaaattccgaatttaattaaacaaggtaaatcgggtatgttgagttcgaatatggtcttagagtaacaaacctgtacagctcaaacttcatgcatggagttggagcagtacacgctcaggttgaaaagataggtcccatttaaggccatattcggattctactggtctaaattgtatagaaaaactaagattttgttatatcagctttggtttttgaccataaaaaattcgagaaaaattagtgggccaattttcaattttggcatggtcgggaaaaaggcagaaaaatctatcaatcaaataaaaagtgaaaggatagtaagatataaaagaggacaccatgaagaacaaaataaaaaaagaatcatttaaataggcgcagaaataacggagttatgaatttttaaaaattggaaaaaaatctctgtcatttttttacttatttattttaatcctttgacaaattccacaaatagagcatcttcattctaaatttaatttatt

SEQ ID NO: 41574 - DNA, 1138 bp, Heterodera glycines
taaaatggcgattgtgcacagccctccgtttcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcgagaataaaagggctattgcgcaccgccctccctatcatgctcgagagaatttgtatgtgtataaaatttatcaaaaaaagagatagccatgttttctgggataaactctaaatataaaaatcccctgcgaaataaaaggggaatgtgcaccgccctccctcttcttctcaagagcttttgtgggggttaaaattttttcaaaaaaaaagaaaggcatttttttgggaaaaagataaatttaaaaattccctcaaaaa

SEQ ID NO: 41575 - DNA, 741 bp, Heterodera glycines
gaactttttgagacattcgcattttaaatttttgtgccctttcaggttttctaagtcagggggatttttataattctgcttccgaatctttcaattaattgcgcttgttcaggcgggttgaggtcactttggcgtgggactttttggcgccgcaactttaaagtgtcattttgcatgtaattaaataaaacaatcttgagaccattcgatagatcgtagtgttctcaattatcctgcaaaattttcgaaaattacacttggttaaaaaaagatatggcacgtggcgcaaatggccaaaaaacaaaaaaaaaaagtttgttgaggtttttttgccataacttttttgtgtccgagcaaaattttttgtttaaaatcaaattttttatttttgatgactcaaaatgttataaggtttggcggcgccgaagtgagcggactcattaattgcccccattctttcagagttaaatcgcgctgaaaattctccactctaattaaaaaatacaaaattgaattcatcttgtaaattgcaacatcttagagcgcgaattggcccatcatttgatggcccaattaattgttggtttcctcgcccttttcggcctacaccccatccaaatagcgctgcaattaagatgaatgtgtcaaaatgtgtaaaatttcgcacttaaatcataaggagactaactgcttgatagcttcaataaaaatcaggttcctgtttagcgctataattcctct

SEQ ID NO: 41576 - DNA, 1273 bp, Heterodera glycines
cattgtcaatgtgccaatctacatttacaaattcaaagtttttgtgccctcctctccccccagggtttgtccatctgcgcgttggcactttctctctttgcgttgctcctcgccgagacggactcggctctggtgaagcagttgatcaacaacaacgacgagacggagacggaacagcaccagtgggacaattacgcatatgaagaaaaaacagtggtgaagacgaaggacggctctgagcatgagcacgtgcgccaaaatacaattggtaattaattggtggatgaaatgccgggggaatgatcccaaaaaagcgaggatttgtggccaattagagggggagggccaggttggcttgttcgtaaaatcctcctgtcgtcaagcccagcttgaaagtctcgggcttatctcgggctggattcctcccacttttttctcacgttttctcacaatttttttgccaaatttccctcggcgtttagcgactgcgtggcgccactacgctcggcggttggagctgagcggttggctgcgcgaggccgagttgtgcctggtgctgttggtgattttgctgtggattgcccagggcatcgtctgccacttttatcgttacgcgaaattgcgaaaggtcgagaggtttgagcgcgcggcgaatggatacggcgcaggcggaactcggccgagcggcacaaatttccgaattcccgtggccacactccgacgtcttcagcacgtacagcagcagcagaagcaaatgcccagcggatcagcagcagcgacggggaaatattgaggaggaaaaaagtgatcggaagggattattggccaagacgaagccatttaagccgaattattaaacaattgtcttaaagaaaaagtgatctacgacgaaatttattaggcatttgagaagcataactgaattttagtgcaccaatgatcactttaagataatcgattggcccaaagtcggacattcgatcaaagaccagacaactgattgattgattgatttattgattggtacgatgtttaatgatcagacacatcaaattattcgaattgtttaatgccgttataaattaacaaacccgtaactgtgatcattctgaattcattcattgcttacataattttcacattttactgtctttttgttcggcgttttcatttaactaattgaatttaacaaattttcaattaacgctgcctttataaatagggcggggaattatatggaaatccatatttttttcggggactgtgggggggg

SEQ ID NO: 41577 - DNA, 1330 bp, Heterodera glycines
tcggatttgtgcaaaacatccatgtttcgaatcccgcccccactttcggacaaattttttaacttttttatttcttgccgctagtatcttctacaataatttgtcagtttggtcggatgtgcgtcaaacggaaaaaataattaaaattttataaaaacacataaatagtataacaaaaaatatcaaatttcagaacaaactaagggttctagtcgattttgctcgacacatgttattttacatatcccatgacactatacgagatacccctttttcttgcatataccatcactttatacattctctgacaacttaaatgataattgcgcatcgtcctgcctctcacgctcgagcgcttatgtaaagtataagattactctaaagaacagatagtcatttttcttggatataagatagatttataaattctctgtgaaataactggcgattgcgcaccgccctccctctcacgctcgagagcatttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaagaagagatagtcatttttcttggatataagataaatttaaaaattctcttagaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggataaagataaatttaaaaattctcttagaaattaaatggcgat

SEQ ID NO: 41578 - DNA, 1178 bp, Heterodera glycines
attttgttttatgtttaaagtatggctctttgcagtttccatcattgtaaaaaataataaaaaattaaagaagatatggaaaaaattttccaaaaattgtagaccaacaaaaatttaaagtttttcctttgaaaatttaattttgggaatgcttatgtgatggagttaatccgggacatgctttgtatgggcaaagaaaaaaccagtttatcaagcgttaaaagtttctttgttagcttatttcgtttccaaaatttttgggtttcagttaaattttttacaaaatattaaattaactcctaaaattaaatttgtttattttttgttcgaattatcataatgtatttttatggtcgtgtaaattttattataattaaaaaacaactcgaatctgaaggaatccaaataaataatccacattttatgaaggctatctatgcaaacaaccttaattaaaaacattttattgattcaatttttgaggaaagagttttattgaaatcattttttaatttattttttaatctttttctttagtatattgaaaaatgtccaaaatttattttttctttttatttttcctaatttctgtcaatcatggattatgtacatttggtaattgtttttttaactttgtttatttattatatttacaataataattgtaattcaaaattgtgaattaggaataaatatctgacattttaagagactaaaattggcgaattcgatgagcaatatccaaaaatgctgatcacaatgcaaaaaatatcgcaaaatgagcattttgaaaaagcgaaattaagaagggaagcatcgattttcaacatttatataatggactttttaagttctgtcgaaataaaaaaattaaataaatcgcagaaaaatattttctcagaaaaaatacgtcaattcgataaaatgacgagaaaatttgcacattcagtggagaacaattgcgaattgtggaagttttggcgtggcattggtaaaacggaatttcaaatagctaaaaaatgaattaaaatagtattatttaaataaaaaataattattacacaattaagcaacattaaaatttccaatgactgaaaatgatgatttgtatgaacaacaaaatgaaattgaattggatgaaatgaattgctctgaatttgaagaaatttgcaaaatat

SEQ ID NO: 41579 - DNA, 1156 bp, Heterodera glycines
atgacagtgctacggcaccggatggacaagcggtggccaaatggcttttcactccccgtccggacaatgtgccgaaggtgttcaaatgctggttgtacatggatgcttggacttgcccgtcaaatattgaacaattcaaaacggtgcttttattatttcattttcgttaatcaattttcccgtattttaggcctttgcctcggcttcatctcctgtcaatttcatcgtttccatttgcattccgttgccttttgctgactccgttttgctcttcgatctgaccaatggatttacgcatgaacaattgacgttgacatggatgaacgatatcggccgttttctgctgatccgtcgtccaattgtgcgcgatgaaagcaaatgggcaaaatgggagaaggatgcgattggctggcaattttatgaccaatggaatcgaatcgacatttgggtttcgtgacgctatgatcgacccaagtaatcagcagaagaagtggatgaatgaactgttaagaagtgatcgaccaatttggattgcggatgaatttgagcccatttgacgtttataaaattgttattttgtggcggtgatcacaattgtattatgtatatatgtgtgtataatatgcctctatgataaattaagagatttcctgaaattgcaggctcattcttttgggtcgggggtcgttttcgtacgagcagcacaagtttttagctataacttttttctttgctaaccatttagttagaatgctcgagaattatggataccgaaccgagaaatatgccggttttttcagttatcggtgcgatggcataaattaccgtatttatcgattaacccttttgggaagggttgagcaataaaagagccccgggccttataaccgaaaagtacgatatacaatatatcggtattcctgaaaaggggtttggtactgagatgggatcttacagtatataaaggaaaacgtcgccgttcaacggcatcccaaaaacaatccttttattttttctaaaacgaattttgttacgaattttgcattttttaaactctaatgattaaagaacaaaaaaaaaagttttacgagtccaataaaaaggagcaatttttatgagcacgtcaataattccataattcaattaggtcgatcac

SEQ ID NO: 41580 - DNA, 1102 bp, Heterodera glycines
gaaaatttcatttgtgattatgattttttttcttaaattaccaactaaagaaatttttataaaataaaattcacatctattttccattcttaatcgacaaataattaatgatattcctttttttctttccatcctttgtttcttctttaatttgatcagagctcgccgccgtcttttcgagcttcccattctttgtgcctttgattatggtaaattttaaagaattttaatgttttcaaggaattaaaaattataaattttgaatagcgattcaaaaatatatatataaagtgttcaaaaaatattataatcactagggaagcaacttttagtgaaaaaactttttttttgctcaattgttttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactattttttcactatttcgacattttttggaaaattccttaacaaaaatgcaataaaaccaaaaaatacacccctaagaatcgacctaaaaaattttcaaaaaaatacacccctaagaatcgacctaaaaaattttcaaaaaaatacacccctaagaatcgagcaaaaatttttcaaaatatactcctatgaaatgaaaaaaaattttctcaaaaatttactttcttggcaaaaatttttaattttaaaaatttttttaggtaactattttgggttttttggtcttaaaaatcccagtcctactcatttgcaactgcaaatagtgaataaaaattatttttgctcaatttttggctgaaaattatgtcactattcgtcactattttggacttttttcactattttgtcactattttggcactttttcgtcactattttagttaactatttcgggatttttcgtcactaaaagttgctaccctaataatcactaacgactcaggataaaaattacttttaaaaaagttctaaattatctcattcaatgaatgggaagttaatttttagcgcttttacttgattgaacacgcactgtcagtcgaaa

SEQ ID NO: 41581 - DNA, 901 bp, Heterodera glycines
gaaggagaattatacaataggggcctttttattaccaccccaacaaatcagcatggcgtctcaatgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggagacaaagtaatacgaatatttcaatttcttacttatccgaatagacaaagataggttacacacgaacatttttatagaaatttggctgaaactaaaatccctcttttggtcttaacctatgatttttggcccattatggatgaattaagtatagaaggcgtcgcagaaatacattcatattttctaaattcgggtttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattatacaataggggcctttttattatgattacaacaaatcagcatggcgtctcactgatatggtatgtttcagttaaggtttagccgatctacaaatttcggcactgtctattttgtaaaagcgaatccaattcctttggattccaagtggaattacagaattgcgacggcaaatcctaatagacaacgacgctttcattataaagctttaagggag

SEQ ID NO: 41582 - DNA, 917 bp, Heterodera glycines
tgtagtgatggatttatgaaacgtctattttggcgtttatgaaacgcctccagcggccggatatccgtatgacacgaagtatttacgtgtattttcgctaataaatatttataaatgcttttatattataaagttttgtcagaaagcttcattaaaataaaatgtttttaaatcttttattattactgagcttatcatgcatttgtcaggccgaaggtaaaatattaaaatattaaccaataaataaataaatttgcagtattaaattcgatgaaaatgatggaattggcacgtttagctgtcccttttgctaacaatgctaatccaaacaaacatttatttatggaatggattgataaatatgcatttcgcttattatgccagaaaaactttttggaaataaatgcaaaaaattattttgtaagtgaattatcaggatggtatgaattaggaaaaattcaaagcaatttttgtgaagcatttgctaaaggggaaatttcaaaagtaacagaagaaaattgggaaaaaatgacaattaaatttgcaaattattttgacgagacgcaaaaaaatgaagaaaatattcgaaagaatattcaaaaaatcaatgataaatttgtgaaattctttggaaaggaaacagacaatattcttgataatgtttttgatgcactcaaagtgatagcagacataggtaaattggccaatatttttgtttttaattttcattaatgaaatccattagcattggccaacaagcccaaaatgtgccatttgcaacacaaagttgcacagcccatgcagtcgttggctgccgaaattcacaacaaagctttgaaaatggtaattgaaatatttaataatttttaccgatttattaatcatctccttaatcacatttagaaaagtatattatt

SEQ ID NO: 41583 - DNA, 1078 bp, Heterodera glycines
  misc_feature (1036)..(1036): n is a, c, g, or t
cgatgcagtcgcggcgttgacaactgagatggaaccaaaagtttccataatatctttccataaggcgggaaaggcagaatttgaatggccagtcgatatttacactaagcacccgttgaagcgggtgatgcgaagccatagcaaactgtatttttaaattctggccgcaattctaccaaaaacgtgtttagaccgcagtataacgatgctctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaaggaacgcaaaagagatgatttaaaagcgattcgaaaattctatcgactgatataataacgatgcagtcgcggcgttgacaactgagatggaaccaaaagttccataatatctttccataaggctggaaaggcagaatttgaatggccagtcgatatttacaatgagcgcccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactaagcacccgttggaagcgggtgatgcgaagccatagcaaactgtatttttanattctggccgcaatctaccaaaaacgtggttagaccgcagta

SEQ ID NO: 41584 - DNA, 762 bp, Heterodera glycines
tctttttctgctcaacactctagacaattcaacccgcattacggaataatagcgccacccctaaattttcccgaaattctttctgggcgagtttgattgtgaaattttggaaaaacgcctatctctttttctgctcaacactctagacaattccaaccccatttacggaatgatagcgccaaccctaatttttccggaatttctttctgggcgagtttgattttgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgccaaccctaatttttccggaacggaatttctttctgggcgagtttgattgtgaaaattttggaaaaacgcctatctctttttctgctcaacactctagacaattccaaccccatttacggaataatagcgccaaccctaatttttccggaatttctttctgggcgagtttgattgtgaaaattttggaaaaacgcctatctctttttctgctcaacactctagacaattccaaccccatttacggaatgatagcgcccaccctaattttttcggaatttctttctgggcgaagtttgattgtgaaaattttggaaaaacgcctatctctttttc

SEQ ID NO: 41585 - DNA, 1471 bp, Heterodera glycines
  misc_feature (1448)..(1448): n is a, c, g, or t
aaattattaaaaaaaaatttttttttgggaaaacattaaaatgttatacggatcaattcccagacggattggccagctctgtcaaaatgttcgtagaagctgtacggtgttgtcgtgtggtagatgaattgcggttgtgccgatatttcgtcgacaattggcacttcgccacgcggcggcggcggtgaaggatgaagcgattgcgtcaaatgaagctccggttggtccatcacaatgtccttttttggtgtgccgggctgagccaaatgcgtctgatgaagttcatcggatgctaaaggacaaatatgggataaatggaaagaaccgctgattttctacaaaatttcttgtttgcccctttgattgtttttttgccggggatggaatagggaggagggggtgaaagtccagaaatttcattttcaaatttttgtggcttggtagtaactggttaaacaaacatgctatgcgtttttatacggtttgccattaaaccgggaggtgaggagagaggggggggggggggataaattaggtaaattttagggaaataggcaacttttaaggatagcagttacattttctatacccttaattttttgccttacgtttcagtttcaacaactgctcccggtccggttttccatggatttgtggcacaatttcctccaccgattgttgctgttgcgttttgttgccggccaaacgaaggcgtcgatcgccgtacaatgtgtagccggaaaagagcaacaacagcatcaacagggcgtagaacagccatttgccaatgtgttgttgctgtgcatcatttctgaataaaaggaattaaactcagtattaaaaaaaagtctgtagctcccagttagatttgaaaaatttcttacaaaactggtcaatttatcgctttttcgggactttactcaattttctgactgtttctggctccgtagccacaaaagccgaaaattggcaacagctaatcgtcccacctcacaaattttttttttaaattttttgcatagcgaagggggaaatttctgaaaaatggaaagcgctccgaaaaaattggtatgaaaaaagcccgcactggagaaaagttgaatatcgtaagaaaaataattagtaagattttaattttttttttagatttcattgccccctcgctcctttcatttttcgggtttcattacgcccctcagcatgccataggtcctgtgctaatattactttgaatgtatcgccgcaaacgctgccgcgtcttcccccgccatttgctgctcacgatgtcgtgacattgcccgggtgcgcaaaccgatgccgcgcacaccgccagcggaagtggaggacggaggcgtcccatccacagcggcggatgcgtaatagcgcggcggcgcgtcgccggctgttgacgctgcctgtgccacgtagcggcgctgcccagtcagccnagcgaatgtccaactgatcactg

SEQ ID NO: 41586 - DNA, 1116 bp, Heterodera glycines
aaatgttggtacccaagtttgcggtcaaatcccccaggagaaaaaagagatagccattttttcgccaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttgggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaaggaaatgttggtaccaagtttgcggtcaaatccccaagagaaaaaaagatagccattttttcggcaagaatttttt

SEQ ID NO: 41587 - DNA, 1333 bp, Heterodera glycines
  misc_feature (116)..(116): n is a, c, g, or t
aaaaatgaattttttttatttatttgttttaaatatttacccaaataattcttgttcaaattcattttgcacaaaatataatttgtccaacacaaattgtgttttccaattccgcncaattcgctcttttttaatttgtcccatttttcctcaaattcttccatcaatttatttggccaattttctactcgatttttgatgaattttgtcgtcacttcaatcgcaatgagaagcattgcaatgtccaaatgcttctcaaattgtccatcttccgaataaattttatacacttttttcaactttttctcattcattaaatcttaattgtttttattattattttttccattttatattttatttaccaaatattctttcgatgccaattctttccaatgcttcttttgtgcccttttcttctttgctcatttcctctgaattttcctcttttatttccattaaatttgttttatttttttgtccattttccgcttcttcgccttttatttttccatttttaactgttccattggttacattttgtcctgtcgacactttgtcctttttctgtttcggcgtttgtttaaattctttttctccatccttctcaattttcatcgaattttgctcatttttttgcgactttttataaacttttttccttttccgttgatcatttttcttttcatttgccaaattcttttcagtgctttttatcatttgccaaatttcgctttctgttttggcgatttgtccgttttgcgtttcggcactttgttcattttttacggtttgtccatttttggcacagctttcttccctttctccttcaaattcgttttgtgtttcccaaaaaagctctttttctgatgaggacgaagacaaaaattcgggcggagttaaataattaatttcctaaaaataaataaattttttaattttaaattgtattatgatctttgatcacctcagtcaaaagtactcgaagcttcttaattgcgtttgaatccaataactcagaccacaagtgctcttaaataattttgtatatttaaattccaattaattagaagagatcgcaaagaatcacgcttcgcaaaaggattaggacggtattccgggatttcaatccttattacgattacactgaattctgttttgtttttcacaaaatcattggtcgcgactgactagtgcactaccgctacaccactggtatttcatcattaaaaagtttggcattttttatctcggcacagggggtcatttggcagaaatttaaaacattttttcttagaaccccaggtgtgctctatctacccaaaaaatctca

SEQ ID NO: 41588 - DNA, 709 bp, Heterodera glycines
ctcttctaatagctgttgtacctcttctaataactgttgtacctcttctatttactgttgtacatcttttaatcacagttgtacctcttctaatcaccgttgtacctcttgtaatcactgttgtacctcttttaatcacttttgtgactcttctgatcactggtgtacctcttttaatcactgttgtacctcttttaatcactgttgtacctcttctatcagcggagcgccctttgaggccgcgaagcggccgaaagtcctccacaaaattatgaatgcgtcctcacttttgcttgcgtttgatggcccataactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttttccagttcagtccccgttgaataactcattaggctttgacctgagcgcaggatggccagcagacttattgtagagctttggaagctcgattttctgaaatttaaaaatttcgaaaattttcaaaatttttcgagctaggcctaaaaaacggttttttggtttttgaattttaggattttttaacgaattttcccagaaaaaacgagaccacttccaaacatagtttttcgagctctatcgactggtatttttt

SEQ ID NO: 41589 - DNA, 701 bp, Heterodera glycines
tttttataaattttagaccctttttgagtagattaaactagaaaaaatagaaaattttgatctcatttttcactctcccttctcccgggggtattattttgaagtctttttttccccaataaacttttcaaaccccatttttcgcaccgtgaatgttatttttatggaattttgaaccgttttgagtagattagactagaaaaaattgaaaattttgaaatcatgtttccccctcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaatttgaaatca

SEQ ID NO: 41590 - DNA, 882 bp, Heterodera glycines
gggagaagggagtgggaaacttgtagtctaatatactcaaaccggttcagaattcaataaaaataacattcacggtgcgaaaaatggggtatgaaaagtttattggggaaaaaagactttacaaaataatacccctgggagaagggagtgggaaacatgatttcgaaattttcaattttttgtagtctaagctactcaaaccggttcagaattcaataaaaataacattcacggtgcgaaaaatggggtatgaaaagtttattggggaaaaaagactttacaaaataatacccctgggagaagggagtgggaaacatgatttcgaaattttcaattttttgtactctaatctactcaaaccggttcagaattcaataaaaataacattcacggtgcgaaaaatggggtatgaaaaatttattggggaaaaaagactttacaaaataatacccctgggagaagggagtgggaaacattgatgtctaatctactcaaaccggttcagaattcaataaaaataacattcacggtgcgaaaaatggggtatgaaaagtttattggggaaaaaagactttacaaaataatacccctgggagaagggagtgggaaacatgatttcgaaattttcaattttttgtactctaatctactcaaaccggttcagaattcaataaaaataacattcacggtgcgaaaaatggggtatgaaaagtttattggggaaaaaagactttacaaaataatacccctgggagaagggagtgggaaacatgatttaaaattttcaattttttgtagtctaactactcaaaccggttcagaattcaataaaataaccttcacggcgcgaaaaatggggtaatgaaagtttatttggggaaa

SEQ ID NO: 41591 - DNA, 185 bp, Heterodera glycines
caaatttgacgacattaaggattgctgctggtcgagttggccgcactttgcaccggcatccgatggaccatttcgcaactgatcatgcagggcgaagagtgcgcaacgccaattcgacacccattggacattgtcagtgccaacacaaaaccaatttatcacagcataaaattttggaaatttaa

SEQ ID NO: 41592 - DNA, 873 bp, Heterodera glycines
cgaggcgcaaccagaccatacccagcctaaaaccctctcctaatattaattgaggaacgtaatcggggaaaggaaatattaaggatgagacgagttggttcaaagccgtgccgttttgaagaacaccaacttgaccggtgttaaatgcaatcaaacgctcaatgtccaagaaattgcgcgccccagcacgaattcgaagaacagcaccgcggacattgttcggagcaagttgagcaatcacctattgaatattttcaaattaatattcaatgttccttttctgcacctgttgtgcgttcgtatcaatgttcagattgatccgccgtcgaatgtcgtgcatctgttgggcgagggcattaaagtctgtcacgtagtcgagcaaagtgtcctaaacaaaatgttgcacttaagtgaacacaacagaaataacagacgtcaaaatcggccaactccccgcctccctcgacttcggtctcgtcttgttcgtcctcctcgccatcgtcgtcgtcatccatctcctcgaaatcatcatcagcgaccaagtgcgattgcagaacctgctcattggcgtcggctgcctcggaaatgttggctggcggtcggttcaactcaaaggcttcgcgttccaacagggcatcccagtatcgagctgggccaaattctgcgccgtttttcgtcatcattccttcgaacagcttcagcaatgtgttcacagtgtcgatgcccggcttctcatgtaactaaaagttgtttctaacatttgtaccaactaaaattaattaaacgcaccggaaatcttcccaatgcttcttgacaaaaagatttgccaagttctgctcatggaagcttttgacgataaacatggccctgctt

SEQ ID NO: 41593 - DNA, 1034 bp, Heterodera glycines
cttttcattgctgccatttttcatcacttcggcgcatattttccactcaaatccctttaaatgcaccgttccgctgctccgttcactcttcaaaatctctcgcgcaaattctgacaatttttcgatcgtccacaaaatgctcccgttggatttggttggatcggcgatgtccgttttcattccctccacaatgacatcaatggccaaaatgactttgtcctcgtttttgttatacaaccctttgctcgtgtccataagttcctggattttgacaataaaagtacctaaatccaattggcacccaccgaaaaagtaatgaaattgaagaagcctcgatacttttctgtgctattaaaaattatgtcatcgaatcgtccagttaaatcttccactccgcactttcgtgaaacaatgcgaaaggttgccgaacatttgcaactccaattctttttttcttaatcatataaaatatttttctaaattgtctcattttgtgcccatcttttttctctggaacggtgcaccaaaggaaaaagcccaaacatttctcattgctttctttatccgtcattatctccgcatttatttcccatttgaatcctttcatgagcactttctcttcactgtaacgctcagttcgcactttcttttgtgcgaattttgaaaattcctcaatttccaatgcgagtgtcgtccctctgttgccatgggatatgttccaatccgaaatgcgtccatggcttgggaatttcaacggataaagcccgggcgtaccacgaaagttcggatggcaatggaattggtaaacgccaacaatttcttcaattgttaaaatgccggagggaactgcgaaataaaaaagtcaaaaattagaaatcaaatgtttaaactaccaatgttcttcacaaaaacatgtggtaacatgcgtgggaaatggattttggtcagtgccgggccaagcgcagaacgaagattctcagcggaacattctttgccattttgacggcacttttcgtcggaccaacggagtgcct

SEQ ID NO: 41594 - DNA, 699 bp, Heterodera glycines
tcccacgccattattctgcaccctcatttccgggaatcttctaatcaaaaaccatagattccacttttaaaatcttctctctcaacacacataacatatacaaatcatttttggttgtgttgttgctgttgtaaatgttccattttttttttgtctccgtcgtccatcattggttgtcctcgtccactgttccgctggtgctcgccacgagcgccgagtcggaggccatcatttcggtgatgttcttctccaggctgtccacccgctgggtcatctcgtcaatgcggtgaatgatttggtcggccatcgcctggaaacggtcccgcgtctcgcgcaaaacgccctctatctgaaaacaattggttttctaacaataagttacaaaagcgcggaaaattttttagcaaatccgagtggaaaaaggaacaaataaatccatcatgacttgacccctaaaactcggatatttaggttcgccaataaaaaagtgctaaaaacacttaaaaaattttaaaagccaacgtcattttcggcactactcaaatagggactttttgttttacaaaatggatatgttaggatcgtgaattaccaaattactagcaaattgtgtaagaaacagctccattttccagattgatttatatttttctagtgtctggcgaattttaaaaggttcgctaatttcaatcccccccc

SEQ ID NO: 41595 - DNA, 1012 bp, Heterodera glycines
  misc_feature (980)..(980): n is a, c, g, or t
agagctgcggtagttgtgaattaattctcagaaaaatggctatctctttttaggacaatattctatctcgtaaccccgatgctaatctgttccgcagagcctcttcaaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcgctaattgtgaattaattctcagaaaaatggctatctcgttttagtacaattttctatctcgtaaccccgatactaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggtaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggtaattgtgaattaattctcagaaaaatggctatctctttttaggacaatattctatctcgtaaccccgatgctaatctgntccgcagagcctcttcaaattttttccattac

SEQ ID NO: 41596 - DNA, 1072 bp, Heterodera glycines
  misc_feature (46)..(46): n is a, c, g, or t
  misc_feature (931)..(931): n is a, c, g, or t
  misc_feature (950)..(950): n is a, c, g, or t
  misc_feature (1045)..(1045): n is a, c, g, or t
tcaaaagaagaggatagtcattttttcttggatataagataaattnaaaaattctctgtgaaattaaatggcgattgcgcaccgccctcccctctcacgctcgagcgcttttgtaacgtataaaatttctcaaaagaagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaagaagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttanaaattctctgagaaattanatggcgattgcgcaccgccctccctctcacgctcgagcgcttttgtaacgtataaaatttctcaaaagaagagatagtcatttttcttggatatnaagataatttaaaaatctctgagaaat

SEQ ID NO: 41597 - DNA, 1166 bp, Heterodera glycines
gcccacatttggacaaatgtaacccaagcagcgatgagcaaaatccttaaattgaaggcttaatttaatttggaagggcatctctgggcgaaaattatataaaaatttatttatttttaatatatattttatttcaacattttggttgagaaaacaagcttggccataagcgagcaaaacatttggcaattcgttaattggaaagtccaagaaggcctttagcagcaaagcgatgttatatttatttgcttaataaataaaaattaaaaaattaatattttttaaacattttcaccggcgtaaagcactgccatggcattttgtccgttcaattcgcttaaatcctccgcgtaaatgaagctcaacatcgctttgaacgcttctgcttcaacatcaggcacctcaattacgtgaggacagtcggcagaggctaaaaaatgatgaaaaattatttttagaaatattttcggtatttttttttgtttacttttagtctttgagtttttgtcatcaaaacggaacatcgacccaaacacagcagaagcgaacatcatcacgcatttgtgtgctttaaaaagctaaaaaaactcggaatagaaatggaacgatggggttttatcggataaagattcaattaaattataaaaattatccggtgtccttaaccctatcctgcaaaattttgtaatatttttttcaagggcaaatttatgccctaacacgaatatgatgtttgtttttagctcttatgcgtttttacaccgggcccccttacgacgaggggggggggggggtgtcgagacaacccttgtatatgtatgcacgaatctgacatccatttctatgaattccgaaccctgaacgcgaatcgaacaaaaaatcaaaaactcaaacttatcaaaaaaaaatttatcttttgcaaaaaaaatgattaaaacaaataaaattaatcagataataatattaaaaatataaatttcgactttttattcgaattcgggtttaaaaattcgtcaaaactggtgttaggttcgtgttcagcgcataaaattaccctaaaaaattgttaaaaacaaaaattcagggagggtgaccggggacaaaaaacggctacaaatccctgctttacgcagccgtgaaaatttaaaaaaacactggcaaattct

SEQ ID NO: 41598 - DNA, 1833 bp, Heterodera glycines
  misc_feature (74)..(74): n is a, c, g, or t
  misc_feature (89)..(89): n is a, c, g, or t
agatagatcagatcagcggtgtaatcgcagagaagccaaagcgaaaggttggacgaagtctgaacaatgagggnaagggggagggatgnggagaggaagtcggacaaaaaagggacacgaaaagcgatggaaatggacccaattaagcgatgaaaagcgacattgcctgataagggtaggaacagcggagcggaatgacaaaagcattgtacagaaaagcgaccagcacaaaggaaagccatccgacgtacaaagagccttcagaatgggaaaagcgatcagaaacagtgaccaaaggagcgaagaagcaccgaaagtgtcaatgtgagaaggcaaaaggcgcgacggagtggccacaatgtcctccaattggtcaccctttaaattttcaatagtttttaggccccaagtcattcagtgcccccgggggatcacccggtgcagtccgatcagtgacaccagcgatgcttttgcccccgcttccgagtccgccaccgtcgtcccctcctcctccgcgcgttcgtcgtccggcgtcggctcgcgcactaactgaacgtccagcaaaagtcaatgaatcggctttccctcccaaatgctcttctcattttacctcgtcacgaactgcagaagtgcgtcttctaaggtcgcgcgcaaattcgtgcagtttttccttgacaatgaaagaaagttgagaggcggtgtccgtgtgatggcgggaactgaaagaaatggacgaaaagccgagtaaaaaggccggggggggggggagtggcgccaaccttgcggaccaggccgttttcgcgccagcgcagtttttgaagtataactttttttcattgtcaaccaaatcaaaacagaaaacttcaaaaaactggttttctaaacatttttggccggaacttttttgaaacttaatgaaaatttcacaattttgcaggctaatagaggaaatatagggctatcgaatgatagcaagaaagttggatttggttgacaatgaaaaaagttatagttcaaaaactgcgctggcgcgaaaacggccggcgcgaaaacggcctggtccgaaaataggtttttcaaaaaaaattatatgcttaaaaaataaaaacctagaatggctctattaactcgaaattatgtttataaccatcataaaaaaaacattaccattggatagaagagggtcgacttctactgtgaattttaaattagaaatatctgattcaaaaaataaaaaagttatgcagcctcaaaatcggaattttaagcctaaaaaatgtttagtttttattatacattaattaaatttatttattttcatgttgggtttgaacccagccagacctccaaaaataggaattaaaccaaatgagccaccaattttgttcattttcctcactttcaccatcgcggaatggaaaatagcaaaattactatttttgaagctcatttttttcaaggatctatacttatggccccctctattaaagcagcctctttgaccgacaccctcaagacaatttaaattcatgagccaaaaggagaattttttttatccaacataatatatttcagttttattttgttctaattaaaatatttagtttttctggatgggataatctggataatgtactttcatctaaaccggcaagagaaatgaacgcgtggatggacgcatctagatgtgtttggcgcgaaggagtgccgaaatcaggatgttgtgatgaaaactacattctcgtaacaccatcaaaaagcgtcaacgattggttgggaaagaatcggccgcatactgacgacatcgaaagctttttgtaaaacggccaacaa

SEQ ID NO: 41599 - DNA, 729 bp, Heterodera glycines
gttttcccaaaaaagtgcggtttcgtccaaactttttttgataaaatcaaactttataattaatgaacatatgcattaaagaaattttgtaaatgtttttttaatttgaaggattgaaaaataatagtcaactaattaagcattaattattagtaatttaattttatctttcaaaagcttttcggtaaattggtactcagcggtgcgaacagccaagttggtttaaaattttctaaagaaatcttgtgtaaattttgatattatttgaagaataatcatggtgtttttaagagttaacccccccccccccccaataaattcagggccaacaggcgccgtgaacgaaagaaatgccatgaatgaaatgcatactgttccaaatttgagaaagtgtattggcgactgattcaaaatgataaataaagtggatataattttaaaacagtgctccatttttattaaatgaatgagtgatcggattagttctctgatcactttggtgagattgacttgtggaaacagccataggcaccaagaaattttcaaattttgaaaaattctcagtatgttttcagagtttatatttttgcgtaatttacaattaacaaattattatgttttttcttggtacgatttacgttttctttttgaatattcagtgttcttgattgaattttaattcagcgacatattcagtatagtttaaaggatcagctatagtttgtaatg

SEQ ID NO: 41600 - DNA, 973 bp, Heterodera glycines
  misc_feature (854)..(854): n is a, c, g, or t
actgaaaatggaaagaatggccttaactcctccgtttcgtttatgcagtaacacgccgagtgaagcacttccttcaaaaaatgttctttcttttctcaatttgatctcattgcctggggctgtcgggtgatcggtgcctcgtaactgatctcgaacaacttttcgaatgcttggatgatgaacacgatcgagatcagagtggcaaatgcctcctcagtgaagcgagtgatcagtgcgaccaacgcggacgcatcggtggccaccaaaatgatcagataaaagctcatccaaaggccgacgtaaaagcgaaagggcagaaactcccaatgattggtactgaaagggaagggcggaaatggcggaaattttaaaaaaaattgaaaaattacgtgcaaaaatcaaaaagaattttctcaaagatcaaagtgggaccggtggcggacagaacatctgaaggatgggagagaacattgacagaattagggaaacaaactcagcggttgcccactgaataggccaaagagaaggccggacagagcgccacaaattatatttgaaaagagagagacaattaattaacaaattaattggggtaattagttaattaattagttggattaattaatttaggagaacaactatgagtaattaattctgtaattttcaaacgtattttcaatggaagcaatttggtggtggaaagaacgctccataatggcgccgaaagtgattatgttggacagattggcgaagaacagaaggatggtggcggcgagggattggctgagacggccgcggaagaaatccgagaaatccgacggaaaccaaggcaatttgcgcctgatgaagaaggngggggaattatattttgggataattatatatttatattttggaatatttatttttgttttttccccaatcccaccgtatgtcggccatcagtcccccgaaaagtctccccggtacggta

SEQ ID NO: 41601 - DNA, 1285 bp, Heterodera glycines
attttttcaaaattataagatgaattattattatttttttctatttcaaaaatcgcttgaaaagattttcaaaaattttttcttgttttttattaaaaatttttatatttttaaaatttctaattttaaattaaatcggaaacggcggtggaaagtgacctgctccaacttcatccttccttacttttttcacacattgccattctcccatcaccacaggtggacttgaagctgtacgagatctcctggtactggtccgactggctgcgcaatgcgatgactgaggcggcccgggcgcgtgacgagcagcacagacgcgtggcgttggatgccgcttcgatggcacagcagcactatcagcagcagccaccgcagctgtaccaacaacaacaccatcagcatcatcagtaccaatggttgattgaccatcacagttaattggacacattgctttacgtttttttatatgttttgctgacaaatgaataatttcgctaattgggtttgatgaccgaagaagaagaagcattgttattttatagttaactctcattcattatcacattgtcaacgcattaattattattttgtcatcatcttttaattgtcttacacacgttcattcggtgctgggacgttagtcaaaaaccatcaaaatgggcgttagtcaaaaaaccatcaaatgaataatttttgacagaaaattattcataattttgtctaaaatggatcaaattttataatattgatatttttcgatagccctaagtgttttctattatcctgcaaaaattttaaaaattctttaagtttaaaaaaagttatgacctgagaagctcaaaaaaccaagtttttttgaacatttttagtcataactttcttgatacttaacgaaactttttggaattttgtaggctaatagaaaacacttagtgctatttttctaatcaaaggttgaagcccttaaatccttttcaatgcacattattggaatttttagcatgtatttaaaaatggttttaaggatagatgaatgaaaatagtgggctatctgtatgcaaaatttctaacatttttgacgattttttaccgtccatgaaccgaaaattttccaatgtgtattttagagccccacttaaattgggagacaaattttagtgtttcaccaattcctcaacaatttcgcccatgggcacaagaaaattctccaccaccaatatgtacagagaagacagacaatgaatggtctctctcccatctattaaattcgggggagggggggggg

SEQ ID NO: 41602 - DNA, 1043 bp, Heterodera glycines
  misc_feature (248)..(248): n is a, c, g, or t
attcttttttgatcagttggggaaatgtcagttggcgaaatgaatgttttggctgagttggcgaaatgaatgtttttggctagagaccggaaatttcaaatttgcggatcctgttgcaggattggaattcaaaattttttacaggacaggatccggcaggattaatcctgcaaatcctgcaatcctgcatttaaaatctgcaggatcctgcgcacgatttctgcgcgggggggggttggaagccccanccccgagccgcgaagcggccgagtgagtaccttcggtgcaggaaaattattaaggaagagagttcattatttatttgttttttgcataattaattcataaatatttttttcagaaagggttctgaaacgcaccaaattttatttacatgttagtttaggcactcagatgctttcactatcaaaaaagggagatgaataaaaaatctaaaaattttaattgctttttaaacaggccaaaaagtttaggcttaacttttttttcagaaactgatcagaagcgaaccagattttgcgagagcatcaaaaagacaaggaaaagcactgctatgatgctaacaccagtaattctgaatttaaaattttttattaatttttaaagcttcactattttatttttttagcaaaattaattcataaatattttttcagaaactgctctgaaacgcatcaaattttaattacaagttattttaggcactcagatgctttcaatatcaaaaagggagatgaataaaaaatctaaaaatttttaattgctttttaaatatgcgaaaaattttaggcttaacttttttttataaacttatcagaagcgaaccagattttgcgagagcatcaaaaagacaaggaaaagcactgctatgatgctaactccagtaattctgaatttaaaattttttattaatttttaaagcttcactattttatttttttagcaaaatgaattcataaatattttttcagaaactgctctgaaacgcaccaaattttatttgcaagttattttaggcactc

SEQ ID NO: 41603 - DNA, 893 bp, Heterodera glycines
aaattggaaatcaaacatttcccatttttggcaggacgtcaaattagtcagccctaccggttggcatattaaaagggtggagtatttttatttcttttactaattcagggcacccacgagcgctcgctatggccaatggcacaaggatcagcgttactcgcagatgcgctcgggcccgcgactgatcattttcattgtcggtggcgtcactttttccgaattgcgatcggcttacgaagtgaccagaacgcaaaagacgtgggaagtcgtcattggttggtcatatacctgtttgtatcatatttaatgccaatattttgatttttaggttcagatcagatcatcactcctgaacgttttctggtcaatttgcgtgagttgagcaaaaaatctcacgattgatactgacttcacttttgcacattcctttggttggtcactattttcttttttgcttcgtttcttttttgctttggttcttttattccccaaattgatttatgtaaatttaaaaaaggtaaattaaaacgcaaggaaaaatacccttttctaaaacataaatcattgtacattatatataaatgatttgcacattatttattctccttttgatcctgtcgcacctgattaaattttgattcttttgatcgaattcaagtcacattcaaatttcgaagctttaattcacattccagtcaattctctttttgtcattcatcctttaaaaaaacataacctgacaaaaaaaaatttgaaatcctttattaaagtttaaaaaaggttgtgctttttatcacccccacccctccaccataaaagcacgataatttgtcattgtttttgtccgattgtagtctaaaaacaaatatgtgaagttcaaatgcattaaatat

SEQ ID NO: 41604 - DNA, 819 bp, Heterodera glycines
ttttcattagaacgtcatttttagtcaaaaaaaaaatatatatattttttaggttttggaagaaaatagttatttaagcatttttaaattttgccaatatttttgttaaaatgcattcaaaaatttcgaaaattataattcatttaggcatcagtcgataaattttcaaattccgtttaattaatttttcattttttaaatttaatttattatcacctggcattgcgccaacaattttgtcatagccaaaatatttccattgtgaaattgttggcgaaatgctttgtgagccgacaaattttttgatggttggaaatgcgcggagaatactcatcgaaaaatcacccatgcctgtctccaaaatgcccacattgaattggaatgatttcaattcgttgatcagcttacgattggcaattaaaaaatctaaaaattaatttatttttgaaagaaaaaaaacaaataccgtaccaaattgtgccatgtacggtacgtcacggtgtggtaaaaaattggtacccttccaaatttgccaccataaattttgctgctgttttaactgtgcgacggcttcggaacaatttttggcattgccaaagctaaaagtcattctgtgccacaccataagtcgtccatcaaattttgatggcacttcagttggctcggcacagtccgcttcactgacgagaagaagctgaaaatggcaattttaaattggcgattaagccaaatcagtaatgagataaataatttttaaaatcaaaaattattgtcaagaataaataaataaattttgagagtgaatttttgagaatattt

SEQ ID NO: 41605 - DNA, 1056 bp, Heterodera glycines
atttaaacagttaattagttttttattcaatctcacagtgataaatattaaattttcattatttatctctttctgttcaatttgatttttatattctttaatacttacgaaacatagtttatcttcccaatctattcattttttatgatttaatccatcataaaaaatttaagacatttattaatatattttcaaaatcaaaatttttatttctttataataatttataattttttggatttttatttctaactaagtaaggctcgccttgttgctacaacttgtagtaggatccttcttggaatggcattgagcataggataaatttgtgtttttgatttatatattaattcatgaatatctttttactttttatttataaaaacttttttttagattagattttcattcctattttgttaaggtcggtatttcattatgaagcgtgtatattaaaaaaatatataaggcgacgttttaaaaggagtgagactgaaacaaggagagacagatagagagaaaaatagagaaaagaggagaggtgaacgagtgagaaaaaaggagagagtaaaaagaagagagagagaagagagagcaaaggggggagagagagagaaagcgataaaagggatagaagaggagagagagagagaaaagaggagagagagaaaaaagaagagaaagagagacagagagaaaagagaagagagagaaaagaggagagagaggagagaaaaaaaggagagtgtgactgaaacagggagagacagatagagataaaaaatagattaaaaagaagaggagaaagagtgagaaaagaggagagggaaaaaaagagagagagaaaaaaggagagagaaaaagggggagagagaggaaagagaagagataaaaagacgggagagagagagagaaaaagaaaaaggaatgcgaggtgcgcgagcgaagcgagcgcatctgcgctagttgatattaaaaatttgatttaatttcacatcaaaaattaaattttactttttgagatattcatgaaaaaatttttcaattcttccctgg

SEQ ID NO: 41606 - DNA, 1287 bp, Heterodera glycines
cgattttccctacaattttataaaaaattatattggcattttattaccattattttctttctgttggcatttcatttcattttcggcttttcctccccattcaatcaccttttaagctggtgatattaaactctttgctcagccgttcaaagtcctcctctctcccgtagtgacagtaccccgcttcgccttcccccgttcctcgggcagaatatgtcaaccattggatggacgagcgcaggtcctccgaattgggcgccataagttcgggactgactccgtccatgcggaaattgacttggccgtcggcggacagaacggagagatgattgggagaagagaagttggggtaggagaggagcacgtcgtaggggacaaaatgcacgtctgggaaagaacaatgaagggttggccaattcagtccgggaagagcccgtccgatcagtgattctaccactgatcgtcctctccccccccccccaattaccttcaattccgttttgcttccaaatctttgcaattttctcagccacctccatttagtcaattagcgtgcattagtcttttacctcttttgttcatttacccttttattcgcttctgtccccgccacgtgcggctcttttgtgaattgccgcaaattttccgcaattcgttttgggtcaatcgttgcaaagattgcctcgcgaatttctgaaagttttttttcctttgctttttgccttcgattgattacctttggcattatttgttctgtgatttggtgtcattttgtggtgaaaatgattttttccgctgaacaaaatgatgaagagaaaggagccgaagcaaaatgcggcgagcatcgaatatttacggaacaaaagcagcgaaagtgccaacagagaggtgccatttggagggggcgaatgggcgggggaaaaagggacggagtcggaggagtggggacacctcccgggggcattgcgcagctttgagctcatctgttaaattgtggaacgcataattggccatgcttatgggattgcttggccaaatgaaaagtgtcaattaaaaaatgccattggtcgcaatatttcccccccccccattttgaacgattcatttggcatttgatgcgagtgaggaaggatcatttgtagaaaagaatgaatgaatttggggagtcaatgggtcagcagcacaaatcattagcacaatttgaccatttgggtgatttccttccccccccccccccaattcactttcttatcaacaaaaagttgtttatatttttacaaggaatta

SEQ ID NO: 41607 - DNA, 853 bp, Heterodera glycines
aatttccaaatttcccggcctcgactcttataacatttgctcaacatgtaaaaccatgtcagtttttgaacaaaatctgttaacaaattacaacaaaaattttcgaaaaattttcaaagaggcgcctaccggcgccgccggcccccttgctcccgatagtttttttttgaaaaaagctcgcctcaaaaaaacattcttaaagaccaaaaaaatcatagaatttacatggccggatcacccctcagccgattcgatcaatcatcatctttttcgaacactttgttgtacatcacagtgaatattgaggctatttaatctcagctttttgttgctctgatcagatctttaattccctctccgataactgcttggttttagatagtaatcatggcaattccgcttaacattagtgcggcatcgaattttttatattttacgaggtaaattaaaattaaaatgattttaattatacaacatatttttattataattttagcacggaatatcgacaagcatttcgagataaatttccaacgaaattttaaagtcatccaagtttctccacagcaaacctgaagctaattgaggaattaggggtagaaaactcgtaaaatcccgaaggaaggtccccatggcgtgatcaagcccagggatcagggctgaacgaaatttcgtttcgttttcggcactctttgagtttctttttcgttttcgtccgtcaaaatggtttcgtttcgtgtttcgttttcggttttcaaaatttctttttcgtttcgtgtttccttttcgtatcgaatgggctttttcgtttcgttttcgtaaccaaaaattttttttttgtgattttcgcaca

SEQ ID NO: 41608 - DNA, 874 bp, Heterodera glycines
ctagagccaaatttatacttgatgaaattcaggggatgcgttaaagtccagggacgcgtattctgcgctagaaccgaaaaatcaatattaaaaaaacataaatttattaattaagagccattatttggttatttctccaattttgatttttctgttccgaatatttcggctcaatttgccatgaggcgaacaacaactcaacaccaatgatcgccaacagcacaaaacagtagcaacagaaggaaggtggtaaaaatgaaaagcgacgaatgcccggcgatcaaaaaattgaaaattttaattttgtcaaatgacattttttattcttgttggttttatttgttggagtgagaatttaaagaattgcagctcagaaataattcaaattgaagaatgtaatgggataaaataaatgaaaaataaaattttaaaatttaatgaataaacaaatcttttaaaaaagcaaccggcggcggatgggaaaccaattaattaaatgtatacacaaattgaaacatatgattagacaattaaattcaattaggttggctaatcacaaattatgattgatttgcaaaaaaaaaaaaattgttacaatgtttggaccaaaaacaactgctgaatgacatgcatattgtaaaataatgtgactcataaagatcataaagatatgcgaactattaaaaagaagaattggaaaactttttatgcttcttaaagggtcatccgggagccggaaaatccgacactagcggtaaatccgacactagcggtaaatccgacactagcggtaaatccgacactagcggtaaatccgacaccggtggaaaatccgacactggaaaacccgacaccacaatgaattttaaaaata

SEQ ID NO: 41609 - DNA, 1114 bp, Heterodera glycines
cttcgatcagtttgcgcctctccaacagttggtccttggtcatgctttcgcggatgcggacagtgtggagaccattcaacgcttgcacctttccgcgcatgcggatgacgtgccacgctgcgtgtttgctcgggaattccattttgagggggcgcggtcgaccatccattcgtttgccgacacggaagacaattggtgcctgatcgacgtccgtggcattcaaaatttcgtccacaacggcacggtcctcccgggctctctccgtcgctttgtccgatttgctttcgtgcacatttgtcacaacgacggttctcagtcgtcgttcctcttcgaccgcgtcgactgccgcagcctgtgaatgaattaggacggaggcggtgcttaaaagggagtgaagctgcttaataagcaacttggcgtagtcgggaatggagttgtctgagtcaatttttttggggatttgtagttggtcaaggtcggataaaaaattttttggggcagtgttgtcagaaggaggagaaaaatttgccattctctttgccatcgattaggagaggagatgacaatttttaaggaaatgacaaattttaatttttttttttttttgaaattgtgtatgtcctcaaaagtcgagtcctcaaatgtctggggtttttgataacttttaatttttgcacgaattttttattccttttaaaactataaaaaaaattaattaaagatttaactttatgaatcactttcgagctgctttctctgttctccactgattgttcctaaaaaaaccacgaaaatagttgctaaaaatttagggctgcatttttgaaaaaaatttaggtcgtttcttaggtgtttattttttgaaaaaaatttaggtcgtttcttaggggtgtatttttcgttttattgcatttttcatctaataaaaaatataaaaaaaaattaatataactattaaatatttaaatatgtgctttttagcaaatttttattcacatgcaaaaaaagttttgcgaaggcaaaaagaaaaaagggggcaaaaagggccattttggggcggggggtgggagcagctaaatttttatttttttgatatcattcgatagccctgtgt

SEQ ID NO: 41610 - DNA, 635 bp, Heterodera glycines
accacccacaacccattgttgctcggactgttgttttggtgcttttgtgtatgtcaccgtcctgcccccccccccaaaaaaattgccaaaaattcccgtccactcccactctctctaccctttgttttgtttgttcgcgcacgcgcatagctccccccccctcccctcccccctgagttcccatcgtgttttcacaaattatcatcataaatatgtgagggttggatggatgaatatcatcaaaattgtatctctgttctgtgagggtttcaaaaactgtcggcaaattgcattgtcaccggaatattattgttagaatttcgatttatgattttttgtaaaaaatagggctacagaattttcgctttaagtttaccgactgatcggtttaaattgattatttcctcattttgagacaaattatctttgatcagggcagttcaaattgtccaaattgaggtattcgaaatctttcattcagtgactaaaacaattagcgttaagagactcaatttaattcgccaattaattgaatattttatgcgacctaatcaaatattatttcattgtgtccctttaattgatcaattagttagatgatgttatcattatcatttgacaaacattaattacga

SEQ ID NO: 41611 - DNA, 1056 bp, Heterodera glycines
aaaaatatgtcgcaattaaaatctaaattttacttgctaatgttcggcccatatttttctgctcaaagattgaatcgttaaatttttccgctaatttttgcaacatttcggcatttattttttccaattgttcaatttttggaattgcgaccagcgaaatgtcaaattcgatgccatcaaattgaaagcggacaatcaaaagtgagtccgactcaattttgataagatttgttgtgcttttgtgctaaaattttggttttaattttattttaattacaaattgctcaattaattaaataattgattaatttaccgcgcaaatttggcaaaaaagtgaagaatttgcctcatccgtgcatttattttcctcacatttcgattttctgtcatctcccataaaatcgctgactttcagcttttcacccggcgttaagcacaccaaattaacatcggagccaattgtgtgcgaatggagcagaagggagcccgagatgagcagttgggcgaggccatttgactgaaaatgcaaaataaaattaaaataaatttttaaatttaaaaattttgaataattttctcgagaatttatgagttttttttgtatattttcccttttggtgtagagaaaaaatatgaatagatttttcaatttttgcatgatgttatcggtccccaaaatccttttgataattaaaaaatctctttttcggatttcctttaggaataattttaaaacaatttttttagttaaaatactgtttttaaataaattctaattggggtttttgtcatttaaaatacatcttcatatttttacagtttaatcatacccatttttcaactacggtaacaatttgctgtaaagctccttccatttttattcgatagaaattttgttgaacataaatatttttgaagacattcgacgtcaaataattttcaaactaaattaaaatatattttaattgctattttaaaaattcattaaattcactaacttcttttgctgcttcatttgccacaagcattggattcaaaatcgtaatttgttgtgag

SEQ ID NO: 41612 - DNA, 1030 bp, Heterodera glycines
  misc_feature (31)..(31): n is a, c, g, or t
tcgactccgtttattaattatttaaaaaaancaatttgctttctcagtcaaacatttctgaagctcaatgtggacgcgtcaattaatggctacgatggtaaacaaatatgtgctcgatcattattgatggctgatcagtgatcataattttacacttttttaagaaaattttcttgttcgacaaccgtttccgctccttttacggtgccgaatgcgttcggtgaacggtgccgggcttttttcacgtaaacttttcttttatttatttcacatcccctcgttagcgaaaaattttcaataaattttaactgaggtggggggtgcgattttacggtgcaccccaaaactcagccgccgaaactcagccgaccgaaattcagccgaccgaaactcagccgagacataattcagccgtgaataaattttttaaaaattttcaaacttagaaatttttcaaaaaaaaatcttagaaaaatttttcttagaaaattctatgaaaaatagaacaaaactttggaggagaaacaaacaaaaaaaaacaacaacttacatatttttattggatttagtgacttttcgggtcacgatgtgccaaatgacttcgcccaaacaaatatgtaactttttttgtttaaaaatcaccttggccaatgcgagcacttcctcgctggagatgcccatttgtgccaatggagaaagacagagacgttccgccacagcgcggtctaacggatcagcactggacgcgtcgccaagacgagcatccaagacaaaatcggtgttcagccgtgacggtttggctttcgcagcaacaatcggcaaccgctgccccggtgacgaagttcaacaggcacaaattgtccaaaattgctgtcaaaaggaaggcaggcaccgtcggtggatgggtatgaatatggactcaaattttatgtaatgtaatttatgaaaaactcatgaaaattgagttttcccttcctattcactatttttgggaggagtgcgccttcctttaaaaattttagaaaatttt

SEQ ID NO: 41613 - DNA, 953 bp, Heterodera glycines
  misc_feature (834)..(834): n is a, c, g, or t
tgttttcaggggcagtccccccgaaccgatgcgcccagatttatgggggagaccgaatccttaaaaaaaaagaatagaaaaataaaaaaaaatagatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattggttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttaaaaaaaaagaatagaaaaataaaaaaaaaatagatttttgctccccataattgtttgagtaccccaaacggacacttgaaaaaatcgatttttttgttttcggggcagtccccccgaaccgatcngcccagatttatgtggagaccgaatccttccggaatagcttccctatagtctgtactttaattctgcgttggattttgctccccataatcgtttgagtacccaaacagacacttgaaaa

SEQ ID NO: 41614 - DNA, 1304 bp, Heterodera glycines
cattttcacattcatcttttgtgatcttgcataatttgtcgttaatgtttaggtgaaatgaatcgccaaattgatactaaaaggcaaaagtctaaaatcacgcatgaagggcacctttacactttcgataaagcaagtgcggacgggatgacaaaattttggagatgcgaattcaaggacatttgcaagggaagtatctggacgaatttggctgatcaattcatacgtttggcgactgctcataggtgccctgcgaacgcatcaagcgttgaggtgcagaaagtcaagacggcgataaaacggcgtgcgctcgccacatatgaaccgccagcagtgatccgttccgaggcacttcaaaatgtgccgtctccagcaggactttaggttacacagaatagttcaagacaggtactgttcaattaatgatatacaatacaacgaatgaattgttaagatcgtcaaaagggcacgacatgaagtaatgcaccacctgtggttcctaaaagtgttgaccaactgattgtaccgccggcataccgaacatataagcctattgacggtgatgaatagcagttcctattgggtgactctggtgtgtattacgaggccggaaacgaaaatccgcagaggtagttttttgaataaaattccactttcactacattttttcaagaattctgctgtttgggcgtgcatcttttgggcgatgggctgatcgcatgaaggagtgtttcggagacggcacattctcattggcaccgccaatgttctatcaaatttacacaattttggccaggtaatgttttttctcttgtgatttaacaaggcaaattatttcaaggcgtggtgcgtgggttattgttgtgtgccattgcctcctgacgtccaagtcgcaggcatcctacgaaaggatgtatgaacttctgcggcaagcgtggccgacattctcgccaacttcgtttaccattgactttgagacagcagcgcgaaacgcaactgttaattcgttccctggatgtgcaatcaatttttgcttcttccacttcgtgaggaatttgcaaaagaaaatcaaggagcgaagtctctggcaggtacaataaacattttctattctattttttaatattttcgagtttccagcgctattgcactgatacagtgtttgcagaaacagatggaacttggtcacagccaacaatcccaccaaaacagtggaacgtctacactcgcacattgaatggggaagcgaggacaaacaatcacgcagaggcagaacaccaccgtcttcaaggcgccttcaattg

SEQ ID NO: 41615 - DNA, 282 bp, Heterodera glycines
ctgtgggctttgttgcaatttaggtttaaacaaaatttttaaaaactttatagtaattgaaagttgcgtaaatccattttaatttatcttatatcagttaatgatatttatttgtttgacactgatgtctctgttcaggctgccgaagctcatttgaacatcagcagcttttcctcttcctccgtttcttccttttacgactctccgcccgcgacagcggcggttgccaatggcttacaacgcaattccaacaacggggccaacaacagtttctgagtgcta

SEQ ID NO: 41616 - DNA, 706 bp, Heterodera glycines
  misc_feature (682)..(682): n is a, c, g, or t
aattaagccattttccctttgatcggtacacaattagccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttttgaggccagaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggccagaaggaaaatttgagagggctaatttatatgtaatattcgaaggtgccaagctaattagcgattcaggcgcacattggggcctgaattaagccattttccctttgatcggtacaaaattggccgaaaaagagatagccattttttgaggccagaaggaaaatttgagagggctaatttatatgtaatattcgaaagtgccaagctaattagcgattcaggcgcacattggggcctgaattaagccattttccctttgatcggtacaaaattggccgaaaaagagatagctattttctgaggcccgaaggnaaaattgagagggctaatttatat

SEQ ID NO: 41617 - DNA, 1029 bp, Heterodera glycines
  misc_feature (76)..(76): n is a, c, g, or t
  misc_feature (95)..(95): n is a, c, g, or t
  misc_feature (98)..(99): n is a, c, g, or t
  misc_feature (119)..(119): n is a, c, g, or t
tcttttctttgtgccggacggcgcggcattcattgtttcaataagcgtctaaatgtccgtttatatttaagtgaantaccttttaatataagganaanntatttgtatggagaattgtntttaaaaagttttattcaaaaatccaaataatttttattatttatttataatttccaccaattttaattttgttgtcatatttcaagcttttcatttaaatatttttacaaattgatattatctttgaaatatgatgctttaccttactatttgtgagcattaaatggtcttcggccatttcgggccattccaagcagacatggacagttttgaagcatcggtcaataatttaaaaaatgaataattaaaattataaatttaattagcttgtgctagaatatattttctatcattttgtcagatgcgtgccgtcaccgtcggtggcattgtgctgatcggcgtattactctgctgcctgatcatctgcttagtgaccatggtcgcctcgctgacattcagttgctggtggacacttggtaagacgaactattcataaagtttatatctgcaaaattcaaaaaatcagaggtgtgcgaattcaaatttttaataccctaggaattttttagccctttttcaaattttgttcaaaaatgacaattttcacgattttttagtcaatttttttacaaattattgagttttggagtctgtatgatgcccatagacgctgttgtgagaactgtaactcgagattttttctttattaataaaaaaataaaactaaaatttactcatattcctcaattttccccaaaaaactctaaatagggaccgcctcggcttaaaagggtgggggaatcaatttttaggttttttggccataacttttttgtaaagtgactaaagtttttaaaattatatagataaaatttagtagactaatagagaaccttcagatctattgaatgataccaaaattatttaatttgattgataatgagaaaagttattagcaacggcgccgaa

SEQ ID NO: 41618 - DNA, 898 bp, Heterodera glycines
tactgaagtgtcgattttcgctgggactcagttgtcctagtgcttagatggcatcggaatttataccgtgttttttagacttggctcatcaagatctttcgaatgataccaaatttgtccgagtttggccgtttcaaaaggtcaggagccccccttttcactcaaattttcgagttttaaaccgattaaaaaaccggttttttggcatttccgcaactggagacctactttttcgtgcatagctcctcgagatgaatcgattggtatatcatttatgccttttttccggggggttgatagtatatccgaaaatttttaaaattttttttttgaaaaaggtacaccatctaaactattacccttctttctctccctccgatcatctctatccttctcatatgagcatttctctcgctctttcttctcacccttcccctctctctctaatcagtgatcactcaccttctatctctcactctgattatcccttccgttctctctctaaattcctcctctttccccgacttgcctccgcttcctctccctcttctgctggtccttctctctccgtctgtcccttttctctgtctctcggaatgtctctctctctacgatcgctttttcgccctcccccacaacaacagcagcaacacttccaattgttctgctgctgctcgttgcgttgtctttcctcttccctccccatttttccccagtgtccgttaaaatcggccgaaatgttttgcattttccgtctcgacaggtcgtccatacagtcctccttttccaattcaattttctcacttccgtttctaatttctcacctcaaagtcctgcagttctcccaattcttccgttggcattgcatttctgtcgaatatttccaaataattcccaa

SEQ ID NO: 41619 - DNA, 983 bp, Heterodera glycines
  misc_feature (934)..(934): n is a, c, g, or t
  misc_feature (975)..(976): n is a, c, g, or t
agcaaagcactaacagggtgtttgactcacttcaaaaaataattcaataccaaaagtttttacaacaatttattgcctatctaatttcttgcagattgaaagccatccattgcctgccggttctcggcacagcaaagcactaatagggtgtttgacttacttcaaaaaataattccatacacaaaagttttttacaaccacttattgctaatctaatttcttgcagatttaaagccatccattgcctgccggttctcggcacagcaaagcactaatagggtgtttgactcacttcaaaaaataattccttacccaaaagttttttacaaccacttattgccaatctaatttcttgcagattgaaagccatccattgcctgccgatgctcggcacagcaaagcactaatagggtgtttgactcacttcaaaaaataattccttacacaaaagttttttacaaccacttattgccaatctaatttcttgcagatttaaagccatccattgcctgccggttctcggcacagcaaagcactaatagggtgtttgactcacttcaaaaaataattcaataccaaaagttttttacaacaatttattgcctatctaatttcttgcagattgaaagccatccattgcctgccggttctcggcacagcaaagcactaatagggtgtttgactcacttcaaaaaataattccttacacaaaagttttttacaaccacttattgccaatctaatttcttgcagatttaaagccatccattgcctgccggttctcggcacagcaaagcactaatagggtgtttgactcacttcaaaaaataattcaataccaaaagttttttacaacaatttattgcctatctaatttcttgcagattgaaagccatccattgcctgccggttctcggcacagcaaagcactaantaggggtgttgactcacttcaaaaataattccatacacaannagttttt

SEQ ID NO: 41620 - DNA, 939 bp, Heterodera glycines
  misc_feature (7)..(8): n is a, c, g, or t
gtcggtnnggaaaatggctccatactaaagaatagatatctcagaaaaatggctatctctttttcctacaccttcaacatgaggtttccccgaaaacgcattactatatacggttgagccctacaaatggtcggttggaaaatggctccataactaagaatagatattctcagaaaaatggctatctcttttgcctacagccttcaacatgaggttttccccgaaaacgcattactatatacggttgagccctacaaatggtcggttggaaaatggctccataactaagaatagatattctcagaaaaatggctatctcttttttctacaaccttcaacatgaggttttccccgaaaacgcattactatatacggttgagccctacaaatggtcggttggaaaatggctccataactaagaatagatattctcagaaaaatggctatctcttttgcctacagccttcaacatgaggttttccccgaaaacgcattactatatacggttgagccctacaaatggtcggttggaaaatggctccataactaagaatagatattctcagaaaaatggctatctcttttttctacaaccttcaacatgaggttttccccgaaaacgcattactatatacggttgagccctacaaatggtcggttggaaaatggctccataactaagaatagatattctcagaaaaatggctatctcttttgcctacagccttcaacatgaggttttccccgaaaacgcattactatatacggttgagccctacaaatggtcggttggaaaatggctccataactaagaatagatattctcagaaaaatggctatctcttttttctacagccttcaacatgaggttttccccgaaaacgcctattactatatacaggtgagccctacaaatggtcggttggaaaatggctccat

SEQ ID NO: 41621 - DNA, 978 bp, Heterodera glycines
aagaagcacttgagatgaccgagtttattgagtgctgtatttataattggcattatttaaatccaaaacaggcaaaagaaattgactgggtgatcccggcccgattttgtacgggtcgttatgacagcaaaaagatccgtcatagaattgaagtccaactgggcgaggagagcaaagaggagcgtcttgaagctggcgaatcgcagaccaaatggccaaacgcatatgtgatcccgtcaaaaggtgggtcccaaaatggttatgaattctgaaatgggtcggtcgtcattcgcatttcagatggacacaaagtccgaataatcgacgcgccgggaattggtgacacaaaaggcgtcaacgaagacaaaatcaactttgacaagacgctcaacttcatcagcacattgcctgaacttcacgccgtttgcattctgttgcgtcccaacaccactcgcgcaacgcccgcaatcacatattgcattaagggactgctcacgtacttgcacaaaaatgcagccaaagtactgtactcatcttctataatggataacacggattataacacacctttttagaacattgtttttgtgttcaccaacgcacgcgggtccaattatgacatgggcaagttttatgcttgaaaatgttttcgctttctgtaaaggtaatagagagcatgtgaagggctttcgattgatcacaacaatgtttgatttggatgccaaagtaaaaagctatcgggcaagctgacggttcagttgaaaaattttaaaaaaatacatagatattttgttaaatccatggccagatgtaatcagctatcaaaacaaacaccattctgtgtctcgtggccagggaccttgaaaaccaactccaagatatgattttttagtttagcggggggggggggggtagcaaaacacggaagtaccaaagcaggatttatatgacattaaattttcaggaaagactgatatc

SEQ ID NO: 41622 - DNA, 1203 bp, Heterodera glycines
  misc_feature (115)..(115): n is a, c, g, or t
aaaattgggagagattatatcgattttagtgcgctaggttcgataaaactttttaaaatataagcctaactttttgggcctgtttaaaaaggaattaaaaatttttaaaaatttnattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaataccataaataatgaactctcttccttaataattttcatgcaccgaggtactcactcggccgcttcgcggcctcgtggtgggccttcgccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaattttaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattatgcaggaatacgtatcggaacactacaaatgcttactaattttcctagattttttaaacccggtgaaaattttttgcacgacaccaccacttttgcacttaaaaaaattttcaaaaaactttaaaaattcatagaaaatttaaaattcata

SEQ ID NO: 41623 - DNA, 973 bp, Heterodera glycines
  misc_feature (809)..(809): n is a, c, g, or t
atttttagaaattctatccgtcaaatcggcttttggacttttaatgagtaaatcagtaaccgtaaatgacattctatgcttctcttgttggatacacgggaagaaataatagttagtccttttgttgaatttttagaaattctatccgtccaatcggcttttggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaattttaatgagtaaatcagtaaccgtaaatgacattctatgcttctcttgttggatacacgggaagaaataatagttagtccttttgttgaatttttagaaattctatccgtccaatcggcttttggaattttaatgagtaaatcaggaaccgtaaatgacattctatgcttctcttgttggatacacgggaagaaataatagttagtccttttgttgaatttttagaaattttatccgtcaaatcggcttttggaattttaatgagtaaatcagtaaccgtaaatgacattctatgcttctcttgttggatacacgggaagaaataattgttagtccttttgttgaatttttagaaattctatccgtccaatcggcttttggaattntaatgagtaaatcaggaaccgtaaatgacattctatgcttctcttgttggatacacgggaagagataatagttagtccttttgttgaattttagaaatttatccgtcaaatcggcttttggattgttatgagtaatcagtaaccgtaatgacatctatgcttct

SEQ ID NO: 41624 - DNA, 769 bp, Heterodera glycines
aattagggttgcatccccgacgtcggggttggaaaattcggggttgtcggggttggaagtgtcggggttcggggtcggggttgccaaattgttcggggttcggggtcggggtttttcaatttttgccttatgccaaatagtcaaaaattttttaatattttttcggaaataatatttattaatttccataataatatttgtattgtttttatatttttttatttcttttttatcagaaattttgtatagaattaatttttttttcttgaaattttaaaattttttattacctttttgttttccaaaacatcttttttcacgtcgctcttttctaaagacttaaggagaaagggtacggcgtccggcggtgccgataggcgccgccgggaaaattttgaaaatttggttagatctgttaacagattttgtccaaaatatgctaaatttttgcgattttgagccaatttttttaataaggtttatgactttttgggccctgtgatgccgataggcagcgctaaattttggaattaagctctattttctaagatttttcaccaaaaaaatttatgaatttcggtaaatttttgtttttcttcgatatgtattttgtcaaaatatgccaagattggtcgatttctatgagtatttaattaaaaaaacaatttgtcacaaagaaaataattaaagaagaaaacatcaaacggtatcgaactcacgacagaaggtaatgtcaatggcactaacctctacaccgcattccaaattc

SEQ ID NO: 41625 - DNA, 1024 bp, Heterodera glycines
tttatgcttccaaataagtctattaatattgaacgctctttgttgcattaaaaaatggggtgtgccttcaaaacaggaaaataccaagataaggaagagcataatgataaagataatggtaataattaggaagaggataatgataaggataataagagataaaatgataataaaaaattaatgataagggtaaggaaaaggatgaggacaatgataaaggataaggaagagaattaggattagataggatgataagcactcaaaacattaattaaataaaccaaaaatgattaattatttgattcagaaaaaatgataaaaattatacggaataacttttaaaaaagaaatccaaaattaatttataaatcgtagaagaaaatataaaatgagcaaaggaagctaaaattttattcaaaaataccaaaaataaataaacatatccataacgaatgaacccacacgagaagtgaatgagaccgagagagttcattcggcgcaggaaaaatactatacaataaaaataatggaattgcttttaatatataactaaaaaatgtagtcttaatattgtagtgaaaattcgatcaatcatatttcaagcagattgagcagaagcgttctaacatttgcagggatactcatgggtaaaggtctatcctacaaagaaaggagcgtcgagtctagctggcgcaagaaaatgtttgatagtccgagtaattagtgagtattgaatgacagcaaaactaattccaaaatattttgtaagaaagggttctgacacgcaacagaagttagttgcaggttagtttagacagtatgattctgatgatatcaaaaagcgagatgaatataatgataaagaagtgtcaaacaattgaaaacagaacaatatgtattagaattataattaaaatttcagtatttttatacagaagggctgccatcgttagagcgattcagaaaggcagagaaatatcatgtaataaatggtatataatcaggtcacatatataatcattat

SEQ ID NO: 41626 - DNA, 1189 bp, Heterodera glycines
  misc_feature (46)..(46): n is a, c, g, or t
  misc_feature (1088)..(1088): n is a, c, g, or t
  misc_feature (1100)..(1100): n is a, c, g, or t
  misc_feature (1108)..(1108): n is a, c, g, or t
  misc_feature (1130)..(1130): n is a, c, g, or t
aaattttaggcattttcgatctgaattggattggcacggtgcacancggcattccgcttgaccagctgacatttcgacttaatcccggcacatccgagtgcccctatttggcatggatgggccgaatggcaccggaaaagggcgtggacattgccattgaatttgcgctttggtccggcattaaattgaaaattgcggcacaattggtggacgagcacaagcattcatattggcacaagcaaattgagccgttgatcaatgctaatcaacatttggttgaatatgttggcgaaattggcggtgacgaaagagagtgcgtttgccattattttcaatacattttaatttatgatttttaattaaaaaagaaataataattacataaacaaatatatttttagcagttttttgggcaatgctttggcatttttgttcacgccaaaatgggacgagccgttcggattgtccatgattgaggccatggccaccggaacgccggcgattgcaaatcggcgcggtgccgtgccggaagtcggtttttatattattcataaaataatttattctttgaaattaccgtaagattaagcaaaacccaagagatatactaatatttaaaaagttccattattaggtaattaataatgcacttgtcactgtaattactggtatttagcgaccgttaaatttatcacaatcacagattgtgcaaattggccgcaacggttatacttttgactacaaagatcggcttggtgttgaacaggtggccaactttgtgcatttgatcaaccaagcggccaaattggaccgtgccacggtccgacaaactgtcgaagaaaaatggtcattggacaaaatggcagaaaattatgagaaagtctatcgccgcatgttgaacaaaaatttcatagcaaactgttatgatcattagtagtttagtaaatattatatgaattatatatattacaggatgatgaacacaattaattgacttggaatttatgaaattaattttagacagttgaaaatttcgaatattttttcaggctaatggctaattttttgctattttctattttaattanatttattattanacttattnatgtaacggtcatcatccctgntgcatataattagcataatatgtctagtgaacattcgtatatgccctaaactttgaatt

SEQ ID NO: 41627 - DNA, 726 bp, Heterodera glycines
taatttaaatttaattaaattttttaataaatcatttttcccatgttaattcactagcttccaccggaaatctgggacttttttttcaaaaattgcattccattgcgcatttcgcatgagtcactctgacttttgcagcgatatccccccccccatgttttccatccattaaagcatgaaatcgaaaatccgcattaatattcacgactcattgagtaacggcacaaaaaataaagaatccttgaaccaaaattccaataatagtagagaaaaaaacagtttagttgctgcagcagcgtcaaaatctgatcacaacagtgaaagtgattttatgtgtatgtcattcatgtgcagcacattattcattactgttaattgctttcaccctcttttcattccaccccaattccattttttgttgggaaggggggcagggggagatgtatcgccaaattaatcaaagcagataagtttctgatcagatcttccccccttcattcactttttttgtagtcaccccacatcaatcgtttcttctttcgatgaaagcgaagtattggggaaaaaaagccatctgatttatggaatggaaatcggcatgcgtcagggggggggatgaccttgggacggggcgtcgaggggagagagagacaaatctccgatcggcgtgcgcaatgattcttcccccccccctccccgcttccccgtcgggcgttttgtttcatt

SEQ ID NO: 41628 - DNA, 1019 bp, Heterodera glycines
  misc_feature (853)..(853): n is a, c, g, or t
ctgatgatcaatcatcattttaaatatctgcgtcattatttaatataatatgcaaattatatgaagtgaaaaatagatttggataatcctactgatgatcaatcatcattttaaataactgcatcattatttaaaataatatgcaaattatgtgaagtaaaaaatagatttggataatcctactgatgatcaatcatcattttaaatatctgcgtcattatttaatataatatgcaaattatgtgaagtgaaaaatagatttggataatcctactgatgatcatcaatcatcattttaaataattgcatcataatttaataataatatgcaaattaaatgaggtaaaaaatagatttggataatcctactgatgatcaatcatcattttaaatatctgcgtcattatttaatataatatgcaaattatgtgaagtgaaaaatagatttggataatcctactgatgatcaatcatcattttaaatatctgcgtcattatttaatataatatgcaaattatatgaagtgaaaaatagatttggataatcctactgatgatcatcaattatcattttaaataattgcatcataatttaataataatattcaaattaaatgaggtaaaaaatagatttggataatcctactgatgatcaatcatcattttaaatatctgcgtcattatttaatataatatgcaaattatgtgaagtgaaaaatagatttggataatcctactgatgatcaatcatcattttaaatatctgcatcattatttaatataatatgcaaattatatgaagtgaaaaatagatttggataatcctactgatgatcatcaatcatcattttanatatctgcatcataatttaataataatatgcaaattatatgaagtaaaaatagatttggataatcctactgatgatcaatcatcattttaaatatctgcgtcattatttaaaatatatgcaaattatatgaagtaaaaaatagatttggataatcctactgatgat

SEQ ID NO: 41629 - DNA, 872 bp, Heterodera glycines
  misc_feature (28)..(28): n is a, c, g, or t
  misc_feature (32)..(32): n is a, c, g, or t
  misc_feature (39)..(40): n is a, c, g, or t
  misc_feature (43)..(43): n is a, c, g, or t
cggctccgggttccgatctttaaaaaanggangcctggnncgngagcagcgaccctgcctttcataggaatttgaatgtaattttttactttttgttttgtttatttattgcatattttataatttttatgccgataaattctgtatattttcagatgagttaatatattcatttaaaatattttctattcgaaaaatttccctactttacttagtctttttttttaatattttcttatgtatctaaaactgacccttttcgcccttcacggtacaattttcgccatattcaactttttttgctgctccaagtgacccacatcatcattaattaatgtgattgcttcttccttaacggcggctaattttgcccatttgccattcgattgttgacgattggcaccataattctgatcataagcctctgctggttccgttttaatccgtcgttttttgtccatgcgctttttgttgtatggcattttggtgcttttcgatggcatttttttgtgccgcttctccatgctggtggacgggaaccaaaatttgttgacacacaattcatcaaataaatcggttggaacggcagaagcagaaggaaatggatttagtgcaaaacataatattattacttattattagcatttttggctttatctgctcacattaaaatttttttttgtaattattgagaagagaaatgcaaaaatttttaatcgcacaattatttttaactttttttagtttcattaggtgcttatttttcgattttttaatgcctaaaagtcctgctgctaagttgcagacccgagactgaagtggcaaatacccttgggactgaaccgtccaacaggtaaaaacgcatgaatggt

SEQ ID NO: 41630 - DNA, 1098 bp, Heterodera glycines
ttgcaaaattgtataccatctagttaaatttaatacctcatttatatttatggcaatttgacattaattatttaatttttatttttcaaaaatttggcgcaaattacataaagttaaatttatttatttaattaaataaattcgtaaacttcctttttttaaaaaaaaaagactttcataacattttcccccttaatatggacatagataatttacatagaagcttcaagccaagataaaatatatttttgtccgtttaagacagtccatgaaaaaaaatggaatttcattataattttacgccccagtcaaaacttttccaagattttttcgtgcctggttttctgagttgccgctcgtaacagcagagaccaacttggattgtagtcccattcatcagcagagtcaacaaacacgggattggcaccaacattgaggacggcatttgagacagcaacaaatgttatggacggcatcaaaacatcggcacccgctccaatgttagctgagcgtaatgctaacaccaacgaggtgaagccgttgcagcacggaacggcaacctgaaaaattttggaaaagtgccaaaattcgggccctcaaaattgggacggcccaaaccaattatcataaaaccaaagaaccttcattctttgtagttttacttacaggaaaatcgtagatggcgcatagttttgctgccagctgttttggccatgtgccagccgatgagatttgtttgctcattaatgcgtcattgacattttggatggcacccggcggaatgtacggctcgacaacccggatgatttgtgagttgtgcgcacaaatatgcggttcaggttcgggaagaaagtgggctaatcgcggtggaagtttggaccgtaattgcaatgaatgccgaaaaagtgccggaggtgtaccatatgatggatagcatactgtgttgaatgggttaacatactgtaaattaattttttaatttaatataaagtttattaaaatttaatagagttagttcctcatattgcaaaaatcttgaacctagctttctgggccttaacaatagtttcatggataaaaattcaataaaatgaagac

SEQ ID NO: 41631 - DNA, 943 bp, Heterodera glycines
  misc_feature (12)..(13): n is a, c, g, or t
  misc_feature (496)..(496): n is a, c, g, or t
  misc_feature (573)..(573): n is a, c, g, or t
  misc_feature (666)..(666): n is a, c, g, or t
ccatatgaaatnncgggcggagaatgggagaaaaaattgtcctttttttgagattttgagctaatttttacgaaaacaaatgatttttagggtccggcggtgccgttaggcactgccgtggtaaatttttaaaatctgtgtgacattgcaccacaaaattacaaatttctgaagaattttaagaaatcaacaaaattggatcactccctccaaatcaggacatttctgataaatcagaacagatccgcaccagggctgggcgaaacttcggcttcgaacttcgtgcttcggctattttacccgaagtttctggaaaaacacacccctaaagattgagtttaattggcttttgataaacttaaagttaatatatgtttattaactttttgctttctgttccttattcacatacatggtcaaggggtatcttggttcttttcagtattcttcctttagatcaattccccaagtagttgtttttcttctaattttttanaattattccttttttcaacggaaattcaatacaaatttaacaattaaaatcgcaaaatgtttttatttttggactanatctgttaacaaaacgcactaaaaatttcaaaattttcccaggcggcgcctatcggcaccgctggaccctaaaaatcctctaaaaatagctcnaagtcgcaaaattggtaattttttgctgtaaatttgttaacaaattgcactcaaattaaaaaaaattttcccggcagcgcttattggcaccgccggcaccctaatttccatttcattttttaattgagtcaaaaaccgtgaatactctaagaattaaaaaaattttcaaatacattgatcaaaaaagtcaatgtattattttattaaaaaggttgggtgatctctaacccgtctggttattgtataaaatttgatatttaaaccgaaattttgggat

SEQ ID NO: 41632 - DNA, 941 bp, Heterodera glycines
  misc_feature (884)..(885): n is a, c, g, or t
cctttgctaattgttcctctgattttgctcacttttctctcctccgatgtccattcttcgtttgttgtcccaattgaaccaggtgaatgactgactgacttctcattataggatgtttcttgtttcgtacctcatgtttttgaggcattttgaatttcctttacttatttttaatttacattcattttttattaatttaaatttaattatttatacctaaatttcctatcataaaaataataaatattaaaatattttttcctttttacataatacttacctaaaaatctacaaatcgtataattttaaatcgatgcaaaatctacgaaaatggtctttttggacaaaatctattaacaaatctcacaattaattttcaaaattttactcgacggcgcttatcggcaccgccgtccctctccatccaccagataattttggaaaacatttaaaatcaaaataattttaatttatgaatctattgtaaaaaaacaattgtgattgatttagaatattttttattgattaaatattgagttgaatttccattttatggggcctgattgaagaaaattttggtccgagtttaaaaattttcttaactaattttcagtaaaaaatttagtgtttcgttcgtgttttaagcgcctttcgtgtctcataattgatttttaatttttgcaacatctctgttatgtatttatttatttgttcacagcttcgcatttgtttggacacccaaaaacactgaaaattgaaaaaaaaggaaattatttcggtgaaaaatagaaagaattcaacctccttattgtgagatatgaaaaaactcatcctcacaatcagccgagtttgtctccctcatttgtcagctgactcttcctagnncgagaatcaatctttttcatacattttcaccaggaggaatatttaaaaaattaaat

SEQ ID NO: 41633 - DNA, 808 bp, Heterodera glycines
attcaaagcaattagtgattcactaggataatccagctattgtaattgaaaatgggagaacatttgatcctatccaaatctcaaatgcacacataaaattcatttgaaaaatatgaaaatttggatattatttcgcaaccctttccctctaacagttaaagaatccgacagaatgtgtcgtttttagaaatttatatttagttttatttgcaacaaaatttggttcgatgtttttgagttcttcggcccgggaccagagcgtttgggcccccgtttttgggcccccgcgtttgggcccccgtttttgggccccggggtcgtttgggcccccgtttttgggccccggggtcgtttgggccccaacccaaaaatagaaaaatgtgcttttttaaaaattaagattctaaaaactaagcctgagggatccctcgccacttggcataagttaggtttaattacattcgctcattttttacttattccaaatcctattattttttaatagttaaccaatttgatgtacattctgatttggacatttttcagaaatggctaacccaattgcaaccaaaaaacaaaaagtaaaattgactctaatgcactttatgagtccaatcaattgacaatccatggtttttatacaataactttttccatgttcgaacaaaccctatctttttggtatcattcgaaagcacaaagtctgaataatgtaataatacgagaaaacaagagaattctaacatttcaagaaagttacaaacgaaaatagtcagcaattacttaattaatcaaatcttttgtggta

SEQ ID NO: 41634 - DNA, 1206 bp, Heterodera glycines
aaaagctacaaatcaaaaactgatgaacaaaaatttgatattgttcaacgctttattgaaatgacaaatgaatataagcaaaagagaaaatattcaaaaaaagaatgggagaaaaattatgccgaaatttgtaagaaaattggagtcagccgagacataattaacaaatggaagaaacaatttggaattcgctgtaaaataacggagaacgaaaaaatggaaaaaatgaaaatttattggcaaataaaaagtgaaaatccaaaaatgactgacaaagaaattgcaaaaattgtgaacacttctcaacagaatattttcaattggaagaaacaatttggagaagaaatttaaagtattaaaaacagaaaatgagaaaagggatcaataaatatttcgatagaaaattgaccaattcttttattttataaaattattatcttggctaattgaattatttaaatttatttaaataaatttctaattatttgcctgttttatactgttgttgcaaataatcaaagaaaaacccaaaaagcgcatttatttctattttattaagaattttcaaaaatctttataaatcttaaaaatggagtaattaataaaatatgcaattagcctcgttaaatattatttagtcaattttaaattttcacaattttatgaggttttttagattcattttttggcagttttaagggcattttttgtataactaactatctacatccaaatgaataaaatgtttttttgtatgaatgaattgtttttttttggaatgaaataacgacattcagtcattttttggaaaaaatttattcttaaaatccgaaacatgaattttcgattggtatcattggcataaattcgataatactcttttgaaaaagtgacaaaaaaaattatattgcttagaaaaaatgccggcaccgtaaaaatgttataatttattatcttgaatgcttggaatgtactaatttttcgccactatttgcgataatttcggcattttttgccgctttttaattaataaatttgggattttttgccgcttaaaatttgcatccgattgattatgactactctcaaataaggattaaaataaaaattttgtgatttgtagtttgttttaatttaaaaaaatccaatttattaatatgaaaatcatttcacgaataaataaatgcccattcattcataaaatta

SEQ ID NO: 41635 - DNA, 921 bp, Heterodera glycines
agatatgaattttcaaattttaacccaaattgtcctcctccttaaagggagtgctaaatatttacgaattttggggaaattctatcatttccaaaacttaaaatagacatcatatctcgtgctcagcaccccaaaataccccagaaaaaaattttacacccacacttttcaacccaaaaaaaaattccgaaaatttctagggggcctagctcgaaaatttttgaaattttccaaacatcgtagtacaccattcgatagagtttcgaaagctctacaattttgctctaaggtcatttttggctaaaaacaactcctgacgagttatgggcccgggactcaaatgtcccgctcaggccaaaaaatttttctatttccgggaaaaaatcgaaatttttctgaaaaaaataccagtcgatagagctcgaaaaactatgttttggaagtggtcttcgtttttctgggaaaattcgttaaaaaatcctaaaattcaaaaaccaaaaaaccgttttttaggcctagctcgaaaaattttgaaaattttcgaaattttaaaatctggaaaaatcgagctctccgagctctacaataagtctgctggccaccctgcgctcaggtcaaagcctaatgagttattcaacggggactgaactggaaaaagttggtactgaaaagttgccaatttctgcagcccttccaagtataggtagaggcctggaattttttttgaaaattagaaaacacttcaacttaaaatcctcccagcaagaattttccgctccctgtcctttaaaaaaagttacgggccttcaaacgcaagcaaaagtgagaaattagccgccgggactcagttggccaccggagcggaaaacctatagttttcccagatgcgccttaaaaagttgtaagacccttccactactt

SEQ ID NO: 41636 - DNA, 1809 bp, Heterodera glycines
tgtatgagactataaattcgcaattatttaaaatataaaaaaaagtttcccgtatcgtacaatgcgttaaactaatgtttagtcgaatttattgtaaagtacgtgcgcgaaaagagaacctaaagtcgcaagcgcgacaaaaaccttggatcagcaccgcgaaacatcatggccaggtcagagctgaactcgcggatgaggaacttctcaacatgccatcaacctctactgctcagcgcgctatttcaagacaacgaacaataccaggaaggattgcagttgaccaagaagcagtggacgcaattgtcttggatgtaatagtagtgctgtttgagatttaaaattctttttaaagggtgattttgtcgtcgatttggcgggattacggtttcttctgcatgattcgaggcaaaatgaacctgatttacctgtgtttattgtatttgctaacgatgcaggcattcggaggctaagaatgtatagacattgggcgctcgacggcacatttaagggttaaattaaaaaccattaattactcttattttcaacttaagtcgttccaagtaatatgctgcagttatatactgtaaatgtctttgttgacaaagcttctatcccttgtgtttatgcattaatgcaaaataaacagcaaagcacatacgcaagattgtttacttcgatcaggcaacatgttaatgacgtgattccattgtccgttatggcagactttgaaattggcatgttattaaaagggcttcctttttagacacgaaaatcgcaaaataggcattttaaaagtgatcttagacatccaaaaaaagtagaaattgggttttcgtgcttatctttgcgtataaaatgaacaaatttttggcatttgcctaaaaaagaagccccgttattaattagaaaaatattttgattgtattttggtttaggtgccagaaatgcgtttagacaagtttttggtgcagcagtgccttataagcactgcttgttccatttgggacagagcaccaatagaaaaattctaaatgatggatatgggcaaatttatggacaaaatgaagagttcagaaaagcagtcagatcgttgacagctttggcttttttacaaatagatgaagtgatcgatgcgtacccaattttgagggcaaatgcaccccaggccgcactcccgatttttgactattttcagacgttatgtttttataatgcaaattctaaatttataaattacagtacatatatttttcgagagattgatggagaacgtgcaacacctttattctcacattatgattggaatatgcacgattcgactattgaaaatttgcatagaacaaataatgctatggaaggatggcatcacgcgtttcggttgagatttagaggactgcaccccccactctctaagtaattggtttaaaaaatttttaaaattttataaaaaagattgattactgcattgaaagtggaggagcagtatcagcaaaatcgattgaaaaaatatattgaaaatgaccaagccataaaagaattaattcaacggtatgacaatctcgaagaaagaaatgatgaaatattattgcgacatttaaatgctcttcagtatcgtctcgccaatgctggcgccggcaagggcagagatgtctgaaagggggggggaaatttgggaaaaagaaaaaatgttacagaacaaatgccataaattttatggcgtacggccttttatagtcggacaaattgtttaatgtaaggtcggataaactgcagtttagccgcctttcaataggaaaagcacgttgc

SEQ ID NO: 41637 - DNA, 1286 bp, Heterodera glycines
aattgttgggatgccttcttaaaaaataatttcttatataattttctttaaaagaattgcattcagtcctcgctaaatatccgattttgctgaacaaaaattcgtctgacattttttatttcgaaattttggtcacaaaaatcaaaaacgaacgcaagtaagaggagaattttgaattttaactatttaattaaaagtgaaaaatttttaaagattttatgttatttaattcttcgctttcagtttggtcagcttcggattcgccgtcaaacagcaggcaagattggatgatggaattctgcttgaaaagggcacttatgcatatggaagtgctggttggatttggattaacggaggagtaaaagaagccgaatattcctacggtgttggcgatactgtaggaattggcgttaattcggccactcgacagatcattttcacgaagaatggacttcgtttggataggaaaataaataaaatgtaaataattttttaatataattttttatattttaacttaacaattgtgtgttccttttacagattccttcgattttttcgttgctccaacttatgaaaatgtttatttttatccgttcgtttctttgtggaattctgatgacaaaattgaggcgaactttgggcccgacaatttcaaattctatttggcaactctctgaggaataagaatattcgttaaactgatcaatgatcatttgtttcgattttatcttttctattaggcttttcttctacaattataaatttctttttcattttattcaattaatgggaaaattgattgtttttcaggtgtaaaattatgtcaacatgatcaatttttctctataacattttgtgtttttcttaaatcaaaagaaataaacaattttaaaaaataatttaatcatttttatcacttttagatgcttctttcaattaaaaaacaaaaaagataaagaaaagtcttaggcaactgataattttcaattttatcccttcttttgatgaatattttccccctttttgcgtgattttctcattaattttatggaatttctcaacaatttctctatttttcctcttctttttcattttgttcatttcctttttcttccaaattttctccaaatattcgtcaactgttttttgtttcaaatttttcttttctgttccaatttcaatttgcataattaaaaatgcaattatatggaaaataggcacaatttcattatccttaagttaaagaattaattcgaagtaaattttttgaggatattcatgct

SEQ ID NO: 41638 - DNA, 1642 bp, Heterodera glycines
  misc_feature (974)..(974): n is a, c, g, or t
  misc_feature (1568)..(1568): n is a, c, g, or t
  misc_feature (1634)..(1636): n is a, c, g, or t
cggattctaggggtccgtgtcgtgtttttgaattgcaggatttttttttaaactcgtgtgccgcgcttttggattttcgacactgccgtgcccaccttggccttgcactcgcgcaactccaaccgcttctcgcgcgcgctttggctcaaatgatgatgaccatggtggttgtgccgtttttgttgttgcggaccgcttccggcaccgccggcaccatttgacgaggaggacacggacgtggcgggcgaccgctgttccgcgcccgcaaattgttgttgctgttgctgttcaagttgctgcttttcgtcctcactgatcgtctccaactcgggcggtggacgattttggtgtgagaagccgccaccattagccgccacggaatgttgcgcgggttgcccattagcaaccgaagccgccgccatttggccgccagaacatgccgtgccgctggcgggaacaccagcgccagcaacagcggcagcagttgtggtcaatggcgccgcataggttgtggaagtgccgggcaaagcatggtgatggtgttggtggtgccgttgttgggaagcggtgccattggagaatgaaggggaggaaccgccccccttggcaatgttgccgagggcactaaaatttggaaaaattccacaaaattttcgggtaatgggtttttaaaaccatttgttgaaaaaaaaatcagggaatttcgtaagaacttctaaaatttccatcccacgaggaaaaccctaatgatttttaaaagctttggatttaaaaattctgagaatttcgtaagaaaatttgaaaatttaaaaactataagaatgcaatttaaaaaagtttctttggaaaacgaatgtccccactggcactataatccatgaaaaataaatcaaatgtacgaattcctatgaatgtccttgaaaagtatttgcttttccgaacgccatgttgcgaaaaaatttcaacctttccanaatatttgttaatttttttaaagttttggcacggcttacagcagtgcgcactgcttcttctccgtctcgcgcctgatgatgtccgccaatttgttcttcacatcggcagcggtctcctccgactcgcattggatccatgccttggaaaaaaatagttagatcaccatcatatatttattgattttcactgatcagaaatgtttgccttatcaatcagaatgtgatcattgatcatctgagtttccgactgattggagataatcagtgaaccaatgatcaaagaatgtgccgatcagtgatcagctgagagatgaagatgactgattacaatcaaaattcagttaaaagatcattgatcagttaactaaccaaggaatgtagtcaattgaacaacaaactggtctaagaatttgacaatgatcagaaaatgatcaaagaatacgctttgaatgattattgaagataagataagttgtttgttgaacggttagtgatcaaagataattaattgaatgatcaacttttcaactaaaccggtcattgaacattcaactcaaataactaaagaagacgcttcattaattaattaagcanctgaaaaattcaaaaacgaaattcaattagtcctgctacaaacacaaagaaatgtggacctgcagnnngcatgc

SEQ ID NO: 41639 - DNA, 989 bp, Heterodera glycines
  misc_feature (6)..(6): n is a, c, g, or t
  misc_feature (55)..(55): n is a, c, g, or t
ttgaanagcatctgtattcagcctctttaaatcttaattttctgaaacccgaatntagaaaatatgaatttatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtttaattctgcctttcctataagcacaatgtgtttgatgggctctacaaaatattgctagtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaatttagcctcttttaaatcttaattttctgaaacccgaatttagaaaatatgaatgtatttctgcgacgccttctatacttaattcatccataatgggccaaaaatcataggttaagaccaaaagagggattttagtttcagccggaatttctataaaaatgttcgtgtgtaacctatctttgtctatgcggataagtaagaaattgaaatattcgtattacttttcctcccttaaagctttataatgaaagcgtcttgtggagttaggatttgccgtcgcaattctgtaattccactt

SEQ ID NO: 41640 - DNA, 471 bp, Heterodera glycines
gctgcacgcgctcctcccgcccattgtcgcccccgctcttcccctgcggttgtcccatggtttgaaacaattccacgaattgaccaattccgccaaatgaatttgtttctcccccgggcatcggttgctgcgcctgcatttgttgtgggatgaaagacgggtgctgctgctggtgttgtcccttttggccaagaaaaggttggaagaaagaaagaaagccttgctgggactgaaattgcatttgccaatgacacggagagacaaaaagcggcaaataattaccaaagttgaggcgaattgcacgagaaaaagcgaaatggcaaataatggcgatgagatcaaacgcttattagcatggaaaagcagaggaaaattgcaccagagatacattccgataaaacggctcatcatttttggcaaaacggacgaaggaccattctaaagtgggggggttgaatattatttcacctt

SEQ ID NO: 41641 - DNA, 1792 bp, Heterodera glycines
  misc_feature (1634)..(1634): n is a, c, g, or t
  misc_feature (1688)..(1688): n is a, c, g, or t
  misc_feature (1734)..(1734): n is a, c, g, or t
ttttctttttcaagtattcatttcttctcctttcttccaaattgactatcactcatacgtgacggtcctgcaacgccaatatctgaattcagtgatgcctggctagcaacattcacatcagtcaaacatcttgctcgtttagcataattatgttcagacaaaacatcatctatatcatgttcaaaaatctcggtttcatcttcaataactaaaacatttccattctccaaaaactgttcatttccatctctaatactaagatttttctgaaaaacatggtccaaattcattgctcggataatatggcgtttttaaaatctgtattaaaaaacaaagttaattaacaacacaatattaaaacatataggtaaatttgcaaattgaacaaatgagaaaaaaaataaagataaaaatttattaaatgaaattaattgatgaaatgaaaattcaaccgaccttttcattgtaaaacttcttttacatattattaaacacaattaatgtagaaaaattcatttcaatacaaatacttttcacatagtaataaatcagcattattaatttttactttttttaattacttaactgagaaacaaaaaaaacattaatataaacatttttaataaaaatttacatatatgtataaaccaacctcataacgatatttaaatccacttcgtaataagtaactcctcttgttaatacacacaataaattgcgataaatccatccagttgaacgaaatgtacaatcgaataattgacatccgctttaattacaaacaaacaaaatttccatttcaaagttcaaaacaaattctcgaatcaaaactttttcaatgcaatatcaaacacaataacatttccattgagcttgccataatcaaaaacaaataatactaacataaatttattcataactaatcaaatcaattttaattcaataaaaaggaattcatttacaaaaacattttctttttctttacaaaagtgttaagagcattcatttccaaacgctttttgataataacaaaaacaaaaactttttctcttaagaaatgcaatagaaagcattaattgcgatttcattatcattaataaacatacaaaaactattttgtcattaaaaacgaaaaaaagagaaatttattttaactgtgctttttgcaaaaactgacaaaacaaaaatgaaaaaaagcaaaaccaaacatttcatttttcaaatacatttttaacgcaaaacaattacaaaacgccacacaaattcaaacactggacacacacaacagacactcaactttattatataagatggcagttataattatagagcgtagaatttttagtcctcattatctaattacatgccacatttaagcattttttgtttattctatatttcgtcatttggtgcatttttcgtacatattataatttatactattagccattaattatgcaatgagactatgtttaattaattcaaatatgcattttttatagtattcaattacctggttaaataaattgagtgctttaaatttatttcttgtaatttttctgttttcttaaaagatatttcttctgataatcttaaccgttatgttttatttcaaaatttgttttattaattanagtaaaataaaaaaatatattaaatatgggcgataaagattctaattattttcngcataaagaggttttgacattgataattttattaataattaaattntgattaatttattatagaaaaaagcttaaatttttttattcaataaagcgagtttttt

SEQ ID NO: 41642 - DNA, 1420 bp, Heterodera glycines
  misc_feature (55)..(56): n is a, c, g, or t
  misc_feature (108)..(108): n is a, c, g, or t
  misc_feature (201)..(201): n is a, c, g, or t
  misc_feature (228)..(228): n is a, c, g, or t
  misc_feature (272)..(272): n is a, c, g, or t
  misc_feature (365)..(365): n is a, c, g, or t
  misc_feature (418)..(418): n is a, c, g, or t
  misc_feature (438)..(438): n is a, c, g, or t
  misc_feature (449)..(449): n is a, c, g, or t
  misc_feature (470)..(470): n is a, c, g, or t
  misc_feature (477)..(477): n is a, c, g, or t
gttttattgacaagtagtccaggcattttaactttaaaggtatcaggcaccgatnncgcgaggagaggcacctttaaaagcccagaccagggcagaggaacgcaagcnaaaaacgaagagaggaacagaaaagcggagacgccgaacggaaagagcaacacaacgcaaaacggagacaaggaacggcccaaagccgaggangaaccagaagaacacaagaagacaaancccacacaacagccagaaacgacgccgcagcagaacggacaaanggcagcagacccacagaaaggccgcggacgaaaaacacaaaacgggaaccgaagaacggaaaagcaacaaaaaggaaaagaaaccgacaaagncaaggcagaaacgcccggacgcgcgacgacgacccaccggcaacgggagcagncaaaggcacccgcaccgccncagaaacgggncacggaaagggaggaagaaancgagcangccaacgaggcgatcgctcgaaatgtcagcacaagatcaggcagttaaccaacgagacggaacctaattatgagagaatgaataaaacgcatagcacatagcatgtattagaaatgaaaaatttcgttgttttagagaaatagttcttttaaaaatttttcatataaagatttcaatagtgaaaaaattttctagcttttttaaagattttttgttgaaaaatttcaaaatatagtttcgagggggataaaacgacgtggggaaaacgatggggccaaatgatcacgtcggaatttggacgtcgtcgagtcgaaaagacaagtcggagattggagaggcaaagttggaaattgtcgtatgccttggccaccaatgaacgcaatctctgatcggttatctgcaaatattatcattttcttaaattgaatgatgccccaaacaattccctgacatgttcgtatgcttttgtggacggctcgtccaaagtgttcagtttcaattgcccaagttcggcgattaatgtcgtttttgttccaatttagcggacagttgagaaaaacgcagttccatcacatcgtccaacttcaacatgagtgttttcaggttcaatttgaacaggttttccacaaaatgtttcggatagtccgtcggtggtatattttcctgataaaattttgccaaattatacatttaaattgccattttcactctcacttggtagtcaatggcgtcaaagaggcgctccttctcctgaggggtcaattccttctccaattttttgaaaatttgtgcgtcttccggcgccgccgcttcttgaacacgtccacccagcccatcctctgcctcctgacaaccgaataaaagattttcagagcagaaaagcagtaatatgcgactagttttagttttaacctctcggtagtccctcgtgcgcgtcgtctca

SEQ ID NO: 41643 - DNA, 1216 bp, Heterodera glycines
  misc_feature (109)..(109): n is a, c, g, or t
  misc_feature (1098)..(1098): n is a, c, g, or t
  misc_feature (1108)..(1108): n is a, c, g, or t
  misc_feature (1149)..(1149): n is a, c, g, or t
  misc_feature (1183)..(1184): n is a, c, g, or t
ccggtatttttggaaaatacgggatttgcaagattttttgggaattttcaggggctaatcccttgtattttttgacgaaatctgctaagaattatcgccattccgtccncaaccagaaattttttgaaagaggcgtgatgagaaattaaatggataaagaagaaaaaaggttaacctagaagaaatgttattaaaaatcttttatgaaacttcatagcttttacctcttttgtacttattttagcaaaaaccttgacaaaattggtcatgtttattattattattttgaagaatttttagttgaaatcgatattttttcaaatttaaataagctcacaatcccgcgctgattcccgcaaatttaacttcgggacttgcgggattatccagtgggatctcgtactgcaaaaagttttgatttacaatcccgcgcgggattcgtaaatttgaattttctatctctattcccaattttcctcttacccattctttaataatttttgtcaattcgccaattatttgtccttttttgcgcatttcttcttcagataaatatccattcgtagtcaaacaatttttaatctgcaaaaattattaaaattcggcaaaagttttaaaaaatggctaaatctgctaataaaaatggtttataaattctcaatttttcacatttcggtttttgtgagaataatttccctaagaattatgcgattatttactatcattgataatacaatacatataattgtaattattcacctcgattatttgttccgatttttctttcaaattttcctcaaaatttatttcttgccaattttttgcaacttcgtccggcaatgtccatttttcagaatccacgaaacttttcctcactttttcatccacatatttgtttagttcatttctgtatttattaaacaaatgctcatctaaatggttattttaattgcttcaaataaccaaaaaattacctatttgtatttgttcatttaattttttgaataaaattaaatatttttccaatttttcaattgataaaataattttttcttcattatcttctttcaaaaggtttgccattatcattttctttanatttttgttncaatttgtccaaaaattcccgttttcaaaaaatgccatcgncaatttgcgcaagtgcaactgaagccgaacttgnngcattcatcgtttatttccattttaaatttgc

SEQ ID NO: 41644 - DNA, 1433 bp, Heterodera glycines
cataaaattccgagataaccgctggacactatttagcgtttaaaacttaaataaaacggcatatttaaagatattataaatgaaagtattttattaatcttacatcgcaacatcttttatagaaataaaacaaaataacagaataaaattctaaagattacattaatatctttaatgaaaaggataaaaacttaattgatatttcaaatattccaaataaaaattcaaataaaacagtttttaataaaaattatataaagtaaaaaagaaaattaataaataaataaaagtgtgaaatttataagattttattatgaaacgtaatttgataagctaaacattttaaatgcatgtttgaagcaattgttctgtataaaaaacatagaacaaattgtgggaaattttatacatttctcgaataaaatattttttaattaatttaaaatatattaataatgaactaaatattttaatgaaaaaactttaaaatattatcaaaaaaagatatatacaaaaaaagattataaaattctcataataaaatgcaagccaaagactctgtcatacttgaaaccacgaaaagcaataaaataatttttctataaaattttgtatttgagtaaaaaccagttcaaaattacacattttgataatatacacttaaaattgaaattataaaacttgaaataattataaaaaatgggaatatgatttgaaataaaacaatctgttagaaaaatgtaaataaaaataatgtatttaaatgtttatatatcccattgatatgtgccatttaaaaggtaatctatgaaaaattaactcaacttcaataaaaaaaagctaaattaataatttaaaaaatgctttaataattaaaagctataaaacattaaactataataaatcatgcgaagattcacaaatcagtgtccttttaaaaaaaatttactttttcaatcttaatcgttaaacctggtggtatttctgtgatataaaattttgaacaaacttttgacggatttacaaaatttattattaaattaattatgagagaaattaataaatattataaataagtaaattattattattgttttacgaaaattaggaaaaaatagcgaatgaagaataaataaatttaataaatatttaaaagttgaaacaacaaattaacaaaaaattcatttgaacaacgaaataattagcaatattaaattaagcacccactgtcttactgttaagaattaattcgaaaaaaatcattcgggagatttcttaaaagaatgagaagatggaaagataccgccactgtcgtcaataaaccagtgaggaactcataaatgtgattaataaatacaaaaagtgtgataattaatatatttaatagaaaaaaatttaagaaaaacaaaaaaatttattaataacaattaaac

SEQ ID NO: 41645 - DNA, 1259 bp, Heterodera glycines
aggacaaattgacaacaaatttaataaattatttaactcgttttacataatagtgaagttaaggggaaaattagaccaattttctagctcattaattatgtgtaaaattcattgaaaattaaattatgctaattattaatttggaaattataggaattgaaaacaattaattaggaaaatatggaattagtggtaaattgacaaaacataaataaattaattcattacttaattataccaatttaatagataataattgtgtgaaattcaacaaaaaattataattttgccgattcttaattaggaattataggaattgatattaaattaattagggatatatgaaataagtgagaaaatagacaaaacattaattaattatttaatttgatgaatttgaatagtaaattaattatctgtgaaattcagggagaataaatttgccaatttttaattaggaatattatgagttagtgagaaattgacaaaacaataagtatttaattaattatacacaaactattaatgggagagaataattttttagattatttgtatatatacaaataaataataaatgtgtttacaaaaaaaaagcatttcttctccacctccctcctctttcttcatcattatcagcgtcattgatcagtgatcaaaaagtgatcagcgcaaatgcgccaaatgtgcgcagaccaatcgaaaaatgttgcttcgggcaaaattgtatatatttttttgatcgctggaggcaattagtccgcattccatcctcaaaaaaataatagcaataaagtcagccattttaacgaaaaaaaataatttaaaattaataaaaaatgtatgcaatgccagtggtagatttgctaataagtgtattaattaaaggaaattttgataaatttccatatttagaaattttaatgaaattaaaattgaaaatttacaaaatatgacaaatatttacaatgtttaaaattggatttgtacgcttttctttgagatcaaagcgaatgacgccgatataatcgtcagataaggcattggcacttggcattttctcccctaaaataaccaaaaaaaatttaaaaaaaaaatgcgaaaaaatattccgacggaattactttttgaaattatcggtgcaattccattcgacagaaaatgggctcaaatccatgtgtcccaagtgtttaaccattttctgttcaatcgtatgggctcgtggcttagtcaaatcaaaaatttggtgagtgtttaaa

SEQ ID NO: 41646 - DNA, 721 bp, Heterodera glycines
ggcaaagctgtagtacaaattattggaacaagtttattacgatcttaggtcaccggcaagttacgctggtattcaaaaagtgctggcggaagcccagaggcgaaatccgagcattactcttcgtgatgttgacaaatttttgcataaacagcgcacctacacgctatttaaacctcgcaaaaaccgcttccgcaggctaaaaactgtgcccagtggactacacacggactggcaatgcgatttgtgcattatggacgcactgaaagagcataatgatggatttcgttacatccttgtgtgcatagatgtgctaagccggaagattttcactgcagaggctgagtccaaaaaaagtgagcacatgattgcggcatttgagaagattttcaaaaaggcaggtgtgttgcccaataagctgtacagcgacgctgggcttgagtttcaggcaaagaaaatgatggactactggaaacaaaaagagatcatcaagcacgtgatgtacagcccacatttgcatgctggagttgtggaacgcgcaaaccgtacgctgaaggagcgactttacaaatattttagtgaaaaaaacacaaagcgatgggttgatgtgctggacagcattgtgcgtaacctgaacagctccgcgaaccgaacaaccggactaaggccaacggacgttaacattaaaaatgcctctgctctacggaatcgcctatataagcaa

SEQ ID NO: 41647 - DNA, 1151 bp, Heterodera glycines
  misc_feature (13)..(13): n is a, c, g, or t
  misc_feature (24)..(24): n is a, c, g, or t
  misc_feature (1030)..(1030): n is a, c, g, or t
  misc_feature (1100)..(1100): n is a, c, g, or t
  misc_feature (1108)..(1108): n is a, c, g, or t
aattcgaatactntttggttatanagggtacaaaataacttgtgacatttagaatcaataaaaaattattagttttcgtattttggtagaaaacaacagtttagacgagttataacctaataaaaatttacttttttctgagacgcaaattgcttagcattcgattagaaaaaaattctcctttgcaaaaatttttttagatattaaatttgtccggtttggttggaactaagcgagttatggctgataaaaaaataataaaaaaggcatttaacagtgtaaaatttaaattagcgcgcaaaaaattaagccaattgcgctatttggcgttatgagcaattttgtctaacactgggatgacccatagtgctccaatcacttttcactcaatctctctctgttttctcctccaacttactatctctccctctcactttgactcactatacctctctcatgcgctctttccctcactctctttgtctttctgcctctctcacgcttttgtttctctcgctctttatctctctctctctcttttttggcattctctttttcacgctatctctctgattcactcttttcctctctttctctatcttctctctttctttcccttttatctctctctctctgctctctgtctctctctctgttatctctccctctccctatctcttcctctcactttgtctcactctacctctctcatgctactttccctcactctctctgtcatctctctctcccgtcgctctttctctccatcttcctctctatatttctttctctctctcacctctctttctctctgctctctctctctcccaacctgtcactctctctctctctctttctctctctgctcactttctcttctctctctttgtctctttctttccctctcccttctctctttttctcgctctctgttttctctctctcccttctctctatctgccctctctctctcccatcctctcactttctctctctctttcttcgctctacctcactgcttatctctttntctctctcttctctttcccattctctcacctctctcgcagctctctctctgctctctctcattatctctngaaccggnttaatcttagaatgcctttaacccaataatttttttagtttac

SEQ ID NO: 41648 - DNA, 1042 bp, Heterodera glycines
  misc_feature (52)..(52): n is a, c, g, or t
  misc_feature (77)..(77): n is a, c, g, or t
  misc_feature (118)..(118): n is a, c, g, or t
  misc_feature (127)..(127): n is a, c, g, or t
  misc_feature (142)..(142): n is a, c, g, or t
  misc_feature (151)..(151): n is a, c, g, or t
  misc_feature (186)..(186): n is a, c, g, or t
agagaggagagtaagagtgaagtgagacagaggagatcaataaagagggagngaggagagagagggggagggaaaanaactttcaaagaaagggacaaaaaagagacaaaaaaggaangaaaaaagngcgggcgactgaccngcacaagantaatttcggcaacccaagcacggaaaagaagaaanaaccgcaaaaagaaaaaagaaaaaaaagcactgacgtaagcacggttagggggaaaaaggcgaaagtgacgaggccttcctaaagaaaggaaagcgaaattaaaacacagaaaaaatacccaaatttcgatcactccgggcgaaaagaaggccaaaatcatatacatccaaatgtaagcaaaaacggacctaaaaagggaaaaaaagggggaaggggataagtgccgatgggaaagagaaggacaaaagacaataagttaattgattaccatgtggcagtcacgaaaaacacgtccaaatgcttttgacggcgaatttcggtgggcggcacagcagaaacgcaaatggcgatgatcatgaacagattgaaggcggcggagccgacgattgtattcggctgagttgggggggggggcaatggcattttgaggggggggggggcaaaaagaaagaaaatacccccaagtcgccggcttcgaagccctaaaagtgagcacggatcaacaaaagtgacgatcactaattcaaaattacctttccgaccacttcgattatggacaaaagaatttcgggggcggaagagccttaaaatttggcaaatcattttttggccaatcggtcgcttaccaagtgccatcagtgtgaggttggacaccttaacaattggcaattgacaaacagataccgtaacaccctttctctgctgcccttaccgtatcgttccaaattcgaactttgaccttttgatcaggcaatccgagccgtttgatcaccacagttcgttccatcgaagtgatctgaaatcaattcgaaattatcagaaacaaacgcatcgaatcaatcgtaccacttcgat

SEQ ID NO: 41649 - DNA, 880 bp, Heterodera glycines
aggcaaataatttttatttcacgggtatttttcagaaaataccaattaaataatgacatcacagatagacacaagtttgtaataaatttaaacatacagaattttttggaataaaatggctttaaataggcaaataatttttatttcacgggtatttttcagaattaaataatgacatcacagaaagacacaagtttgtaataaatttaaacattcagaattttttggaataaaatggctttaaataggcaaataatttttatttcacgggtatttttcggaattaaataatgacatcacagaaagacacaagtttgtaataaatttaaacatacagaattttttggaataaaatggctttaaataggcaaataatttttatttcacgggtatttttcagaattaaataatgacatcacagaaagacacaagtttgtaataaatttaaacattcagaattttttggaataaaatggctttaaataggcaaataatttttatttcacgggtatttttcagaaaataccaattaaataatgacatcacagatagacacaagtttgtaataaatttaaacattcaaattttttggaataaaatggctttaaataggcaaataatttttatttcacgggtatttttcagaattaaataatgacatcacagaaagacacaagtttgtaataaatttaaacattcagaattttttggaataaaatggctttaaataggcaaataatttttatttcacgggtatttttcagaaaataccaattaaataatgacatcacagatagacacaagtttgtaataaatttaaacatacaaattttttggaataaaatggctttaaataaggcaataatttttatttcacggg

SEQ ID NO: 41650 - DNA, 704 bp, Heterodera glycines
ctttatatgtgcgagggatttttgctccccatatttgtttgagtaccccaaacagacactcgaaaaaatatctttttttttgttttcggcacagtccccgagatccgatgcgcacagatttatggggagaccgaatccttcgggaatagattccctatatactgtactttaattgtgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtacgttaattctgcgttggatttttgctcccccataattgtttgagga

SEQ ID NO: 41651 - DNA, 614 bp, Heterodera glycines
gttaacaaaaatgcaataacttcctaaaatacacccctaagaatcgaccgaaaatttttaaaatcacaccactaagaattggaaattttcttaaaatatttgaatatttatgtgcatattttggtcatttttcgtgcatatttttgcagccctgcctatgacaaatacttcgcacagtttagcagttacaaattttcctaattttatccaacgattcttttgaaaattaatgaaaatataaacatgagttttggtgacaaactctaattttggtattaaaaaagtttgttgattaaaagtgaaaataaaaacaattgggtttattgcttaattatggccaatttggacaacttcgacaatgatacggtaattaattggtaaaatattatttaattttacaatatattttcagttttatttggccttcaaagatgccaatcccagctggtctctgattggatgcgcactgatttatggaatcattacaacatttggaatcatcttcatttttctgtgatttttatcccagtcaaacaaagtataaaatgatgaattattatttgatcgaaattataattttatagtttttagatctctcaatggctccgccaatt

SEQ ID NO: 41652 - DNA, 1461 bp, Heterodera glycines
  misc_feature (32)..(32): n is a, c, g, or t
  misc_feature (1383)..(1383): n is a, c, g, or t
  misc_feature (1420)..(1420): n is a, c, g, or t
caggaaaatgcatttatgattttagcctatgnattaaaattattttatacatatgtaataatttggattatattgtataattttgcaatattttttctgcgcattgccatgaagaaaagggctcaaaattagcatttctatgttaatttttttttgtttgagttggtgaaggtttttagtgcatcgtcgccgcccaccactgttcggaccagcagagttgttgcgaattgaaaaataaaatgcaaaaaatgaaatacgaaaaaaattaaaataaaatacgaaacacaaacgaaaaacgaaacgcgaaaggcaaaacacaaaatttgtttttgaaaaattctaaaattttagaataattctaaaatataatcaataaagaaatattcgagatcaattattttcatattttttaatcaaattccataaaatttagaagttgatattattgttattattgttttttacttttaaagttctcctaacatttccttaatcaaggtgtgatctgctaacaaattttatatttttttgccgcataatttttcctaaatttttgtggagtaggaccgaaaggtcatacttttttgaaactagccaaattttttgcaattaaaaaacgaaatgcgaaactcaatatctctcctgaccccactcaagcccagcagaaggacaatattttcagtattgtcggccgccaagcacttaacaggccggcgttccccgacacacctttttggcgatttgttctgcccaaaaatatcggcccattttatggtcttccaattaactttttttcactgcaacaataattgggcatgtgttaaatgtaacaaaaaaagagaagctgaatatttacatttaaaaatgaatttttcatatgcaaaacgaataaagcgaattattaaattaatctttaataaataataaataaatttataatacgtaatttttatttataaatttccttgacttttcttatgctgaaagtcaatcggattacttttaaccaaatgaaaaagaagaacattcgggctttaaatatgtaaaaaaaatgagcaaaaatagagcggaaattgcgagtaaattgggcattagccgacgcaatatttaccaatggaagaaggaatttggtaaaacaaaatttttttatttaagcggaaaaaaagatatacgaagcaacaaaaactgagaaaaaaaagaactttccaaaaaaattcagcataagaacggtcgagaaaattgaagctaaaatcacgcgaaagattggcctggcattgtccacaatttatctttggatgagacaattcggcgtatttacacgtacaattaacaaaaatattcaaatattaaattcattattacaaatttaaggaagatgaccantcactcgcaaatcagcagatgctgagaaatttgaatntgtaaaatggttaacaaatgaaaagcaaagccatgagcgat

SEQ ID NO: 41653 - DNA, 954 bp, Heterodera glycines
cgtccgctttttctcatccaaattcgtctctctttcctttcaaaggtttttcctccttaaattcgtctcgctttcgtccgtcggcttttctctcacacaaattcgtctccctcctcccccatcgcttccccaatttcgtccgtctccgtctctctccgttgttttttctctttttcgccaatgttttgcccatcgtccaaaagaaggggcgactttgccgaaagcagtgacctgtcgagacgaaggtgaaaatggccaaacgctcaaagaagcgaatcactcgccttttttgtgccaaattcgaaggcatttgcggcatttctttgagctgaaagtgaacagattgactttttttttttttacaaattcggggaatgttcgtcggttcggcttttcctctctttggcacttttcctttcctttccttccctccaaattttaattgcctaacacttttccacatattctaattacttcccttaccgtatccccattaccgtacccttttgtgtccattccgttcacaggcgtaccccgtgccaacttctgtcccatttccgcgtcttctcactccgccgcccgtttgttctgcaccgctgcattccaacgtaattacggaatgtttggcactgttcgctctcagcggcaatttgggacagtccaaaagaagcgacgccgccgacccgcccgctgcgcatgggcacggcttccccgcgacggaggagggcctttggggcacgtcctttttcgctgtgggcggactcgtcaacagaaccccctccgaactgcttgagcaccgggcgaatgtcatccgctgcttgatttgaaggttttcgcccacgacactttgccttccgaatgcgcttccgcccattagaacggaacttccgcctgccgtggctatagaaaaacccgttggttcccgggtacgacccgttcgagttgcgtccaaca

SEQ ID NO: 41654 - DNA, 617 bp, Heterodera glycines
cgccgcgtacaccacctcaccacacccgaccagcactcccagcaaaatgccgagcaccaaagggaagttcttggtctgcgccttggccaccgcaacgagaactaaaaattaaaaaaataaatgcatgaaatgaaagagtatgagtataaagtcttaaaaaggggatggtaaaatgtctaacctcaatgacttaaaattaaaaaaacccaaaatttaaatccaaaatttggacataagcgcaagggcatggacacgatttgttgcaattttccttttttacctatgttaccccttcagactcctttccccaaatttcaaagaaaataatcacttttttgcaaaaacccagaaatagtgaaaaattttgtgtttttatgatatttgttaacccaacaaataaccaaatacgcctatttaattttttaaaagaaaatttctttttttttagaattcaacaagaccagaaaaagtttttaaattatatgtacctggcgcggacgatggtggtggctccatcggtggccacggttgtggtggtggcggtggcggcgtccatggtgaatgtttttgcgtccttcgtattcgggcatttgtgctcaaagattttttttctttaa

SEQ ID NO: 41655 - DNA, 1253 bp, Heterodera glycines
  misc_feature (6)..(7): n is a, c, g, or t
  misc_feature (34)..(34): n is a, c, g, or t
  misc_feature (81)..(81): n is a, c, g, or t
  misc_feature (99)..(100): n is a, c, g, or t
  misc_feature (115)..(115): n is a, c, g, or t
  misc_feature (121)..(121): n is a, c, g, or t
ctgcannggtctttgaaaaaaaaataaaataatnaggagactcagaatctttaaaagtttttataaaaactgatgacaagntaatgtgacataacaggnnaattcttttcctttnagtatncctgcaaagtttggggcgcttctgataagtttctgaaaaattagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaactaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaatttttcaaaaaataaataaacagttaaaaactcagaatttctaaaaaaatttaaaaccaattacaattgtcattttttcaggttaagttagtcctgtaccggggagtatccctataaaatttggtacgattttattgattattgaaagagctagagccgaagaaaatctttttaatttaagcttaatctttttggcatgtttaaaaagcaattaaaaattttattcatctccctttttgatagtaaaagcatcagagagccttatttaccttgtacataaatttgatgcgtttcagagcactttgtgaaaaaatatctatgaattaattttgcaaaaaataatagtcagtgaaacactcagaatttctaaaaacctttaaaagttatttctcttcctttcagtatccctgcaaagtttggtgcgcttatgataagtttctgaaaaaaaagttaaccctaaactttttggcctgtttaaaaaggaattaaaaatttttaaaaattttattcatctccctttttgatagaaaaggcatcagagtgcctaaactagcatgtaaataaaaatgggtgcgtttcagagcagtttctgcaaa

SEQ ID NO: 41656 - DNA, 724 bp, Heterodera glycines
  misc_feature (163)..(163): n is a, c, g, or t
  misc_feature (236)..(237): n is a, c, g, or t
  misc_feature (287)..(290): n is a, c, g, or t
  misc_feature (362)..(363): n is a, c, g, or t
  misc_feature (415)..(416): n is a, c, g, or t
  misc_feature (489)..(490): n is a, c, g, or t
  misc_feature (540)..(543): n is a, c, g, or t
  misc_feature (580)..(580): n is a, c, g, or t
  misc_feature (615)..(617): n is a, c, g, or t
  misc_feature (674)..(674): n is a, c, g, or t
  misc_feature (711)..(711): n is a, c, g, or t
cgtaagagctgcggaaattgtgaattaattctcagaaaaatggctctctttttaggacaattttctatctcgtaaccccgatgctattccgttccggagagcctcttcaagtttttttcctttcccctggaagctgcgggctttgtgctttttttctcggccnggtggctttctctttttgggccttttttctctctcgtccccccgttgcttctccgttccggggagcctcttcnnttttttttccttcccctgggcgctgcgggttttgtgttttttttctcggnnnngtggctctctctttttgggccctttttctttctcgtccccccgttgcttctccgttccggggcgcctcttcnnttttttttcctttcccctgggcgctgcgggttttgtggtttttttctccggnntgtggctttctctttttgggccttttttctttctcgtccccccgttgcttctccgttccggggcgcctcttcnnttttttttccttcccctgggcgctgcgggttttgtgttttttttctcggnnnnttggctttctctttttgggccctttttctttctcgtncccccgatgcaagtccgttccggggcgcctcttcnnntttttttcctcccgatagagctgcggaaattgtgaattattctcagaaaaatggctntctctctttaaagaaattttctatctcgtaaccccgnatgctaatccgtt

SEQ ID NO: 41657 - DNA, 726 bp, Heterodera glycines
atagacctgccattgctattcctgcaaatattgagtctagtcagcccaatcgattgctattcgaatggtttggggtcgttggcccaaacaaaagttgtgctgcttcttgcaaagaagactaagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcgactaaatttgaaaatcgatttatggtgtacaggatgtttgtcgaaacataactcgtcaggcctttaagatagacctgccattgctattcctgcaaatattgagtctagtcagcccaatcgattgctattcgaatggtttggggtcgttggcccaaacaaaagttgtgctgcttcttgcaaagaagactaaaccaactgtaaacagcaagccatcccaatgcttcaatgtaaaaaaaaaaattacatttgggatgcaacctttatttttcct

SEQ ID NO: 41658 - DNA, 1240 bp, Heterodera glycines
aaaaataattattgacaaaaaatggctatctctgaaagtcacgattaaatccccttccgtgaattggtcaccaactttgtcttttgttgtagcgctgaataaagcactaatagtgtgttttgaaaacgcacgaaaaatagttattgacaaaaaatggctatctctgaaagtcacgattaaatccctaccgtgaattggacaccaacttttgtcttctgttgtagcgctgaataaagcactaatagtgtgtttgaaaacgcacgaaaaatagttattgacaaaaaatggctatctctgaaagtcactattaaatccctaccgggaattggacacaacttttgtcttctgttgtagcgctgaataaaacactaatagtgtgtttgaaaacgcacgaaaaatagttcttgacaaaaaatggctatctctgaaagtcactattaaatccctaccgggaattggacaccaacttttgtcttctattgtagcgctgaataaagcactaatagtgtgtttgaaaacgcacgaaaaatagttcttgacaaaaaatggctatctctgaaagtcacgattaaatccctaccgggaattggacaccaacttttgtcttctattgtagcggtgaataaagcactaatagtgtgtttgaaaacgcacgaaaaatagttattgacaaaaaatcctatctctgaaagtcactattaaatccctaccgggaattggataccaacttttgtcttctgttgtagcgctgaataaagcactaatagtgtgtttgaaaccgcacgaaaaatagttattgacaaaaaatggctatctctgaaagtcactattaaatccctaccgggaattggacatcaacttttgtcttctattgtagcgctgaataaagcactaatagtgtgtttgaaaacgcacgaaaaatagttattgacaaaaaatggctatctctgaaagtcacgattaaatccctaccgtgaattggacacaacttttgtcttctgttgtaccgctgaataaagcactaatagtgtgtttgaaaacgcaccaaaaatagttattgacaaaaaatggccatctctgaaagtcctatttaaatccctacccggaattggacaccaacttttgtcttctattgtaaccctgaataaaagcctaataatgggtttgaaaaccccgaaaaataatttcttgaaaaaaatggctatctcttaaaagcctattaaatccctaccggaaattg

SEQ ID NO: 41659 - DNA, 1115 bp, Heterodera glycines
  misc_feature (6)..(8): n is a, c, g, or t
  misc_feature (18)..(23): n is a, c, g, or t
  misc_feature (56)..(56): n is a, c, g, or t
  misc_feature (69)..(69): n is a, c, g, or t
  misc_feature (72)..(77): n is a, c, g, or t
  misc_feature (79)..(79): n is a, c, g, or t
  misc_feature (85)..(85): n is a, c, g, or t
  misc_feature (95)..(95): n is a, c, g, or t
  misc_feature (100)..(100): n is a, c, g, or t
  misc_feature (102)..(104): n is a, c, g, or t
  misc_feature (107)..(108): n is a, c, g, or t
  misc_feature (110)..(112): n is a, c, g, or t
  misc_feature (114)..(118): n is a, c, g, or t
  misc_feature (121)..(121): n is a, c, g, or t
  misc_feature (125)..(125): n is a, c, g, or t
  misc_feature (127)..(127): n is a, c, g, or t
  misc_feature (135)..(135): n is a, c, g, or t
  misc_feature (147)..(148): n is a, c, g, or t
  misc_feature (152)..(152): n is a, c, g, or t
  misc_feature (154)..(157): n is a, c, g, or t
  misc_feature (159)..(159): n is a, c, g, or t
  misc_feature (162)..(162): n is a, c, g, or t
  misc_feature (165)..(166): n is a, c, g, or t
  misc_feature (174)..(174): n is a, c, g, or t
  misc_feature (180)..(182): n is a, c, g, or t
  misc_feature (189)..(189): n is a, c, g, or t
  misc_feature (994)..(994): n is a, c, g, or t
aaaaannncggaaccaannnnnnaaacgaaacagggcacaaaaagagagggagggnagaagacgagagnaannnnnngnaagcancgcaccccancgaanannnccnnannncnnnnncanaacngnccaaaggngacggcggccanngacncnnnngnagnccnnaagggacngggacnnnccacagnaaaatgtggtacaaattttggaactgtcccgcctcacggtgggacttaaaagcaggataaagccaagttcgaaacttaaaaggagaatttaagttttgaatttttacaatttaatttcttagagtcaaaaaattcggaacagaagcattatttaaaatcaaaaataattttagtaaattttttacattttagtttcaaaaaaacaaacaaaaaaatgtgcccaattttgaaaatgaaatagtgcacaaaaagggagggatggttagacgaaaagagaactttttaggaagggacgcaccccatctgatattcacccttttctgttccataagaggccagaggcgactgggttcgttgacaagtaattgtccaattaaggtacatggacattccacagtgaaatgtggtacaaattttggaactgtcccgcctcacggtgggacttaaaagcaggataaagccaagttcgaaacttaaaaggagaatttaagttttgaatttttacaatttaatttcttagagtcaaaaaattcggaacagaagtattatttaaaatcaaaagtattttagtaaattttttacattttagtttcaaaaaaacaaacaaaaaaatgtgcccaattttgaaaatgaaatagtgcacaaaaagggagggatggttagacgaaaagagaactttttaggaagggacgcaccccatctgatattaacccttttctgttccataagaggccagaggcgacttggttcgttgacaagtaattgtccaattaaggtacttggacattccacagtgaaatgtggntacaattttgggactgtcccgcctcacgttgggacttaaaagcaggataaagcccagttcgaaacttaaaaggagatttaagttttggatttttacattttaatttctagagtcaaaaaat

SEQ ID NO: 41660 - DNA, 726 bp, Heterodera glycines
gatgcgctgatggggggaattgaggaaagggcttggggaagggagagggaactaaagatcgaatgccgagggaaggtggccactaccgctcggttggtgagttcgaaaacctatgtcccaccccccaaaaccaattcctgactccgaactttatttccttcgatggataaaggtataaaatggaataaaaatggagaaaagataaaatgaatggaaaatgaataatcataagtgtaaatcgttaaatatccgtttgaataggcggagccaagtgagagagagagagatataattaagtcgataaatggagagaatagagaaaaggagtaattgcgatttaaatagaatgataaatggataattgacgtaaatgaatatgccttacaataagcataatgccttttcaaaattattccgcccggttttttgtttaatgccgcttttttttgaacacaatcacttcgcgaaatgtggccacttttggccatttgatccactgttgactttgtcttttgcttttattctaaaaatagctaaaagactctttagccattgcttttgctggtttgtgagttggccaattacggagttaaattgcataattaatttatgcatttattcacataaaaaagcaaagaataatcaaaatcatttttggaaaatgagagaaaagcaactatgggtgatggaaaattcaaaatttgatcattttaattggttgtttaa

SEQ ID NO: 41661 - DNA, 871 bp, Heterodera glycines
caacagtataaataaatattaggcaaatgaaaaattcttttccttcctctttagaaactgtctaaaaatttttgttgcttatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccattctgctttgacaggccatatctcgccagggagtggcggtagaccctttgttgatacatttgacaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgt

SEQ ID NO: 41662 - DNA, 878 bp, Heterodera glycines
ccccccccccccaccatcacaaaaatgaccactcacatggacataatgaaggggtgggaacaattttgtaaatgtgtagaggagatgtttgtagcaaaataaaacgaaaaaaacaatggattttgaatggaatttttaaattttaattttaaagtatttttttaatgagtttctctacttgagaaagaaggcagaccttgtctgattctgttaaatttttatgaaatttatgggaaaaaaagatatctcaaagattgaggtttttgtttaattagtttctaagacttttttgttttagagaaatttttattatttttttcgactttttatggggtgttactccccgaaccgaaacccaaaaaaagtaaaagttttcaataattttttttttgaaattttaagcaattttcttgacaaaattgcattcaaatactcaaaaatttttccggcggcgccttcggcaccgtcgacccctattttaccatatttttgaaaaatggagaccaaaatggcaaaaataaaagtattttttggcgaaaaatggctaaaaattttgtaaaaaacctaattcgggatttcaaaaaaactacacacctaaaaatctaatgaaaaaaagaaaaaaaatacatcccaaaatcgaatttctgacttcagcccccccccccccccgaagccaagggtttgactaagggcgggtgcccttaacaatgctactccctttaaaaaataacaataattttttctgaaaaaactaattaatttaattcaattttaatttttcagtttccaaaatccattggtctgccccggctctttcgtggtccgctgagcacaagcacacaaaacattaacaagcagtacacaaaatgttctgccaa

SEQ ID NO: 41663 - DNA, 1687 bp, Heterodera glycines
atattcatgatcagcaggccccgaaaacccctggaaactctttttatcattaaaaagaaaaaaaattttgtatgtgggtcaaactgtataagtaccccaaaattcaatcggactgactgtcttaaaacattcattttgatatttatccccaatttcagcccctcgacaaaaaacacgaacaatcgctgaacgacgccctgcaaaagtttgccacgcgtggacagaagctgaacttgaccttcactgtgaagccggacttggttggtggactggtggtgaacatcggcgataaatatatcgatttgtcaatggcaacacgccttaagaaaatggacgcggtggtaaagggatcgatctgatcaatttttgttagcacgacagaattagccgatgacttgacagttccgaatgttcttttgtttttattgtctcaaataccatattattactataaataggatttttgatgttattttttatccatacaaaaattgaatgtagggaaaggaactggcggaaaattagggaattctgtaaatgaactttaaatttgccggtatgcatataaattgttttatagtactgataaaataatacacaaatagacatagtaaaaagtcaattggatgcccaaagtcggaggatggagttagacaatgtcaaataattgtgaatagacgcgcaaccaaaaacatgaaaaattgtacaaaataacagaaagagatataggttgatgatgatcacatttttcacatgcgtcgtgcatttactcgagtgaattcgtagaccagaataaaccttagagcagccaatcaaatcacttcaatctttgagttattgatgccaaagcaacggcaaaagcctgaaaacatcaaatgtcgaaatagacaattactaagagaaccaacctgaatggcagaaaagggctcgcgaaagtccaatgtgtacgcaccattctcgatgcgtccaaattgaagcacttgccgagactggtgttcaatttggaagttcttggcagattcttgagtgactcttccattaaagtccaacttaaacaattaaatatcgtagagaatgaatcacactacacgcccaccattaacatggtttctgcatttacctggtagacttgagactgttcgttccagaagggccttttgttggtcatcaccagtatcttcgtcccgctcgtcctcctcttctcctcgtcgtcttccccctgtgcgcctttccgtccgtttttaccttcccgtttcttgcaacacttcgacggcgtttccatggccaaatccgtctttttctccgcatttcttctgtttgattttggcactcttaacactgacgacgaatgtattggcacagttgcggtgatcgttgactaaataagagagaaaatgggaaagaatgggccgaaaggagcacctgactagcaactgtcgaagaacacttcaacaacggcacaatttcttcgccaaccccgacagctgattgtgagaatgcaattgcagtgccatcacagtcattttcttcttcctcttcgtcgtcgtcgtctccctcccccaaaaccatttttatgtgctgcacacgctgtcgaaggtcaccgccaatttcatttaataattcgttgatacgaatcagctgtaaagaaatgccaaaattagtaatggaggttgaagcaaaataagaa

SEQ ID NO: 41664 - DNA, 316 bp, Heterodera glycines
caaaattttcaattttttctagtctaatctactcatcattaagcagaattcaataaaaataacattcacggtgcgaaaaatggggtatgaaaagtttattggggaaaaaaagactttacaaaataatacccctgggagaagggagtgggaaacatgatttcaaaattttcaattttttctaggtctaatctactcaaaacggctcagaattcaataaaaataacattcacggtgcgaaaaatggggtttgacaagtttattgccgccaaaaagactttacataatttttcccctgggatatgggagggggaaacct

SEQ ID NO: 41665 - DNA, 1428 bp, Heterodera glycines
ttccataatttttctttgattttatcaaatttttgctttatttctcttttttgttgatcatttgggtgtattcccattttttttaatggatttttaaattttttggtaattgtcgttattttcatgggaaaaaaactttcgctttttatttaaaaacgatttcatcattttaatcgaaataaatttatattgataataccacttatttttatacggaaagaaatttttatcggttttaaaataccaaaaattccctttccttaaaaaaaacccaaaacccaaaaaaaaaattgcccacaatgccaggaccaacaaatcgtaaattacgaattctaaacgaacctttaacttttaattgtgaaaagtcgattttttttgtcaaaccccgaaatatgtgcgagaaattaataaaaaaaaattattacttttatagcaatttggcagtaattcttttttccatttccgaaatgtcttttttgaaatgcctaattccttcacaaattctttatgttttccttggccatataaacttttaaattcatcaattcgttcaatgaattcgctctttttctcttcataaaaactctttttcattttattgaatttaattttatttaaatttaattcatttttccatttgtatatttttttacgatttgcgcctaataattttgcaattttccactcaattttatttcttttttcattttcatattttcctttttctctcaacttttctttaattgcatcaaatttttcgattgtttctattttttgttgatcattagggcggtttccattttttccactgttttgattaatattaaattcagagttttcattttgttccattttaataattttttcttcactttcatttttatcccatttgtcgccaaatatttcgtcaaaatttggttggattttgccagatttaattccataaaataagcaaaatataataataactattaatagccataaattcatttttactattttgaaatttttttttttaaatatttttaatgttattttattgcttaatttctgctcattttataatcaataaaataatgtaatagattttcgctattatttggcaatgatacaaatgagaaaaataatataataataataatcataattcaaaataaaatttcaatgtaaaaatttcttatttaaatttttaaacataataatagtaatcgggttcatagataacaaaaaacaattttcaaattctaacaactttaattataagcaaaatatttcaatttcttttttctcaattcttaaacattttaaaataaaattcattttttaattcatcaaataaatttatttttgtaaaattaaacaatttaaaaatcatttttaattactttaaagatatattttcattcgtttttcgcacttccattcttc

SEQ ID NO: 41666 - DNA, 978 bp, Heterodera glycines
tcagggattaattcctgaggaatttccaaggaccacgtgcatcattgctacaacggggccttaatggcattttaatgtcaaaatgcccgacactagtgcatttctttagacaacgaaaattaattcttgaggaatttcccaaagccatgcgcagctttgttagaccgatgccgaaatggcaatataattggaaaaggacagacaacaatgcttttctttatatcagctgatggtttatttacaaaaatcgaaatacttcctgattactttccaagaaccatgagaataaatatcgcactagcgccaaaatcgaacaagaacgctaatcatcagaatcatcttaattttcccccagtgatttgtgagtgataagaaaataaaagaaattcagggattaattcctgaggaatttccaatgaccacgtgcatcattgctacaacggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgagtactttccaagaaccatgagaataaatatcgcactagcgccaaaatcgaacaagaacgctaatcatcagaatcatcttaattttcccccagtgatttgtgagtgataagaaaatagaagaaattcagggattaattcctgaggaatttccaaggaccacgtgcatcattgctacaacggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagaca

SEQ ID NO: 41667 - DNA, 932 bp, Heterodera glycines
gagccaaaaaacgaaaaaaccaaaattgaactttatggtgccagatgaatgcgaattaactcgagttgaatttccacctcaaaattgcgcaacttttaagcattctgccatttctaaaatgaacccactcgtaagtattttagacttttcagttaaaatcattttggcttgaaccctgttcaaataattatataattaaattttaaacaaaacaaaatttaccagatttccggtggatcgaaacttgccataaaccgtatgtcgtggactgtttattttctggctactgtagaaaatgagttccaaaccatgggatacggctgcacagcttcgctgatttcaccgcaattcgttctgttggcagcacattgttttgacaatctgaaggaaaatggacaattttcacttggtaattttttttattaaattaatacataaatttgtaaaatgtcatgatgaaaaaatgaataatagatgtatatacgttataataattaataatatttaaataaaataaaaataaatattattttttaattccattttatgattcggatcaaattcgcgcatcattccgagatcacgctcacattatgatggtgttatcattaaaatgattcttgaaaacggctttaatgtgttcatccacccaaattataagaaggaagttctttgcttgttcgatttagcacgaattaaggcatttaaaaatataattaatttattattaaattgttattttagatggacaaaaaagttaaactttctccaaaaatgtatccagtctgcgttcattgtgggcccaccgaaaaattcaaaaatggaaaagcattcattgccggatggggaaatttaaagagtaattaattaatgaatgatttaattaaaaagataacacaaaaaattatgaagtaaaatatttaaataaatca

SEQ ID NO: 41668 - DNA, 854 bp, Heterodera glycines
atatttttttatattaaaaacttataaaaatagtgcactcattcagaatgcttaaacataaaactaaaataacaaacccataaaagtcataattaaaaatttaaaattattctaaattattaaaagcatgaagcactaattaatgcacagaatcaaatgatgatttaaccagaaattaattaaataaaatattttctataataaacaaatacataataagattcatcactagggtagcaacttttagtgacgaaaaatcccgaaatagttaactaaaatagtgagtaaaaatgccaaaatagtgaagaaatagtgacaaaaagtccgaaatagtgacgaatagtgacataattttcagccaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaaatttttttcatttcttaggagtgctttttgaaatttttttttgtcgattcttaggggtgtattttttgaaaaaaatttttaggtcgattcttaggggtgtattttttggttttattgcatttttgttaaagaattttccaaaaaatgtcgaatagtgacaaaacgccaaaatagtgatttttaactattttagtgacgaagtcgccaaaatagtgatttccagtgacgaaaagtgacgtccaaatgaaaaaattttaacgcagaaatgcgttttttgagctcctttcttcaaaacaattgagcaaaaaaagaagttttttcactaaaagttgcttccctattcatca

SEQ ID NO: 41669 - DNA, 777 bp, Heterodera glycines
atttattttttcttattacccctcaggcaacatttgtctattcgtcactccgtggcgcgcgccctgagagtgcggagcccatcgcggtcgtgttcacggacgggtttggccagcacgagtttgacgagcaggcatcgctgctgcgccggttgattccgcgcgtgtacgcgctggcggtccacgacggtgcacgggcggcgccaatcgcgcacgcagagttatccaaaattgccggagacccacggcgcgtgttcaccgcaatgacagtggccaatttgtacgacgaactgcgcgagcggttcagagggtgctgacacatggacggatttcaaaaatgccgatttagacaacatttttggcactcagaatttccaatttacttatctaatttttaattagagaaacaattaggaattcgtttaattttattttattttttttacacaaaatttaattgctcatatttattttttgacaatatgtaaatattttattatgaaatttttttgattaattgcaatttatccatgagcgataatcagtaaatattggtcatttcgatcataaaaatattaaatttgaaagccgattatgatcaataatttattatgaaaaaatttattagagaaattttaggaaaattttaccaaagatattttaaatttttcaattaaattgaaatattaaaaatgcactataaatatgtgcatcaaaccccaaaaaatgcccttttcctcataatcttccaccgctttttcttcatcactcaattttctt

SEQ ID NO: 41670 - DNA, 956 bp, Heterodera glycines
ccagctaagtagtcgacggttcacgcacccgctaccttaacatagaatgccaatacaaaaatgctattttgagtgtttagttgaatgtggctatttctgacgatagttttgtggcatttcattcaaatgatttttgaccactttttgtttgataattttaaattaaaattttttgtattttttattgccttttgttagactattttattccgcacttatgaaattcattcaatttgacttttgcttattaccgtacattggcctcatttccaaattaaaccataaaaatcacaattaagcttatttaatctctctttggtcgtattttacgcctcattgtttaattgacatcaaccaaaatgtgtaataattgacacttttgccttgcgattcttttttagacaaccctctcttacaataattgccatttccattaatggcaccctatgctcattttccgttcacctgacgtaattttctacggcaccagcggaccggccgttagcggaccaaaattttttgtcccataactcttgatagatttcttttaattgcaagctaatagagaataattagagtctcgaatgatacccagatatttgtgttggataattttgctccgctacgtcccttaccctttttttctgccccatcattaagcatagcaccaacaattatcattagcattttcgtaatttaatttttgaatttttgtgcctaatgatcttctgaacacttttgccgtctttttaaaggctctaggaaaatccgacaccggaaaatccgacactggaaaaaccgacacgacaccaactttaaatttaaaaaattttgattgtttgagttaatatctggctaagtttatcaagttttcgaattgaattttaaagaactaaattggttgcgccattcgatgggatattgctaacaaataataaaggggttgtcgattgttg

SEQ ID NO: 41671 - DNA, 1592 bp, Heterodera glycines
cagtggacattccgtcaagaaattttcttctttcattgtcagcaatgatcacaaacgttttctattcatttaataatttaattaaatttattattctttaaaaaatgatctttaattattctaaaaatttttttgaacactttaataaaatataaaaatttttattaaatttttatcaattaatttaattttctatataaaattttgcatttaaaatattaaattttgctgacggattgtccactgcaataattgttctttgtcaccgctctttcccatcgattttgagcgtgataaatccatccaatccccaaatttctggatttgtctcaaaagttttgggcctccaatcccgaatcccgagacatccatccccaccttcagctcctgcactttgaattcgtttaatcgtgtccacaaacgaattgtggcactctccgccccgtcggttgttgtcgaatcgggcggttcttcccctcgtgccggtgccattgtcacgcttttgtcctcacccatcggtgccgtcgccgcatcctccggcaatacaaaacatggcggtgtggcagctaatgggtcaggggaggagacgaacacggcggcactgtccttaaggggatgcggtgaatggcttaagagcattttgccacggacccgaaaaatcaattataaaatgattttaaaattaactgacactgaacaaccattcacaaaaaaattggcacagaaatgcccttcttaaaatttatttggcactgaaatgccattctgaaaaatcatgggcacaaagtgccattcttgtaatatatcattcgattcgaatcgaattccagaaaaagtcatttttgaactacatggcgctgaaatgcgttctcaaatatcatcggcagagaaatgccattccaatcactaaaatgccatactcgggaaacattggcaccaaattgccattcttgaaatagtcaaaaggtttcagtgtgaatgaaaaattcaatcttggattattttgattccaactgccattttggtcaattgattccttgaaattttccaagttcgaaatttttttgctcatcggaattccggtttgaatttcaaaaaaatttggggcctgtggatttcacacctttgctacttccggaatgtaggtgctgttcatcaacaactgctgctgttgatcatcatcatcatcatcctccgcggaatgtttggccgttgtttttgccgccgcctgtttcgtctccacgccatatcgtcgagcagtagcggtggtggtggtgccattgttttctcggcgtgccaatgccatcatcatcatcattagcaggagaaagagcaatttaggtggcaatgggaatgtccagaggttaagaatggcttaaccgaaaagtgcgaacggcggcggaatgtgccaattggataaagcattcattggcgccggaatgggcggggtggcgaaattgttgcctgctgctggatgctttagtaataaatgaaaatgaacgctctgcagcttggcgtgctatcctcctcaaatttcaaagtgctcgaggaagtttttgtgtgtgtggttgtggggggacattgagggaaaa

SEQ ID NO: 41672 - DNA, 1051 bp, Heterodera glycines
tcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctcgaatcgcagctcctctgggttgcgaggtgtagcgtatagaccgtgagcttgggttggcccgcttgttcaagttttcccttcgaccggggctccagagaaggtggcaagacctgtccaactggcggtgcctattccattctttacgtgtcttggagtcgggttgttttggggattcgcagcccaaatcaggtggtaaactttcattctaagaactaaatacggccacgagtccgaatagcgaacaagtaccgtgagggaaagttgcaaagcactttgaaaagagagttaaagaggacgtgaaaccgaagaggtggaaacggacagagctggcgtatttggtctgcattcacccgtttgttgctgtacgttgtactgctagccttcaaacttggggtttgttgtccttctgttcagtggcgaatggggcatttgcaggcggagtgcgctgagatgctcggagtagcttgcgtgagctcggtcttga

SEQ ID NO: 41673 - DNA, 1255 bp, Heterodera glycines
ccaattccttgggccccaaccttgcacggcatacctctttccatttgatgacacgtggcagcaaaaagttgtacagcagccgagaggacgagagcgcattcggtgtggcattttcggcagggatgaaaggcacaatttcgaacaacagttcgagcggaaggcatttgggggccattgttgggagaagcaagggagaattttgtgatttggggttaattaggtagttagttcaacgtcagtcaaaggacgccgcccgtcgcaccggcactggattttgttttgctcgtttaagcagaagaaatggccacttgcatttcctttactttcttctacgatctctatctattgcctttaggtctctctttctctctcctaccctctctatctctctttcatttttctttatcggtcgcttttcgtcgtccccggaggggttttgtttgtgtgtctgccgcagtgtcgcgctttttcccttttacttctcacgtgaacactccttgtctttgcttctctgttctcgcttttcctccactggaacggcactctctgcattctctcgcctttcctttcgttgtctgtctctgcgttctctctctctgtttcacttcttcgttcgttttgaataggacagagaaatgaatccaacttcacaggctcatatatcatcaatttgacaaaaaatgcctaacattataaaaaaaaatgattattgaaacgaaaattaaaaaacaagacttgcgaagaaacaacagacactgtaagagttagacactattaaaagttaatgaaaataaaagtgaacaatgcgccaatgaaaaaacagacagctgaggttagacactatatgttttatcattgtttttaactaaatttctaatacttataacttggtgaagggtaaaccaaacaaaaccattttgtgctcattttgatgggaaaattcttaagaatatttcaaagttaaataaaaatttgaaaaaatagtttattagcaagaaaatgaaccatgtgttattttatatgttagagacatggaaatagtacactaaaatgagagaaaaagaaaaaactttgtcctgggtcaaaaaaattttcctcgggtcagattttcttgaaattttgcctaggctagttttttgaccccatctatcgaattctattttgttttttgaaagtatattttctaactcgagatcggctcttccatttttacaagggaaaatctcgataaaatttttaaattagcggggttttt

SEQ ID NO: 41674 - DNA, 760 bp, Heterodera glycines
gcggagtgcgtttcctaactttgttttttactatttgtatatttacatgggtactacccttgtaaatgcactatatttcctttttttagctgtattgggaagagtctcaacaccgacaccaccatgtataattcggccggcgataccagcggactcgtctttcgaacagtgccgacaatgttcagcagcagacaacaactggggccgctgccttgaacgcgcagagtggtcaccgtcgatcaacctcgcgtacgcgatcgcgatcgaacaccgcctcacctgctgccaaggagcgccgcgtgacgttcaaaaacgcgccgccgcagaccaccagcgggcgccgccggcagcagcaggacaagaatattgaagaagatgaagttggagatgggccgctgcagaagcagcctgggacatcgcaagcatccgcccccaagaagaccaaggagaagagggctgcctcggcccttccgaccatgcaggctccggacctatacggctcccggcccaaaccccctctggcggtgaattttctttataattttttgattctttttaaataatcattttcacccaagaaggcgctcgaccctcaatacagcgatgaggatgaggaggaagtctagtgcgaggaagttgagggcgataatgtgctgaacaccgcagaccccttccatgaacacacggacggccacgacgacgactgatgggccgctgcgatgcggcactatcataatttcttggctgatgaaaagatcaa

SEQ ID NO: 41675 - DNA, 1069 bp, Heterodera glycines
ttcaataagaaaaataagactcaaattgccttgttttcctagaattggctacccatgaaaaattttatataaaaaatgtgctcaaataaagtgtttttgtttgtgccaaatggttcagtgaatgctcctcgtcacgcaacagcccattccggcgaaaaggaagaaaaaaaatgtctttcgttggtttgacctatttaggcttaaatgagcattagcctcttataataataaaaaaaatttaggcactaagtgacaaacaacacaattgaaaagaaaaaactgtgaaataaatattctcaaaaaagattattgttattttacctttttctcgcagataattcaaatatttaatcactatttctcgttttttttttgtctaacctagcttagaaaggtcttagaaaatattaattttaattaaaaaatttagaagcattccttaaaaagagaaaatatatttaaataaaaaataattgtagaatttaaaaacttattgaaaaatcgatgcgaattttttcatccaattttgatctaaattattttcgctcaaattcattttccattcgcccataaagtcagagtaaaaaaagccgaaaaaaattggcaatagcaaatcgatcatgttctacatgaaaaagtggctttaagtggtttagacactcacatttggaaatgttcccctgtaagtgtcttattagaataaatgcttaattattatagattggatttttatataattttttttttcttgggtccacgtggtctaaataataggaaaaacattttttttgtgtttgcgaacaaaagttgggacttttatttgcatattttcggggtttttctacgcattacctaggtgcatgaatatttttatacatattttggatttcctcacattttttcataaatattttgaaatttttgggattttttaactaaattttttattaaatgccccgaaaaatccaaaatttctcaattaaataccttttcaataatttttatatttattatattttctaaaccagaaaaaattttgaaattggttaattctcttttgtaggttttt

SEQ ID NO: 41676 - DNA, 1128 bp, Heterodera glycines
aatgtcaaaaatgcaaaaaaaaaatgcaaattaagtgattgtcgttagaactggcaaaaacatttgaacatatgttaaaaaatcatcgaataagtgatctactgcgaacggagtatgccatcggtgccccaatttcatttgaactattgtgacgcgaatattgcgccggtgacccgtgccgagaactgcttcggcgggagcgcgctgttggtgactttgatcccgaattgtgccgggaacgataattgctgagacgggagcgagaattgccgagacgggatcgtgccattggtgactttgatcccgaattgtgccgggaacgataattgctgcgacgggagcgagaattgtcgagacgggatcgtgccattggtgactttgatcccgaattgtgccgggaacgataattgctgcgacgggagcgtgccgttgaccgcgatcgtgcagttttgggacgagagcgcaccgttggtgactttgagcccgaattgtgccgggagtgagaattgcctcggcgggagcgctccgtagacggcgatcgtgagtttttgggacaagagccttccgcaggcggcttgacacaattgtgttttgttgttggcgatttgctggtagaatgtgacagttccaatgacaatctaacaataagaagccaagtagataaacacaacccaattcactctcttacagccgaaatgacaaagtaaaataactagcaatttaaaaaagacatttgtttctattccatgcaataattgaggaagaattcttttaaagtggatcacgaaatccccgttcaaatgccaaattttaaaatttaatccctttaaagcgaaaaaaatatatttttatttttttgcgttgcaaaatttaaggtaaatgaaaatttgaaattggttaagttggcactggcaatatgacatcacaaaagatgagaattgttctccatttactggcgtttcctctctacctctgattcacttccggttgtgccaggattcgattcgcccgtttccacatggccgccttatgttccgcgtgcatccatccgttggtccgctgttgggcgccatgcgaaaattttgcattggtcttatacgaacaaaagccgtgcgtgaataaatgctt

SEQ ID NO: 41677 - DNA, 889 bp, Heterodera glycines
cctaatgggcccagcgctcgacggacaaagaaaacttttctcattgttttgtggtaggcgcttttcctctgccgatggaacaattgaaggcaaaaagtgtggcattggcacactctgtgccaacaaatttgtcttaatattttttttttgaacataaacaatgaagttgaagcttaatataagggatacatatgttcttgacagatattttattaattagttttttttaaataaagtgaaaattgctgaaattgttattttatatatatatattttttggttttttacacttaatttctaattttttagcttttttggtcaaaaatattaacgtagaataattaagtattttttggaaaataataaaactaaataataattttgaaaaaaattaaataataatctgtaacaatatttcttagagattaaataaatgatttaaatatattttttctaaatgaaatgataatttagttgaatttattccagaaaaatgaaatctgcgtgtaaattagcactaattttccgaaacaatgtttttatttgatttataaaaaaaataaattagggtaatttagaacggagtaagaaaaaatgaaaaaaacaaaatttataaaaacaatttcaatttttattttaaagaaaaccaagaaattatgcaaaaatttgatcggagtgcttactgaaatcgaaaattgttatctgtctttttttgtttcgtattgaacatttttttctattacttcgcaatttaaaatggcaaaataatattaggcatttgtaaatgagttcactctccaatgcccaaaaaacgtcggcaaaattatagaaaagctggtagaacggctaatcgcgggcgagaatcgatatggaaatcgatttgctgacc

SEQ ID NO: 41678 - DNA, 700 bp, Heterodera glycines
atagcttccctatagcctgtactttaattctgcgttggatttttgctccccataattgtttgagtaccccaaacggacacttgaaaaaatcgattattttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgtttcataaatatttttttcagaaagtactctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaattttttaaaattttttgttgaaatatttgtcgtgctctgaagggcgggggggg

SEQ ID NO: 41679 - DNA, 1002 bp, Heterodera glycines
  misc_feature (935)..(935): n is a, c, g, or t
aatgcgagtaagcagttttaaaggcaccaagcttatggtaatatttgtgctctaaatatgaaagacccttgtggaatgagttcgccacataatcacgtgcaatcccgtgtcctttttagaaattcccaaatgcgagtaagcagttttaaaggcaccaagcttatggtaatatttgtgctctaaatatgaaagacccttgtggaatgatttcgccacataatcacgagcaatcccgtgtcctttttagaaattcccaaatgcgagtaagcagttttaatggcaacaagtttatggtcaaatttgtgctctaaatatgaaagacccttgtggaatgaggccgccacataatcacgagcaatcctgtgtcctttttagaaatttccaaatgcgagtaagcagttttaatggcaacaagtttatggtcatatttgtgctctaaatatgaaagacccttgtggaatgagttcgccacataatcacgagcaatcctgtgtcctttttagaaattcccaaatgcgagtaagcagttttaaaggcaccaagcttatggtaatatttgtgctctaaatatgaaagacccttgtggaatgagttcgccacataatcacgtgcaatcccgtgtcctttttagaaattcccaaatgcgagtaagcagttttaatggcaacaagtttatggtcatatttgtgctctaaatatgaaagacccttgtggaatgagttcgccacataatcacgagcaatcctgtgtcctttttagaaattcccaaatgcgagtaagcagttttaatggcaacaagtttgtggtcatatttgtgctctaaatatgaaagacccttgtggaatgagttcgccacataatcacgagcaatcctgtgtcctttttagaaatttccaaatgcgagtaagcagttttaaaggcaccaagcttatggntatatttgtgctctaaatatgaaagacccttgtggaatgagttcgccacataatcacgagcaatccc

SEQ ID NO: 41680 - DNA, 1267 bp, Heterodera glycines
  misc_feature (1189)..(1189): n is a, c, g, or t
  misc_feature (1238)..(1238): n is a, c, g, or t
agaaaaatttgaataatttttttataagaaagccccggccctcgttttcttccgctttgatccccgatttttgctggctttgttccgctttatttccagcatttgaatggatggatcctgcaaaaaatacgttctcaaattatttggcccggccaaaattttcttttcgctcgtccgaagcgattctgcttaaatttgtttatgcaaatctttaaacatgcaacaaatgttcagcatcgattgaggagtacaacctgggccaggtgggctattacctggacgaagaaaacaattgggcgctggacatggacgaattggaacgggcattgaaggaggttggttagttggaaaaacaattcaattttttttttgtccattttttaaattttgggctaacggctgaaagttaaacagactgaggatttttctatgtgttttcccacctaaaaattttaacacgttttttggcccaaaaagtttgcaaaaaaaaataataaatttggtttatttattcttattcgtccaagcttggtatttgtccgacggtagtttaaattattcgttgtcctcctaaattggcactaattcgcctcgcccgtacgtaaatttcaacattttcaaaacacaacaaatccgatttgccatcattattttgcacgcattttcccccttgtatacacagagtgagcacgatgtgaaggcgattgtggtgatcaatccgggcaacccaaccgggcaggtgctgagccgagccaacattgaaagcatcatccaatttgcgcacaaacaccgactgtacatcttcgctgacgaagtgagctgatcacatgagaccaggcccgtacccagaaaaaaaaattttttggggaggccactcgaagaactttttttcttttctttttttgttgctttccagaccaaatttttttgtgttatttttcaaaatttcaagcgtagcggcgaaaaagcaggagtttgtagcgattttgcgccaaaaatgacaatttttgcccgttttgtggtcaaattttcaaaaaataaatggtccaatggaggccggccggaaaaagtttttgctaaagaaaatgtacaatttccaaaattttgtccattttttcttgaaaatttttttctcatccaaattttatgtatatcaaaagtcccatcggcggacggtttttcgaatttncatcaaatcattcaaaaaaatattagaaattgtttataggaattttaanaagaaaaattttaaaaagaaagtcttgga

SEQ ID NO: 41681 - DNA, 988 bp, Heterodera glycines
ccattcagagacaagtcaaaaaaaaaaataataggcttggactaccatactaattagaaattttagaatgtgtctgttaaatgcaaaactgttgtgaaaaattgttataactccattcagagaagagatagaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaaaaataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaataataataggcttggactaccatactaattagaaattttagaatgtgtctgttaaatgcaaaactgttgtgaaaaattgttataactccattcagagaagagatagaaaaaaaaaataaaaataggtttagagagcccgtgaacagctgcatcggatgcaagtgccgccgttgctgtacgcctaacagttggtgagcaatgacggaaaat

SEQ ID NO: 41682 - DNA, 902 bp, Heterodera glycines
  misc_feature (9)..(9): n is a, c, g, or t
  misc_feature (875)..(876): n is a, c, g, or t
catttaatntcgtggtaataaaaaacaaataacaaacctgtctttctcaggaatcgcttcaactttattaaaaagtggaagaacaatacacaatcgatttaaatttccgctaaatttaaatgctcagactgtttccggtgttgtccaaggcacaaaggctgccgaagaaataataaacagtgatttttttgtgattgatgaagctcctatgacaccacgatttgcacttgacgctattgataaaaaattacgtgaattaactaaatgtaacctattatttggtggaaaaactattattcttgctggtgattttagacagaccttaccaataaaaaaatttgcagtaagaagtgaaattgttgatctaacaatcaaaaaatctgttttatggaacaattttgagcaattgaaattaactataaatatccgagccaaggacataatatttgcaaaacaaattcttgatataggcgatggagttagtccaaacagcttcattcaattacctccggagtgtattttatcaaatgaatctgatttaatcgatgaagtttacggtgacatttttttaaagcataattttaatgaattaaaaaatcatataattctaaccccatacaacgatttgaccgataattataatgaaatagctttggataagttcccaggaaaatgcgttacttatcttagtattgatgaagttgaaacaagcaataattttccaattacaccagaaataatgaactctttcaattctcccggttttccattgcatgaattaaaattaaaacaaaattgtaaagtaatgcttatgcgaaacataagtattgaaaatggtctttgtaatggtacaatgttgcaaagtattgaattannagatatatgttaaggtgtataattct

SEQ ID NO: 41683 - DNA, 898 bp, Heterodera glycines
taaagagagagagtcaattaaaagaggagggagagaaaagaagaaatgagatagagagagaaaggtgaagagaggaagagaagaaagaatagaagaaaaatggagatggggatagtaagagagagagagagggaatgaaaggcagagagagaaataagtagagagaaagaaaaagagggagtgatgagttacgaaagaaaaagagaggaattgaactgagagaaagaaagaaatagagatggagaaagaagagaagatggaggggggatatagtaagagagagagggagagagaaagaaagaaagaaagaaatcgagagagaggagagaaagacagagagtagagtgaatgaaagaataaaagaagtgagtgagtgattgagagagagtgggagagagagacaacgagagagaggagagttagaagagaagatggagaggaagtgagtaagagagagagagaaagaaagaaaaaagaggagtgagtgagtgattgagagagagagaaagaaaaagagggagtgatgaggtacgaaagaaaaaaagaggaattgaactgagagaaagaaagaaatagagatggagagagaagagaagatggagggggggggatatagtaagagagagagggagagagaaagaaagaaagaaatcgagagagaggagagaaagacagagagtagagtgaatgaaagaataaaagaagtgagtgagtgattgagagagagtgggagagagagacaacgagagagaggagagttagaagagaagatggagaggaagtgagtaagagagtgagagaaagaaagaaaaaagaggagtgagtgagtgattgagagagagagagaaagagaatgaaagagagtgtaagaaagatagggagagggagggagggagag

SEQ ID NO: 41684 - DNA, 1386 bp, Heterodera glycines
aatttatttaaaaaatttttttttgcatattttacgttccgttgtgatccatgatgaacagcaacagcagcaatttgttgtgcatgagcatcatcctcagcaaccgatggaggagcaacaatatgctgttgttgttgatgagccggaccattaccgtattgagcaacattttgacgagcccatgccagaggaatacggtgatggtggtactattgtacatcatgagcatgtcgttgaatgggaacagcaccgatccgacgaatcaccaccttctgatgcagtatctgcaccggctgcagaagaggccatgcaaaagagtggcaccacaacagtgactactgtaaccaccgtaaccgactcgtggagcagcagcaacggtagaggcgctgaagcagagacggagggggaggaggagaagcggctggcacatgcacagctggcagaacaacaacatgaggaagaagaagccgaacacaaagggggagcgggaggtactgcttcaacaaatggtggccatggtcgtgccgacgaagttggcacaccggtgccaacggaggaggaccaccatggtcatgatgatggacattggcacgagcaagccgaagaccgccgggactagtctcgaaacggctggcactttgtgtgccgtcgtcggacatccatgccaccaaaaaaaaaaacgccgtgccgacgtcgtcgctttagcttatgtttaaataaataataattaatttttattattttctttttttgcacagcccccaattatgcgcatatgcatttatatatacaacaacacatactccacacacaatgttatgtttctttctttttagtataggtgtatttcctttttttctctgctatacacacacacacactctgctgctgctactgctctctcttccgttacatttttttttctttgcctgtctgagcccttacgctattttcttagtttctctctctttctttctttctgagcaccccttgccgaaaaatccgtccatttaaaaaatttattttatttttattttttcatttttgaggggcaaatttatgaaaattagcgaaaaaaaattcgatttttgcgaaaattctgctcagaaacaaacaaaaaaatattgctttacgtttttttaaagttttgtaatgcttacgcaaaaccccaatgcttttttcgtttaattttttttttaatatttatttaattttaaattatttattttttaatttgccccctcaaaaatttagaaaaatttccttcacgcacacttcctgaacattgaatattcaaaaatgaatgtaccaatgtgcaattttggcacaatacaccaattttgttgttcgctctgtccgtccacacagatgttttttgcgtaagta

SEQ ID NO: 41685 - DNA, 447 bp, Heterodera glycines
  misc_feature (436)..(436): n is a, c, g, or t
tttgctctctttgtggtcttttggtcttttcgcttgtctgtttgtctgttttcggtttgtcttcctttgttttccgtctcttttttcttgtccgttgcccttctctgtccggtggtgcctttgtgtcctttccgtttgtttttcgcttccttttgcgttttggcgttcccctcgtcgtcggtggctccttgctgtttgtcctttgtctttcggcctcctttttcgtctccctgcgcttgcgcctcgctggtctttcgtttggcgctcctttcgcgttcgtggctgccttttcggttgtgttttccccgttcttttctcctctctttcgctttgaattgtgccgttaaaattctgcccgttttcgtccgcttcttctgcttctggttgtgcttctttttcttcttcctcgcgtcttccgtaaggggtttccccgcgntggcttgccgt

SEQ ID NO: 41686 - DNA, 1056 bp, Heterodera glycines
aaaatccatttagaaaaattaaaaaaataatttgtccaaagttaaatgccgaagtaaaaatcatttaatattatagaaatttaatgaaaaataatatattaaaatttgaaaaaaaattatactttcgaaaataattaaacaaggaagctaaaatgaatttaaaaaggaattaattaccaaaaatataaaaaaacgaagaattagaaattaaataattttcaaaaaatgtaaaaaaaaaacatgattaatttaattgattatttatttattaataaatatatttaaaaaatcaccaatttaatcaagtgtccatttaaagtcctggttcgaatttcaacagtgaaattggcaattttgacattctgcttgaattgatggattgtgtatcgaagcgaactgcttgcaaacaaactacaataaaaatgatttaaataaaatttaaaaatctaaaatttattaacgaatcgcttaaaattattaattttttgatggggggggggggaagtcggcgctgaaatttttcttaggcccatttcagcaccattaagccatctgagctccatgtgatatataatttaaaaaattgtcatattttttaatttatttaaggtgggagggggtcaaaaaatcgtaaatcggcgctgaaatgtatgcagagagaaatttcagcgccacagtgccaattgagcgccgtgaatattcagaacaaaattaagacattcaaaaagaattaatatacatataaagatttaattttttggacctggcagtggacgcacacacaaaagcgccgtccaaattttggcattcggtgccctcagggcaaagtgccgttgtttttgcggcggtgccattgtcacccaatgaattgccgcaaaaatcacgctgctcacatagaagacccttcaaaaaaaattgttgtaattttagcctggtcttcgaatagagtttttgatgatcaaattttaaaaattttatcctaagttagccattataacctgaatggatggcatccatgaaaagttttttttggggggattctgatcattttaacaa

SEQ ID NO: 41687 - DNA, 1694 bp, Heterodera glycines
gacgcagtcgccaaattgattatgtccgaaaatcctgagaacattcgaattggtaaggacgaataaattttgagacattagtaatttaatcaatgtttggctccactacagtttacttgtcaaattagcttttacacttccatttacttcagattttgacaacgatcgtacgaagtcaatcggcacgccgtttaaggtcaaaccaaagctttcctacactccttacagaggctccttcaaatacgtggacacaacgaaggcactgactttgtttgattcatttatttgttcatttcattttgcaatttcagatgtcaaaccgcgaatttgcgatttatcagcaaaagaaggaggaggaaaagaagcaagtgctgaacgaacagagcgaacgatgtgcgagtgtcaacagaagcttcttctaaatttgtagcaaacgtttggactgtccgattgatgcgtttcgtttggttcggatgtttatttgtatttgactgtagcatcttctgacctatttatgtatcctggtaatttttttttccattgctatcaccgatcatcaaaatcttctatcgacctgattgaattgaattgtcattggcagttcgttcaatacaaattttacaaaataaagcataagcttatgcctaaaaccaagaaagcttaagattagtctaagcctttgtacgaactgtcacgacagcgatttgtaaatccgtatttcagccgttcgtttttatgtaacatttacgttgattccgccaaatattgtccaaacatttttccgttcttttcaaaaaaggaaattcattgctttgttcagtttcgggtcgcccattgtcatttcctttgtcatattaagccaaagaatccctctgttttctgtcacattcagtcgtccgtccctcccttttagccaaaatattcattaattgtctatttatcggttgcgcagtctccccaatttgtgtgtagtattttcttttgccatttttgaattatataaggaccagaaaacgtcgttcgcacaacaaattcaccggcatgggagtgccgtgcccgggggggggggaagaccgccactcacccgtaaacagcctgggacattccgcgaaatgatggatggctgcagcagatggacttttgcggtgccctcactcaaagtgttctgctgaattatgtcatccatccgtcggcactcatttgggtgcccattcactccctaataatgggcggaagacgggcctatcaatggccatcatttaatttgaacagggaaaacaatacagggatttccttcttcgttgagtccatttgtttcaattcacttttgggtgatgtttttcccttccaattggtcctaatgggctttcatcattattagcaaatgcgcggcatcctttgccattcgccgtctctcccgaggagcggcggaattgtcgcgcgtttgctgctgggcggactgatcattgaccacctgcttttccaactcatcctcaccacttctgtcgatgcccatcctccgtttgattccgacttcgaaagggatttgttgcaccgattgttaatgatggacagaaatgccggcggacgacgactgttcggcgcctatgtgagaaatcagcctaaggaaaacccaaattggggacaaccgccgcgtctcccgccgttcccttcgctggcggccgaagagaacg

SEQ ID NO: 41688 - DNA, 569 bp, Heterodera glycines
catatactcacccatttgtgcgaatgttggtccctgtactggaggttgtagccaagaattttggacccgccgttggatgccggcggctcccactccaattcggcccatgttcggtcaaagtcgcgcaccacgggcttgtcaggctggcttggtaccgagaattggtacttggccacaatcggctcgggcagttccagcgggtcggacagcccgtactgattctcggccaagactcggaatttatagcgttcattctccaccaagccggatacctgttttatacaaaattattaaaaaaaacgatagacaaaaatttttctacattgtgaaatacaggcattttacgttgatacactttttcacaaattattcaacaaaaaaaaaactccaaagtttgtcgtgaagcggactcgaacatccgccgtttgtcccttgctatcttacaaaaaccactttgccatacattcacaaatcgtttttgaactgagggcccaaattgaaacaatttgaaaatcgcgcaccaaagtgttcgtgttgcgcacgaatgagctgagtcgctcccagttttc

SEQ ID NO: 41689 - DNA, 885 bp, Heterodera glycines
tcaatcacatcgtctacctcatccacgagtagtagctcgacaccatatggctctacaagtactccgaccactttttcaatttcaacctcaactaccacgaccctggagccatttacactttttatacctccacatatatgcccgccagaagaagatgagaccacaacaagtccctcaacagtttcaacttcgtcatccagtacaacaatggttattcaaaaatgcatttataatttacttacctaaatgattttttaagtcatacgattcgcttgagcacaagtacagagtgttgcgaaaagaatattatcaactgaagataaacatgatcaagctggagatacagtatatgcagttgaaacggatgtgtgaccgtcacatgaacaattgtccttgtcccgaaacgacaaccaccacgacaacaccaatgacgacaaccacaatgtccaccaccacaactgagcaatgtgaaccagcacagccgtgccaagatgacagcccgatgatttgtgcacattatgccaaactgaatcagtgcaacaaacctggcgtatgtgtgctcataaaaagggtgttcctccccgatccgattcggggaaaaattgcgaatttcgtaacggttgacactccaaatcggatgttttgattttaaattaatgaccgagccgggcccggtaccgggtttttaccaggctccgaaaaacaggcccgccgatttttggaaaaacacggtttgaccggtgttggaggcacgacccaagaaacccgagttgtttttgaagatgtcagcccagcctgggcatttttaatttatcggttaaaccccatttagtatacaatgaaattttgtaataaacgggtgccaattttataaattttccaatt

SEQ ID NO: 41690 - DNA, 829 bp, Heterodera glycines
  misc_feature (794)..(794): n is a, c, g, or t
tttgtgggtgatatgttaatagaaaaagctatagatattactttttgtgggtgatatgctaatgagaaaaagcaaatttgctctgagatattaaaaaaggcataacaataaaattttgctattccaattatgtatccaaagagtcagaaaatgggtaaattacaatttatttggacttattattgccattaaaaaccctagaaaattatttttgaattttctggaattttattaaactgttttgaaatattccttaatttttgtgggtgatatgttaattagaaaaagctatagatattactttttgtgggtgatatgctaatgagaaaaagcaaatttgctctttgagatattaaaaaaggcataacaataaaattttgctattccaattatgtatccagagtcagaaaatgggtaaattacaatttatttggacttattattgccattaaaaaccactagaaaattatttttgaattttctggaattttattaaactgttctgaaatattcccgaatttttgtgggtgatatgataattagaaaaagctatagatattactttttgtgggtgatatgctaatgagaaaaagcaaatttggtccttgagatattaaaaaggcataacaataaaattttgctattccaattatgtattcaaagagtcagaaaatgggttaattacaatatatttcgacttattattgccattaaaaaccctagaaaattatttttgaattttctggaattttattaaactgttttgaaatattcccgaatttttgtgggtgatnatgtaaatagaaaaaagctatagatattacttttt

SEQ ID NO: 41691 - DNA, 843 bp, Heterodera glycines
aaaaaatcgattttttcaagtgtccgtttggggtactcaaacaattatgggagccaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaaagttaggcctaaactttttggccggtttaaaagggaattaaaaatttttaaaaatt

SEQ ID NO: 41692 - DNA, 1342 bp, Heterodera glycines
  misc_feature (66)..(66): n is a, c, g, or t
aaatgaggtttatgaaaataattgaatgaaaaaagataaagcgataaattttggtggagtgtactnttaggggaattttaaaaaggaaataaagcaactacgccaccactgcacgaaatccccctctttttggctgattaaaatcccgaaatttcatggtcacttgtgggccgctcatttgtcagggctacaccaaatgataccaagaatggttaattaattgcttttcaaaggaagatttatgatactaagaaaggtcaatcaatgcgcaccaaaatatgagtgcggattatttaatggaaaaattataataaaataaatattatcaaaatttggccaacaaatcatggtctattgcacattatgagtccaaacgcattttatgagttttttacacaaatttttggtttttttattaatgccaaaaatatgaatgtaaaataatggaactatgtatagacaaaaacaaaaaatatgaaaaatagggaataaaaagacaccctagaagcaacaaatcaagctaaaatactatttacgtgatttttcggccgaaataagtataaaatatggaaatccatataaatccggccctagttattaaattggcgtaaaaaacaaaacgccaatacactcaaatgaaatacaaagtatatttaatctgatcaaattcataatcagagctcaaagcttccaattcacttcaaataaattaattagatgttttttaggataatagaaatagtagattaaatttacaacatttacgaaagtttcagtgccttattttcgttatttagttttggtcacatttgatcagccataactcacttcatttccaactaaatcgaataattttttattattcgaaagatattaaaaagaagaatctttttctaagcgaaggctaagaaatttgactcttgaaataattactgctagccgagcttttgtgcagaacaaaaaagtcacttaaacaagttaatcagatcactcattcatgggggtctgaaaagcccaaaatgacttgaaattaggaaaattcataaattttgggaaaaaatttctagtgggctgaaaaaatatcctggtaaaaacaatctgctcattaaagcacaaaattccctacaaaatagcttttgaatgatgttctttgttgagtctccgcaatttttggggcatcggaattccgacttccgacttccgaaaatttttggggcatcggaattccgacttccgaaaatttttggggcatcggaattccgacttccgacttccgaaaatttttggggcatcggaattccgacttccgaaaatttttagtgcctcggaactcccatccctg

SEQ ID NO: 41693 - DNA, 1503 bp, Heterodera glycines
  misc_feature (1382)..(1383): n is a, c, g, or t
  misc_feature (1423)..(1423): n is a, c, g, or t
  misc_feature (1464)..(1464): n is a, c, g, or t
  misc_feature (1482)..(1483): n is a, c, g, or t
attcccgtcattttcggcaccgccgaaaccatttccgtgatcactcagaccgagtcgtgcacaaggagtcactcgggactcacctgcagcatcaacgcggccaccacactcactctattaccggcaggccaaataagctccctgatcctccgtgatcacatcggcaatacaattggtaccgtccaaatgcacctccgttcccttgatttggtttgccatcggcgatcagaggcgtggctccgctcttaccacatcgaggtcttatccgttaagcggtgcccaagggccggctcatgtcgtgaagaccactgtggcctaacccgccctcaaacgttggtccccgaactccaatccgtccaacgattccccggcaacaccttctgccaggactcgaccagtttttggggcaacgactgcggactcccggccaccgcatgtctctattatcggtacttcgctcgaccaaccagcgcgcgcccattcgagctgatcagctgtccatcatggggggtacaaatcgacatgcacctcgaagtcgagtcttcgggcggtcaaactcggcaaatggacctaactctccacccgggcataaccacccaatgggggaacctgtccattacccctctcgctgtttctctacccccgctcccgactctcggttcgaaattcataaccgacggccgttcggcggcaatcatcgaccatcaccccaccgatcttcagtgttcaaacgaagaagcggctgtctacttcaattgctcgttatcccttgaggcttgccaggaatgcttcccggaccatacagcaggaaaggttgaatgtcattgtcgggacctcgacctcgacgcattgttagaaaatccggagtcccggctacccatcaccaccgccaaagtccgacttcgcaatcatggccccgctatattggccacgcacgcctattcgccgacccaacttcacatcgtcatgaaaaacgtctcgctgctcctacgtctcgcccagtcattttgtagagttgaagagcctagactagtcggttgctatagttgttctacaggggctcaattcgactatgtgtgccattccgacctcgaaacagccttagccacagtcgtctgtaatgacggccaactctttgtcatccactgcgcaccaaacgggacggcagggaggcacatcctaccatttgaccgctctgaagtcgcaacggaatgccaagtgcgttgtccggggggtaagagcaaattttggctgaatggcaccctgcggtacatccctcgtcaacgacggtttgggcaccagcaaagaatatctgaaaccctcccgtctaatcccgaaaccttcaacctttggtcaggatttgagattgacttattctctcnncctcaactcctcggcaaaggtcccgccatcctattgcttntcaccattcttgctgtcggcctcgtcgccctttacttattncgtcaatattctccattnnttcacacataccgacttatc

SEQ ID NO: 41694 - DNA, 1033 bp, Heterodera glycines
agcaggtaggtggtgaataggaatcacttgggtaatgatccagcagcaggctcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatcttgctcgcgttccatcctttgtctttggtttttgattcgggaagtcattattagcgaaagctctagcggtattccgttctcctggaatcctataatgatcatggtccaaagcagcgatcggccggggtaaggaaaacaacgaaagacacaaaaaagggatgattaagataatcaccccattgataatggaaaaaatctttaatttaa

SEQ ID NO: 41695 - DNA, 1772 bp, Heterodera glycines
ttttgctccccataaatttttgagtacccaaacggccacttgaaaaaatcgattttttgtttcataaatattttttagaaagtcatgcgcacccgtccgatctggcaagttaagcaacgattgctgactagccaaaaggttcgggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtctccccgaaccgatgcgcccagatttatggggagaccgaatccttccggaatagcttccctatagcctgtactttaattctgcgttggatttttgctccccataattgtttgagtaccccaaacggacactcacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtacccaaacggacacttgaaaaaatcgatttttttgtttcataaatatttttt

SEQ ID NO: 41696 - DNA, 780 bp, Heterodera glycines
atatatgaaaaatgaataaatttttttgcgttttcgtccctgaaatttgttgtcccactgaaaacggcctatcataagcttcagctatcgctttcatatgaacattatcatcagcatgagcaacagcagagcatgattgtggtgatgatgctgggactaacgcgtgcaatcgcacatgtttgcccagtcgccgaccgtccgcaaatgaaacgccacactttgcgcactgtgcaaaaatggtacaaacattatgccaaaattccatgtaaaagcaaaattggtggcccttggatttttggtggcttgagggatgaatatttttatgagtattcgaaaattaatgccataatgatacacacataacaaccataaaacaggtgcactaccagtttcgtttcccacctcccccgaaattttttaaacaaatttatataagaaaattccaggaaaaagttaaaccaaaattttgaatttttcttttaaaaaaatttttgaaacaaaaaaaatcggagggaggggaaatggaggggcgaaaaagggagggggggggggaatcctattaccaaataccaaaggtttttttgccaaaaaatcaggtcaataatgcatccatccgttcaccatgtaaggtctgtcgtcggaatggtgcgttcggttgtgccctcgaaactctgacacatatgcaaagctcttgacacattcgacgcactgtaatgcaaataataaaatgcactagtgttaattagaaattttattgagtgttcacaacaaccgataaaa

SEQ ID NO: 41697 - DNA, 938 bp, Heterodera glycines
aagaattattgaaatagagtgctatcaaattttgcttctccacaaaaacacaaagcatttactaaggaaaagtggcccaactaattatatggcctattttaaccatgaatcagatctacattaaaattcttggctataattcgcatgtccaaaaaatgtttgattttattcggagccagttatggaataaattaaaagcagttgttactaaatattgaatggaaacattgttttttattgcgagcagctgtattggatttggctaaaaacctatagcagctgatggcattacgtccccattgtaagaggggtgaagaaaattcagcccgcgcacttcctcgctcccgccgtgttaatgttggtcgagaacccatggtctttgcccctctcatcttacgaatcaatgccggagcccttttcgttgccattggaaaattttcacaattcttgtccattttgcatttttgcgctaattttttatgaaaattaaagatttttaggtgtgggggtgccggcaggggcgcggccgggtttttggctcaatttgtaaatgcttttcacctaaaaagatcaaagtgaatttttagtcttggttttaaaaagcaaagaaaaatttaatttctattaattaaacatatagtagtaaatatcaaataataggttgtaattttcgaaatatttacaaaattaagagtgacaataatttttttttttcaataaaatttaattaatttctccaattctccaaataattatttttctctcaaacccctcccccattcttaccaatgcataaaaatttgggcgctactgtaaaagttgttggttttgaaacaaaaggggggacccttttgttttgcaaaatttttttaagataaaaaaccatgataattttttatccggggttttaaggtcgctaatcacgaatctgacatgta

SEQ ID NO: 41698 - DNA, 876 bp, Heterodera glycines
gggacatcggatgcaaattgggcgggatattctccaacagttgggccacatgggctggcagatcggcacgcgatgcccattccttgctgatcgcgttcacttgtttctgcaatgagatgtgggtgggggattactctcattgtcagagacaaagtcaatgctaaaactccaggatttatgccgcatttttgcatgcatgtttaaacggtttttgagcgctcctatatagcataagagcatattttagtgctagttagaaaaaaggaatggcattttggtttttaaaagtttggagcaaaccgaaaatggtccgtcttttttgggagcaaatccaaaatggtctgtcctgttttttatggttttctagctaaagatatgtgccggatttgtagctaataacatgaattgttttctttttgaccgcggaatataacccacgtaaaacaatgcaaaaaatagtgagatgtcgtaattcagaaaagtttcccagcttgacaaacctggtcaggaatttcaccggtgcacaacaaccaccaaatgccttcgggcaatggctcttcaccaccctctgcctttggcaacttctgttggcactccgggattgagtagccacggaagcgaatgccctcttccgggtccaacaccgaagtttcagtgaccatgcccttcatggaacgcattccgccgtaaatctgagggtgaaaaaaggaaattttaatgaatcgaaatcggaaaaataggttttttagaattataatgaaatggaaacattgaataaattggcgctagtctaaaagtggccgtttttgaaacaacagggaggacccttttgttttgcaaaatttttttaagataaaaaaccatgataatttttta

SEQ ID NO: 41699 - DNA, 1217 bp, Heterodera glycines
  misc_feature (135)..(135): n is a, c, g, or t
aaattcgctcccttttattggcaaaaaattctttttttcaaaaaaaattttttcggaaactggccaagacacagttaaaaagtgtaatgaaaacttgcataaaacgcattaataacttgaaataaacaaaatctntaaaatttcatgcttggcccgattttcatttacgccaaaattcgattagaaatgagaaaatgcaaacaaaatttttctggctattcacctgcctcaacccctgtcgaattttttaaatttattgttttggtctggccaatttcttgcctgctaaatatggcgagttttcatttgtattttcactttctaagaccatatttgaaagtgccagaaacaaaaaattaacaaaaaggggtgggggagaggtaaaatttgaactattaaaaaaaaacattttaaaaatccaaaaaattttcctgcccgcgcctaaaaatccttatttgtcttgcaaagatttgcccaaatcgcaaaatttgttcatttttggataaaaaatgtttaaacaaattcatttaaaatcacaatttttcccatggcgcgtgtccgcaccaccggactccctcttgtcgcccagtattttttttttttgaaaaagtgggctgcaaaaaaagtcggcgttcaattttttggggggagtttttttttttttgctacaaatataaaaatgtggaaatttacctcccttttttgatctcaaaagtcttaagttttgttttgtgccttttctcaggaggttggcgacgtggacaactgggcacgagcaattgaggccgatgtgacacaatgtgccgccactttggaacgcgtttatcggacccggggcggcgctgggcatggaccggcggtgggcgtgggaggtaaaaataattggattggaaaatttttattagacaaatacatatgatcgccaaaattcaacccacctgaaactttaaaaaaaaaaaatttcctttcgagttttttctcgttaaaataaatttaacgagtcgattcaaatgttttttatttaaaaaaaacaattataattacaaaaatttagaaacaaaatttttttttcagtttccttcaaatcagtgagcaaaaatttttttttggttttaaacctagaattttcaccaaatcttgccttaaaaagaagagtgccctggaacccctttcaagatgcctttaagtgaatttttttttgaaaatttaatttcttt

SEQ ID NO: 41700 - DNA, 1568 bp, Heterodera glycines
  misc_feature (49)..(49): n is a, c, g, or t
  misc_feature (212)..(212): n is a, c, g, or t
gagaaataattcaaaaatattataaaataacgagaaataaagggagaanggaaagaatatttacaaaaagaatgggttaaaatagaaataaaaatgcaaaaaaattggggacaaatcgccaatatatttataaatggattaaagaattagaacttaatcaacgaatacagaaaagctataaatcaacagagtttgccaattaggatcttttntaaggaattagattcatactctactgatcatcaaaattgtaatgaaagtagggaataaaaaaataaatattttctggtcagtagggataaaaatggttatttaaccgtggaatactttagtttttatttcattataatctttttaaaattaattgagagatggatgaaacaatttggcattagccgtaaagaataacggaggaagaaaaaatggaaaaaatgaaaatttattggcaaacgaaaaaagaaaatccaaaagtgagtgacaaaaaaattgcgaaaattatgaaaattagtcgaaatagcattttcaattggaagaaacaatttggagaagaagtgcttcagagaacagcagaagaagaagaatgaattgtttaaaatgttatttttggtgttttttttctttattaattatgctaaattataaatttcattatttttttcaatttcttcaaatgccgaaattgtaagaaaattggagttagtcgcttagttaatgaaaaatggatgaactaatttggcattcacatacacggatttttcaaaatttatagtcattcagtgaattggttatctattttttgaaacttttgaatttaattgctttatttgactcggctaattgatttatacaattgaaaaatggggtacaaatgtttagaaaaatattaaaaaatagctgacatttttaaattagtataacgaccattttcataggaaaaaacatttgaaaaagaaataataacggaggggtgaaatcggaacagcttctaaaataaataggaaaaattaattgacttatttttaatgtttggtttcttataattttaaagatatagaaatattttttttagaaaaaaaaagtgaaaaacaacattaaattttctcatttttcaaattagaataaataattctcgacaaacttctgttccattatgctcattaattatttttctaaattatcggcttatcagtgactaatattgtggctaatttattgatccaaagtcgaattaaagcagcatttgtttggtggcgttaggcatcgataagaagaaaattaagtttgacttaattatgcatttattttttaattttaacacgccaccggtgctgcttaatagaaatgacctgaaaaattgcgaaaatacagccctacgaattgaaaattcccgaacaaatttattttggaggatttttcttttttaaaaagcgtttcataaacttcaatttaaaaaaatttcagctctcaatttattattttgaaaattagcacatttttcaaattataataattaattctcgaccaagaaagttccactatttcaataattatttttctaaagttatcgg

SEQ ID NO: 41701 - DNA, 1232 bp, Heterodera glycines
ctttaagcatacattttttaactgaaaaatgagaatttaaaataaggactgccatctaatttttgaatttacacatttgctaaaagagaaattactggcaataattttaatcgaaaaatttggagtgacttactgcgaatttcccgattaattattgcagttaattaataacggtaataattttcaaagtatgacaaattcaaaatatatttccaatacataaactagaaagcataaatgtaacgaataaataaataaatacatttgtccttgtcaataccaattaatttaatctttcgtcgccaactctcatcactcacttttcgttttgtgtataaaaagggagacaaataaataacatcatccagtttttattgcaaaattttctgctcactaaatgcaataattgatttaatttacgaaaagattagctaaaataatgcaacttttgtgagcatagaaattagagtgccacgggaccgggaattttgggcaaacccgggaccttttcgggttgaaaaaccgggaatttttggctgggaaacccaggaaaaaaccgggactagtcccggtgccggtcaaaaccgggaccttggtactcagttgtactcagttgtccgctaccaggtcccggtcccgtggcactctaatagaaatacataaaattttttagccaatgttttcatattttaatgaaataaacaagaggaattttcaattttcttgcaaacactttttgaaaatattatctctaattttcatcaattttgacatttactcggaattcccgaaaattctattcacgcatttttgagtgtttctaagcatcgatcactttataaatttgttggattagccatattattacagcttttaatacgcccgtcaaaaaatggtccactacaaattgtattattttgatctcactgctcgtggtgagccaatccgatatttgctgcactacgctggccaaccctttgaggacattcgcattaaagccgaagattggcaaacagaaaagccaagtgaatgttgagaagcgggcggcggggggcggctaaacgggtctattaagtggtcactgctgatcagtcatctcccattcttaagccgactgactcgaggaaattaagttcgagtgattatagttgattacctagatcaagaaaaacttaaaaaatcgctacagaagcccaaatttggatatgagaattcgtgatgctgagttgatg

SEQ ID NO: 41702 - DNA, 865 bp, Heterodera glycines
gaaaaaactattcgctttgatcttccgctttacgctccgcgcacaagatggtaattaccatttgcatcaacattaaactctctaccattgggttggatgtaatacaccagtgtatcattggcatcatagcaaaagcgattaggatttttttgactactgtaactgagcaaaccgttctcatgacgcttataaaaccgtgctccttgggctaagtctgagaagtcaatgacagtattatattcataagtttcgcgcaataactgtacggtagcggtgcccaacaactgaaaatggaaagtgagtacaattaccggactaaataaactttaaggattataaaattattccaataaaataataagcataataaaagttttttcaagaaagaaaatattaaattctgaatttttgataaaattttccaattgttaggagtgtattttttgaaattttcgactcgattcttaaggtgtattttgattttattgtatttctgtatccgaaaatccttaaaatcggtaacacaaattctgaaatagccataaaaataggtaaaaaaaattttacaaacaattttctggcagttaaaaagcaaacaaaaaggttaaattttggattattgctgtgtaaacgaataatttaaatatttatgagtttttcttagaaacattgacatcttaccaaaaaaaaaaaaaatttttaaaaattaaattaaaaattttgtcaagaaaaaataaataaatttgggagaggaatttttgagaaagttttccaattcttgggggggggatatttttcggatcaatttttaggggtgattttttgattttattacattttgtttaagaattatctgaattaagtg

SEQ ID NO: 41703 - DNA, 1433 bp, Heterodera glycines
aaataaattaagcgatttcctgaaactgtaattgattttaaaaatgttaaaaaaagaattaagaggcccccggcattccgataggaaacgtgggacaaatttttgaaaacacaggtcgaatttcaggcgatggtaaagaattggggtctctaatttgttttatattttaggcgcaaatcagttttagagggtactgatgacgaatctgaattcgtacatattttgtctaattcctaactccggatccgaatttaatagatatattttaaatataagtaaacttaatataaattatcatcgcctttctttcaaaaggtaaattcatcatcatcataagtagggatgctaattttatgtaacaaaattgcgaaatatgtaaataaaatatgtataaaaaatgctaaaatatgtatgaaatatgtacaaaaacccccaaatatgtactaaaatatgtaaataaaatttttttaatggttattttttgaaaaaaattcttcgtaaaaagtgaaataggcacaaaatgccataaaaatgaccaaaataggcttagaattagagaccggaaatttcaaatttgcggatcctgttgcaggattggaattcaaaattttttacaggacaggatccggcaggattaatcctgcaaatcctgcaatcctgcatgtaaaatctgcaggatcctgcgcaggattgcggattttaggaaatttcaaaaaattctgtattaataaaaaagtctttcaaagtataaaaaagtattcaaatatattttgaaaccaaaaaatgatgaagatgaaaaattaataacgtttttttgcttacactccaagcaatcgactgaatcttctttaatgcgtttaaaaagaccgatttgccaaattgggtggctcataataatagcttaaattaaagtaaaataatttttatttaaatttctttgcaaaaaagccataatccattatgtatagggatgggatttttaggcacaaaaaatcgcgaaataggcacttaaaaaggcagaaaaatcctaaaataggcacaaaatagtaaaaaaaaaaaaaaaatattaacgctttttaggtagcaaaacacataaaaaattcaattgtataaactttttcgaataaggataagtttttaaacgaaaaacttttattaagaaaaaaatttttgaaaaaagaaagtttctgaatatttggcattctatttttaaaaattttcaaaaaatcaatgcaggatcctgctgaatcctgcataaaaatcaaatttgcgggtcctgttgcaggattggaattcaaaattttttacaggaccggcccggccggattaatcctgcaaatcctgtaaatcctgtattttccaaaatatgcaggattgcggactgggatcctgcaaaatcctgcgcaggatcctgtcctgcgccggtctctagt

SEQ ID NO: 41704 - DNA, 539 bp, Heterodera glycines
aattccgacttccgacttccgagttccgacttccgattttttgggtcggaattccgacttccgaaaatttttgggtcatcggaattccgacttccgacttccgaaaatttttagtgcctcggaactccatccctgatacacacacaccccatgtgtgtaatttttacacatttttgagtaattccttcatttaatcattatttttcttaatttttgttaaattgtatcttctattccttaataatttacaaattgtgttacaaaaccctgactatttttctcgttaaatacctttttaatttattccttttaatattagtaatgacacattttttcaattttatttctgaataaacattcaaatgaaaaatacaagtgtaaaatagagaataaaggaaattataaaaagaaagtatgcaactcttttgatagatttgaaggcatatcagaattcttagagttccctttgaaaaaagtgaaaaaacacacacagggaacggcttcacccttcggtccccaatccatgctgtcacgcacca

SEQ ID NO: 41705 - DNA, 1162 bp, Heterodera glycines
ccaaaaagtttaggcttaactttttttatataaccttttcagaagcgcaccagattttgcaagggcatcaaaaagacaaggaaaagcaccgctatgatgctaacgccagtaactctttatttaaaaatttttattaatttttaaaacttcactattttatttttttaatagatttttaaatgtttggattttttttggcttaccaaaacttcatcgaacctggttctttctattctctttctaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtaatgtgcgcgatacgtatccctgcaaaatttggtgagcccctga

SEQ ID NO: 41706 - DNA, 1117 bp, Heterodera glycines
gcttcaacggttctcagtgtaaatatagactgcccattcaaattctgcctttccagccttatggaaagatattatggaacttttggttccatctcagttgtcaacaccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcatctctcttgcgtcccttaatcttcactctgagccgagttactgcggaaacagtttgattacgaccaaataaaaatttgaataataataacatacgagcgctaggcgccggctcggggggtttttcagataatttaaaataaattttgatagagttttattaataacgtttttcatccaaatctcatttctctcaactttgtctccttcctgtctctttctttttgtcaaattgataatatatgtaataataatctttttttggcacccccacaaagtgtccaagccacgaaatgtccaaaagagtaaaaacccacgaaatgtccaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgctttttttattttataaataaagaataagataaacagaaatcgtgctggcgcgtttgttaaaaactgccacccatgcgcgtttgttaaaatgccaatgggtttgaaaacaaaaaatgggtaaaataattaaattaatagcttggctaagattcaaccaaattaatatttcgtggta

SEQ ID NO: 41707 - DNA, 808 bp, Heterodera glycines
aaatttttcaaacttaattacataattataaaattttcaggtttgcaaaaatgtggatgactgcgtgtacgtgaatggcaaactcgaaaatgccgcttttggttgtgttgttgtgtgcccagaggcagttgggggcgttgttaatgcttgcggtggcatcaatttcataatcaactcgcagacctattgcgttacgaacacacaatgcccaatttagtcgcaaaaatttagaaaccatttaaaaataataaatataatatagtaaaattggaatgcttgatttgataaataaatatctacttttaataagtataaatttgaaaatttttatttattcaattattaaataaatacttagtaaaaattttcattctttcggtaaaatttgtccaataacaaaaaataatgtgtgggtttatcggaaggaaaatttgcctgcgtttccaaataaatagtttctcaatttagttgcaaaaaggcaattaattaaaaaaacccattatctataatcgtcaattccttaattataattttaaaaatcaattaaaatttttcttgtctctctgtgccgtggtgggaatgttaaatgctctgctgttcgctaaaagcccataaccttatgaatgtaaagtggaaaaataatattctgttttgctgaatcaaaatttaatgaaaatgaatcggataatttgctatgattcagtgcaaaaaaagatgagaagattttaaattaaaaatgaataaataaatggaataaaaatattgaataatagaagaatcatttaagtaatttttttttaatttacta

SEQ ID NO: 41708 - DNA, 837 bp, Heterodera glycines
  misc_feature (741)..(741): n is a, c, g, or t
  misc_feature (795)..(795): n is a, c, g, or t
  misc_feature (820)..(820): n is a, c, g, or t
ttaaggtacttggactttccacagaaaatgtggtacaaattttggaactgtcccgcctcacggtgggacttaaaagcagggtaaagccaagttaaaaacttcagaggagaattaattgttttgaatttttacatttaatttcttagagtcaaaagattcgagacagaagcataatttaaaatcaaaaataattctattaaattttttacattttagtttcaaagaaacaaacaaaaaaatgttcccaattttgaaaatgaaatagtgcacaaaaagggagggatgtttagacgaaaagagaaatttttaggaaggtacgcaccccatctgatattcacccttttctgttccataagaggccagaggcgactgtgttggttgacaagtaattgtccaattaaggtgcttggacattccacagtaaaatgtggtacaaattttggaactttccgcctcacggttggacttaaaaacatggtaaagccaagtgaaaaacttcagagaattatttgttatagtttaatttcttagagtcaaaaaatttcggaaccaatttttaaaacgaaacagtgcacaaaaagagagggggggggtagaagacgagagtaattttttgaaaggatcgcaccccatcgaatatttccttatttctttttaataactgtccaaaggtgactgcgtcattgactcttctgtagtccttaaggtacttggactttccacagaaaatgtggtacaaantttggaaatgtcccgcctcacggtgggacttaaaagcaggtaaagccaagttcnaaacttcagaggggaatttttagtnttgaattttacaattta

SEQ ID NO: 41709 - DNA, 925 bp, Heterodera glycines
tttgcacttttccttcccatcatttccaaatgactcccaaaatgcccttttcctctcttttctctccctttttcttttcctcttcctttttgtcctcctcctcttccttcttcctcttttcctcctctttttttctcgttttcctttccttttctgtcgctgtgttttccgcttgccaagtgatgaccaaaattgagaaagtgtacgcaatggtggacgaatatcagagaacttttgcgggcagtgaaagacaatttgagtgagttaaatgggcaaaaacattcattggattaaggcctaattaattagtccattttggtaaatccaattcaaaccccccgcccccccccccccccctctttttgttacccctcactttctctcgttttcccttcgccgctctctcagcgtggccatcgcctcactgcgacctcaacgccgccggagaatcgcttcaaggcccggaagccaagttggacaaaattggaacaatgagttgtgccaatgtgatcaatcccgtgccgaccgttgtccgcccggaaagcccgggaaaagggggaaacggggcaaagacggaaagccgggtgagtgggcgaactgtgatgagattgtctatgctttttcccaggctctcccggacttagcggtgcccccggactccccggcaatcacccgcccgtccctttggacttcgaactccaatgccgcatttgtccgctgggcgaacccggtgaataatgtttctgaggtccaaccaatttggtgaacactttcaggcgagcggggaagagccggcgaaccgggcgaagatggaaggccgggtaaaagcaaaactacggaaaacagcggaaaaaaacacttttttaggggaaaatggcacaacgggcaaaacaggaaaagtaatggaggaaaaaggataaagcaa

SEQ ID NO: 41710 - DNA, 1028 bp, Heterodera glycines
atgacgagatcgtaggccataattttttttttttttacatatttttacaatgaaatgtgattaatggcactgccttcccactgtttaaacgtttcatgccaatattttaaatcaattgccaacattatttaagggcatcaccccaaaattgggcaagcaaatgcctcccctctatttaagcgtttcatgccaattttggcgcgtaatttaatttctcgcttttttatataattttttcgtggtaagcggatgtgacaaaattacatgtgtgggggggggggatatggccgaggaaaggtcatttcagtcggggaaaattatttgtataattaaatttaattatttttgttgtataatttatttttccatctgcttacaaatcagttatattaaattttaataattatcaaaacaactattagaagagtgatgaaaccgaaaaccatatttcatccattcagtctattgcaattttattttttttcaaattttatttttatattttccatttagtgcctgttttgagggtttttagggcctgcctatttattgaaagccatcagcgagggagggacaaaagttttctaattttcttaacaatcgctaatggaaaatccattttccgtagtgccagaatttccttatattcttaggcaaatattggacaaaatctgttcaatagccccagcaaaaaaaattaacttgacaaacataaagcaaatttttttactgggggttaaaaaggctttgaaatggcaattttgaaaaatgagattggaaaatgatgatattgccaggccatgatcagttctatttagtggctttttgttgttgttttttttttaaatatttatttaaattaacaagtaaagaaatttcggggagtgacgtaaaccaaaattagtgctttttgtcaatgaaaaaaaaatccaggactaatttttagggtaaattataaagttaaggcataacaaaaataaaaataatctttatgcaccgaagaaagaaagacaaattaaaataggaaa

SEQ ID NO: 41711 - DNA, 922 bp, Heterodera glycines
gctaattgagcagaagcgtaccaaactttgctgggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttattctgcggtggattttgctccccataatgttgagtaccccaacgacacttgaaaaatcgatttttt

SEQ ID NO: 41712 - DNA, 886 bp, Heterodera glycines
attttgaatttgtgccatttggcgttttgtttccaattcgcattccgtccctttcagcagttgcgccgtgactcttcgtccctccggcaacgctttccgtcgcccgcggcggtgtgccaccgcactttcttctccaatcagcccaccgggcagcactgttccggcaaagatgccgcctcttcgactgcgcgtctctgctgccaattgcgcttccgccccttccaaaatcggcacttcaccgccctgagattggaaaatgcggtcacttcggcactgattcaatactcacaatggaaatggaggggcaatggcaaagggaggagaaacgaaaaaggggcagagaatgggacggagagcgacagacagacgacggattgggaagagacggagagacggcgagtgcgcattcagttggacggcacgacgcacagcacagtcggcatttaggaccataaaagctaattgaggcaattctacccaaaacttccattttcagattcttgacgaagaattgggactgaaactgtccatgttgggactgaacggggcaaagtcggccggcgctcagttggacccgggggtttattttgtggagaatcattcggacggatcgctgggcgaaattacgggacaaattgcagtcaaccgaatcacagaacacgagtaaacgggtggactttggtaaatgaattttaattcaaattgaatcatttagctttcacaaattgggatgggttccgtttggacgaaaagggacggccatttgtgcaataacggcgaagtgttcctggacaaaatccatcacgcccgggcggacgattgtgccgagcagcgcttccgatcggtgctggacgcgagttactacgtgaacggagacaataatgtg

SEQ ID NO: 41713 - DNA, 1011 bp, Heterodera glycines
ggaatactttgaactaaaattaagaatacaaaaattcagtttacgcaatgttacgatattaaattattttttatattaaatgttttgtgaattgatagataatatgataaatatagtgtaaagaatttttaattttagttaatttattaatttatattttcatgtatcctgtttattgtagtggttgttatatgattacatgagatagtccattgattgtgcaacttaatgataattgtgttcaatatattatttaaaatatatttatttatttattctttttatttatctgtctctgtttgctaataaattttctttaaagttttttccatccatatatttcaacctaaatatttattttgtttaatgataaatactattatttttataaaaactttatcatattaatttattcttgtatgtgcatgttgtatggtaaatgaacatcggcctcgagaaaataaaaaggaaaaagaacgcaattaatttaaaaataatattatactaaatatgttttaatttttaaaaatttatttattttattattaaataaaattgttttatttttaactagttttttaatttatttttttcgtttaaatattcataacaattttcgcaaagaaaaatgctataattaatgaacgtaaatttcttttgataatcataaattcataaaatttattattacattcaaatattttgtaaatgcaggatattatttaaattggacgagaaaaaaattcagttgataatttttttttttagtatatttttgtttatttatcgggttttgtgcccttgaatttaatttcctttttcttatatatttatacaaattattctacatttaattagcggttaagttaatatatacatttttatattttattgttcaggtgttaaatacttttttaataaattaaattttatagatgaaattcaaaaaatatgtcattatgtcacttagatcttgtgattttatttaaattttattttttattatttgat

SEQ ID NO: 41714 - DNA, 872 bp, Heterodera glycines
  misc_feature (48)..(48): n is a, c, g, or t
  misc_feature (50)..(50): n is a, c, g, or t
  misc_feature (60)..(60): n is a, c, g, or t
  misc_feature (69)..(69): n is a, c, g, or t
aattgtgaattaattctcagaaaaatggctatctctttttaggacaantntctatctcgnaaccccgangctactctgttccacagagactcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccacagagactcttcaaaatttttccattaccgcaagaagtggggaaattgggaattaattctcaaaaaaatggctatctctttttaggacaattttctatctccgaaccccgatggtaatccggtccgcagaacctcttcaaaattttttccattacccgaaaaggtggggaaattgggaattaattctcagaaaaatggttatctctttttaagacaattttctatctcgtaaccccgatgctaatccgttccgcaaagccccttcaaaatttttttcattac

SEQ ID NO: 41715 - DNA, 919 bp, Heterodera glycines
  misc_feature (7)..(7): n is a, c, g, or t
tgtactntaattctgcgttgagtaatgctcgccataattgtatgagtacctcaaacggacacttgaaaaaatcgatttttttgttctcggggcagtcccgccgaaccgatgcgcccagatttatggggagaccgaatccttccggaatagcttccctatagcctgtactttaattctgcgttggattttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctcccccataaatgtttgagtacccctaaacggacacttgaaaaaatcgatttttttgtttcataaatatttt

SEQ ID NO: 41716 - DNA, 1283 bp, Heterodera glycines
ttgtcgcggcaccaacggacaacgacgccgcaacaccagcggaggcgactaacacacagtcttcccttcctcccgtggaacagccgccattttcctcccttccgcccacccacgcgaccgttgcggacgaccaacagcagcaacacccgcacccgaaacgcaactacgcatccaaagattgtggggcaaaggtagtccaaatgggtctttttaaattttgatttcacattttaattcttgtaattgtcatttaactgttgcaatttaaggtcttgtattggaatgctgaggccgaaaaccgcggtgccattctcaacgacccggaaagggacgattatatgcgcaacccatgcgaacgggcgcagaacaaatttctgatcattgaattgtgcgagactattcaggtacctaattaaatatgtctacaataataaaacaattaatttttaaattttgatggttcgtaattagttaattattttttgctttattttttaaccttaaaaataaactcacaaattttcagcccactgcgctggaaattgccaattttgaactgttctcctccagcccccggcagtttcgcgtttggggtagtgaacgatatcccacgcaagaatgggcactcatcggcgagtttgaggcattggacaatcgcgaagtgcagctattcaatgtgctggaacacacttcgtacgccaaattcgttaaggtaatgacctatttgcatatttttaatctaggcttccctaatcttaatgttagcccaaaattcattttcatggcacccccaaatttatttttttacacaaaatacagttggaactgctcactcactatgggtcggagcattactgcacactgagcactttccgtatgtacggcacctcaatggttgacgaatacgaagcggaaactgtggtggcggttgacgccatgcaacaacagcaacaccaacaacagatggactcggtgttcggccgcacattctccacacttccgtccacaaattcagcagcggtgaatgaagctgtggtggccacgggtggggaggaggaaaacagacagaacaacggcacaataacggaaaagacaccgctgacgacagtggtaattcacaggccgaccgaacagccagatgttttgcgacgctgtcgcaagtgcccatatgaaatggcgtcgcaatgtgattggttttgccacgtattctttggccatcatcagaaaatcacgacgacagagatgacaaaagcgacggactcttcctctccatccgctacttt

SEQ ID NO: 41717 - DNA, 1017 bp, Heterodera glycines
  misc_feature (11)..(11): n is a, c, g, or t
  misc_feature (39)..(39): n is a, c, g, or t
  misc_feature (95)..(95): n is a, c, g, or t
cccctcctttnttcaaagaaaaaaataataattttcaantcgtgtaaggcactttttaaagtgaattttggtgaaaaattagttttcggttttgnctcgaattcgggtccgaggttcgaaattggtcgaatgggtatcagattagttatcagcgacctcgaccccataaaaaattgtcttacacggtttttttaaatttttatttttttgaaaaaaaggggggggacaaaccaaactattacccaaatgaaaaagtcacaatgcttatcgcaaattttaattgcaactttttgttcgaattcgaatctgggattgagaataggctaaatggattctggattcatgaacagcagggattgggcggcgttgccgttaggcatcgctaggaaaatttttttgaaaattgtacaattaacagattttttccaaaacaaaatttttttttgtgattttgtaaggaatctttaaaaattgagaattttgaagtccgccggtgccaaggacagagccgggaaaaattgataatttacttgtgatttgttaaccgattttgctgaaaaaatgacaagtttttgtgagtttgagccacacaccatcccagaattaaaaaatgacgaattttgggaattatttttgaagctttttgccaaccaaattggataattttggtatccttcgaaagctcttgataatgagaagctttttctaagcaaatgctaagcgatttggtgtaccagagaaaagttatgaggctttaaaattttgtttttcttataacttttgatctagcgcataaacaaaaatactttttgcattaaccgatgcagaatatttttctctatcgatttgcaaaatttggtgtggatttaacatgcagaaaaaaagttaaacatcacgaagtgaatgttgtttttcctaataatgaaaatattagatagtacgccaaaaggagacaaaaaattagagaaaaaaagataatgtttttctctggcattctctatttattggtacacatct

SEQ ID NO: 41718 - DNA, 1419 bp, Heterodera glycines
  misc_feature (59)..(59): n is a, c, g, or t
gggaattagggaggaaattagaaaggagaaagggcgataagagatgacgacgaaatggnataggcatggaagaaaacggggagagagaggagagggagagagcaagagagagcaagagagagcaattgagcaattcactaagtccaacgaattcgtaacgaaaattgagcatcaattagcttacattcttccaagagtctatcgcatttttacttcctagttaaaaatggttataaatggtggatattcgagggggggggggaattgggacccccggggattgggagccttaaaatgcgacacctgaaaatagacagagggaaaacagggcaccgaattcattttaaaaatatatttatttacaacaagaaaatctattggcctattctaataaattataaaatatttaattaaaagaattttgagtgaaattaaattggctaaatattaaatttttattgccaattgagtcggaaaccctgacggaatttaatgaaaaaattttcactatttaagacgaattcaataagcacgagggaaagcgaaagaaattttataattgaaaattatttggcgggaaagcctttgggggaaagaaaggattaagcaaattgcaaatgaatgaaaaagggagaaggaaaagggaaggaccaaaggattcattccctttttgagatggcacagaaagaataaaataattcatcggatcaaagccccgtggggtcttttcttttgagggaatgccgaagagtcgcggccgagtcgagaaaagtttcggaggttttgggtccgtttttaaatatttctttaacaattaattctttatttctatattttcgcaccgccggacccgtagaataaaattattcattttcatctcagccaaatgccaaaaaaggcaaagagatgagccaaagaagctaaatttttgaaattgttttaaattttcctatttcgtctttcccctttgatttcttttgcccaaaattccaaaatttccactcttttttggggtgtacccttaaaacgtttaccatttttcttttttttgcttccaattccgaagaattcagtaaaaatatctcttcttaaataaatcttttttaaaagcaatttgaatgtgatgagaagacaatccatcagctgataaatgaagtcacttttttccgtatccaccacacccgccaccgtatcctccaccgccgtatccgccgccaccgtatcctccacctccgtagcctccgccaccgtatcctccgccaccgtagcctccaccgccgtacgaaactgcacatgttctacacgttgtcaccgtgctaacacagcacgtctgttgatagcagcatctgacatcaaaggaaagaattgaaatctgagaaggaatgtgagagggaagggggggggggaggggccgtaaga

SEQ ID NO: 41719 - DNA, 849 bp, Heterodera glycines
tattttctttctttatcattttatgaatcctttcttagggaagacgggagcaaaaaggagggggaaaaccttttttctgaaaattcagatttatggcatcttgcaacattaaactatttttacatttctatactttcatttgcttataaaaaattaaattagtaatataaaagaatttaaaataaacattttcttgctgctatttaaaagtccagatatatcatcaattttttcaaatggtataaaaaattaaataataattttttaaaactactaataatttatttaaaaaaggcttagatttttttatataaatccttatacttaaatttttaatataattttcttttgatttcatttttaaaaatatataaccgaatgaaatttcatagccgatctgttgatcatttgttggtgggtttgaccttttccaacacccattaaaaaactgtaatattaaaatttcatgattgtgaatagagaccggacgggatcgggatcccgcgggatttcttcgggatcccgacctcgggatccgtcccgagcgattttttaaattcatcgggtttgatagggatcgggatttcatcgggatcccgaacggcgatccctcccgaccattttaccaatccgcgcgggatcccgcgggatggaagtcacgataattttcaaaaaatctcatttttttaaattaagatcttgaattttaaattaaaaaatattgtcattgactaatttttctttaaaaaaagcccaaaaaaattttacaggtctccaaaattccactaaaattttcaaaatttgatgcaaaagttggccattttgtgattttaattcttccataaattt

SEQ ID NO: 41720 - DNA, 146 bp, Heterodera glycines
cattttgtccaaatttttgaatgccaatttgtcatcgtaccctcccaatattatgcttacatttaaacatttgaaaaatataataatttttccctaaaaaacatttatataaaaaataatgccattttaaattcattacacatttt

SEQ ID NO: 41721 - DNA, 802 bp, Heterodera glycines
tcctaattatcatttctcctaattagcatatctacctctttaccaccccaattattgtcataagcccctaacttcctcctcgtgctcttcctttcccttctctctctccgctttttcccaatggctccgtttcggcactttttcctcctccccttatattggcccatcaacttccacttccttttccatttcctcttccatttccctttcttggccttcttcgtgcttatgctcctcaattcacgttccgtctttggccaaacccccgcggctgctcaatgccaatcggtcggccaatgggccgattggggccaatggcagccgtgccctcaaaacccttcgaggccggagttgaacgtacagcggcggacacggatttgtcagccactgccaattgggtgcattcagagcagaacagcgcctttttattgcccgtaaatcagggaaaatgcacttcctaacaaacagccaccttgcctttagagggacctatactgaagttttaccatgtgtaattacgactacggttaccgtaccagtaataacttcgacccaaacaatgacaacaacggcaccaccaaacgtaatgttaattgacaggacagcagggtccatttcaattgttatttagaacacatgtgctcagtggaacagttggatggaatgggtaagtaggatttatgtacagaatcaaagaaattggaaatccgacggtttgccaattaaaaaaaccgaacagtatcggaaatttgggatgagttatattttgattggattcaagggcgtatctaggggggggggg

SEQ ID NO: 41722 - DNA, 900 bp, Heterodera glycines
  misc_feature (56)..(56): n is a, c, g, or t
tttcaggctaatggaaaagataaataaactgccattttacaattagctaactaacngtctagaaaagctgtaaaatttggtggtaattcttagcaaacaaatgcgccatgtccaaaatattaattaatagtcgcgacaactgaacttaatacaaatcacatcaaaaattcttgaggttcaacatttttgtctcaataaagtaaaaaaaaaagaagtctattttggccttattaggccgaactgaaataaaccaattttttcaaaacatttgacatttggcaacaacaccaatcagagatactgttaaccaaaagcaggatctgatgtcttaatgcttattgttagactgctttttttgtccttttttaaattgaaagacaaaggaactgatggggaaattttttttttttgcgatacgaaattttgggtaaaaattttatatgtttttccattttcatacagctgaacatagaaaaaacatttctgaataatttatagctttgatcaatcaataaattttttaagacgacttgagtcagccgccgcttgtcaaacgttctcaaagtgcacggaatttacccggtaattttttgaaaacatcatataatcagtttggtttaataaggctaaacaattcagcaacactgcattacattgaaattttatcagagaatcactgtgaaaaacagggttagggtgttgtaaaaaattctattgtcactgtcacttgaaattttttcgcacaaaaccaaaattacggacggaaagaatataaaattagctacaaaacataaaagaccccatgtctgttgacttctttccatggggtattatcgaaaagtcgaaaatcgattatctcaaaactatagtattctaggggaatgattttttaagcctacc

SEQ ID NO: 41723 - DNA, 1194 bp, Heterodera glycines
gtccctccgtaccggctcaacaaccgcacgctgttttccctgtgccggacgtgttcggaaatgtacccgcgtggcttgattgaccccgagtacaactgcaaacattttgaggactctgaaaggggtgggtttagaaacttataattaagcaaatatttttcttgataggattttcgacaactgtcacgcacattgagctggaggccgccctccgctctgggtacaggtgacgcatgtgtaccgtgcctacatctggcggctcgcgtgcgattggagcaatgggctgttccactcgtacctgctgaagttcctcaaaatgaaatttgagggtgaaattttggaaaaaaaattaataaaaaatcattaacaaaaatttaagcaagcgaatatccagcgtcttgtacggaggcgggcatcagcgatgagcagtcggcacggagaaagcaggaacacatcgacaaagacaaagaaaaggctcaagtccatcttgaggcggaccgaatcaaacacaactcaggactccgctacctgtccaagctgtgtttgaattcgctgcggggccggttcgcacttcggtaaaactttttagaaaaatttataaaaaactaaaaaaaatcaatagaaatcggctcaccaaaaccgaaatcgtcgagtgccatgcggagctggccaaactgctgaacgactcgaagattgaggtcagcagcatcgaccagctgacggaaaagttttggatggtctgctacaaggccaaagatgagcatgtggtggagcacagcacaagcaacgtaagattcttgaaaattttcaaaatgattggcattttctcaggtgcccattgccctatggaccacctctgctgcgcgaatccatctgctggaatcgctgaaaaagatgtatgggcctgctccgggtgttgagcggtacgacacccgaattctctacatggtaaatacgggggaaatctgagattttagtagtaaataaaaacaggacacggacatcatcttttacgagtacttgacgcggttgggggacccacttccgggtggcgaacagctcggggaactcgctgacgagtaaccgaaccatacgattatggagtttatttgcggtaagctcattaaaaaataataataaatgtaaagtttgtttagccggacccaaggcgtacggattgtggctgcgcaacaa

SEQ ID NO: 41724 - DNA, 1074 bp, Heterodera glycines
attaccttgaattaatttctttttgttacctaaattttaaaattaaccatttttaaaatgaatttaagttaatttgtttttgttaatttgtccattccttcgttttttaattttaataaattttaatttaccatttcccttattttccgacttccttctcagctgtcctctccaagagcacgtcgcttctcttttcggccttccttttcctttttcttatcttccttcgctaatggacgcggatttgcccgacaaaatgtcactctctgaacgatttgacaaccttttgcgcacctttgtcggttacgtttatctttggcatggcattgatccgctgacgaacattttccgaaaacatttcgggtcatttaaatgctttggtttaattaatttattttatttttgctttcaacagaaacgatttccccgaccttcgcgacattgtcaaaaattcgccgtttgttttcgttagtgtggacgaactgctcgattttccgcgacctctcttcccaaatatggtgaacatcggcggaattggcatggacaaattggacaaaaatgccaaattggaggtattctgacaaatgagcagcccaccgaaagagtgcttttgtgataaagcaacattttgagttgttttccagcggtgtttttcggcacattctgggatgtcttcgctaggatttttcaacattaattctaaaaccctaaaaagtgacgatttttgcataaattatccaattttctgtggcaccgctcctccattctttcttaagaatgtacagttttacaaatgagctctaattaatttttaggagccatttaaaagtgaaatgagcaaaggaaaggaaggcgttgttttcgtttcaatgggcaccatcattcgctcatcggaccttccggccaaatttcggcagaaccttctcgaaacttttgcaaaattctccgattatcacttcataatgaggatagaaaagggggacaatgtaataaattaaataattatgagcccatcattcccggtttttagtattcaagcggaaattggcagcgaaaattcggaaacattttttt

SEQ ID NO: 41725 - DNA, 894 bp, Heterodera glycines
gctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaagagataaccatttttctgagaattatttcacaatttctgcagctctt

SEQ ID NO: 41726 - DNA, 144 bp, Heterodera glycines
cgccggtttcgcggttgcacacgccgcacgccgggtcccagaaatgcaccacgcggatacggccggtgtcaccggccagatcggcgggcaggcgcagctgcgagtcgtcgaagacgatggcctgttcggtgaaggtggattgcg

SEQ ID NO: 41727 - DNA, 350 bp, Heterodera glycines
gcccccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttattcatctccctttttgatagaaaaagcatcagagtgcctaaactaacatgtaaataaaatttggcgcgtgtcagagcattttctgaaaaaaatatttatgaattaattatgcaaaaaacaaataa

SEQ ID NO: 41728 - DNA, 776 bp, Heterodera glycines
  misc_feature (7)..(8): n is a, c, g, or t
gcatgcnnctgcaggtcgataaaaataacatttcacggtgcgaaaaatggggtttgataagtttattgggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttt

SEQ ID NO: 41729 - DNA, 1454 bp, Heterodera glycines
  misc_feature (27)..(27): n is a, c, g, or t
tcaatagacagagagaccgactcgttngaaatgtttcgaaatttaaatttgtagaggcttgaacaaatgcctaaaactcacatcggttgccgtgtcggcgccgcccggctcctcgctgcaccgctcgttgctggcggcgccggcgattggcgatccgtccatctcctcatccaactcgtccccgtcgctggtgtaccgagttcgaccccgtcgtcgcttgtccttggcgcccgggtcgaaatagccggtcagcgagtcgtacagcgattccacctagttggatttcgatgaggctttattagattggattttggccggatgactcatagttttttggcacaaaagttttgctggtccctgaattgatcatagttcggacggaagaaaattttgtgtcaaattgtctgttgcccaattgtccggcattgccctattgtctgtctgtctgtatcaccatgtcctttttgcgcctcgcggcggcgcccggttttccgatggacaccatttgctgacgccgacggcgtatttcctcctcctcttgctctgaattttgttgctgttggcgctgtgcagttgtgctggtggtggttatgtcgtgtcgatcagcaccaccagcagcagtgccatgaactgcttgctgttgttgcggttggcctccgccactggcactggcgcccaaaaatagctcgtcatgttgaccccgttgctgggcttcgaacatggccaccgccatggctgccatgccggcatccgagttcatccgttcgaccgcctgaacatgttggaaggcatcagagaaggtgtgccaataagaaaattgttaacaggatcatcaaatgatagtcgagaattcaaattgggaacggtctcggatttttggagtttgttaagaaaattaaatttctatggaaactcttggtctctcggcattctcaatcttgagcataactgaccaataggtgccgcaaaatactttagtttctcggaatataagtataggattgtttaggaattcaatcggaacttcaaacagaaagaaaggggcatttttgccgattggtccatgatcagtttggtctgatcactgtcaagagcctgctcttgaccttaaaaattggcattccttaaacttttctggaaataattggcaataatggacaatgagaggtcggaaaatgccattttcaacgggttttcaatgccctgagtctgttttggcacattttgttgccaatcattaatgctgctgaaaacttacgtcctgaatgtccgtttggaacgcttgtgccatggccgcctgctcgtcgtcgtccaacgggtcgacactgaacgcgaacgaattcatcgcctgaatggtttggaccatcggcggcaccggcacaatgccatccaaatcgccgccaccattttcgtcaaaggcgcgggtatttcaattctctaataaaattacattt

SEQ ID NO: 41730 - DNA, 389 bp, Heterodera glycines
tttcagttgtcattcggccgtcacgcggactcaaaggccgcttcgctccctttcgcattgtacggtataattcgcccgcttcgcggcctcaggtcgggcgcttcgcgcccgtttttaaattttgtggtggatattcggccgcttcgcggcctcaggacgggcgcttcgcgctctttttaaattttgtgggggacattcagccgcttcgcggcctcaggacgggcgcttcgcgcccgtttttaaattttatgggggatattcggccgcttcgcggcctcaggacgggcgcttcgcgctctttttaaattttgtgggggacattcggccgcttcgcggcctcaggacgggcgcttcgcgcccgtttttaaattttatgggggatattcggc

SEQ ID NO: 41731 - DNA, 1074 bp, Heterodera glycines
ctgctgctaagtttttccattccggcgtgtgactcgtcattatgatatgcggataaggaagcgaaaaaatgttatcgtaagcgtaaataaattgttagacaaattttactagaaattaagaaataaacattataaaaacattttaaaagaagtctaatgtctcagcatttgctaataagtaaatggtttatttatcatataggtaaatctgtaagcttaagcttgcatcttcttcatttcggtcctagttttaacccaaccgaggaccaagccaacaaaaaatttaaaaattatgttttcgcgaaatttgtcataatgtctccttcagtcgagatcgcactatgggtcaagcccagtgtcagacaaaattgctcataacgccaaatagcgcatttggcgtaaatttttgcgcgctatttcaaaatttacactggaaaatgccttttttgtattttttattttgatctgccataactcgcttcattcccaattaaactgaacaaatttggtatctaaaaaaagtttttgaaaaggagaatctttttctaagcgaatgctaagcaatttgacatatcagaaaaaagttgtgggaatttcaaacttttatcatgttataacgcaagtcctaaactgctgttttcaccaaaaatgctaaatttattcttttttctattgattctaaatgttcaaagtgattttgtacccttataaccaaaattattagaattttcgaatttggtgttttttcatgtgttagagacatgaaaatagtacgccaaaaggagagaaaaaagaaatacgttattattattatttataacttttgagtttgagcacagacaataataattgagcatagaataatgcagaatttttttctctatcgatatgcaaaatttggtatagatttaacgtatagaaaaaaagttaaacgtagcgaagtgaatgttgctttttacatcattaaaatgaaaagatagtacaccaaagtgagagaaattacaaagaaaaagagaaacgacgagatagtactaggcttttctctgcacagtggggcgtacctatagtgaaata

SEQ ID NO: 41732 - DNA, 621 bp, Heterodera glycines
cctctgttcccgtgccattccccattggttgtcccccatttaaccctcctctgctcccgtgccattccccttgtcccctttttaaccctcctctgttcccgtgccattccccattggttgtcccccatttaaccctcctctgctcccgtgccattccccattggttgtcccccatttaaccctcctctgttcccgtgccattccccattggttgtcccccatttaaccctcctctgctcccgtgccattccccattggttgtcccccatttaaccctcctctgctcccgtgccattccccattggttgtcccccatttaaccctcctctgctcccgtgccattccccttgtcccccatttaaccctcctctgttcccgtgccattccccattggttgtcccccatttaaccctcctctgctcccgtgccattccccattggttgtcccccatttaaccctcctctgttcccgtgccattccccattggttgtccaccatttaaccctcctctgctcccgtgccattccccattggttgtcctccatttaaccctcctccgctcccgtgccatttcccttggactccatttaacccctcctcctgttctcctgccattcccc

SEQ ID NO: 41733 - DNA, 748 bp, Heterodera glycines
aagtttgatcataatcgccccgattaaagaagaaaatggggggaaaacggggggctgagggaaggggagggattgaaaaaccggatgatttaaggggggggggggagaaatgaccccctcggatcgcaaaagtcggggtgggggagggatttgcttgagatggacttgacttacgcgcctccccccccccccccccggggacccctccctattcatttctctcacagtttcgacacagcatcgacgaggaggggaatttgaaggtgaaagccaacgcgccggggggggggcaaataaatgctttttgctctttcccctaaacacttcacaatgaatggggggaaattttgggagcgggagaaggaatttgccatctttgtgtgcgtgtgcattgtatttgtgtttatatgctttacatgctcctaatgatgcttggaatgtcaggacggaattcagtcgagaaaattttagaccccggaattcaaacttccgaaattttggggcccaaaaattacaagttccaatttttagggactaaggaattccgattttcgaatatttttgggacctgagaattgagaattccaaaaattttgtggacctttgagtacggccttggaattccggtctctaaatcgtgatgccaaggaattcatttgaaattttgaacttggaattcagactccccgagatttttgggcacagaaggaattccaacttccgattcctgaaaattggtcacctaaat

SEQ ID NO: 41734 - DNA, 713 bp, Heterodera glycines
tttcaatcactgggtactcaacccaacagcatttcaatcactgcgtactcaacccaccaacatttcaatcacatgggactcaacccaacagcatttcaatcactgggactcaacccaccaacatttcaatcactggtactcaacccaccaacatttcaatcactgggactcaactcaccaacatttcaatcactgggactcaacccaacagcatttcaatcactgggactcaacccaacagcatttcaatcactggtactcaacccaccaacatttcaatcactgggactcaacccaccagcatttcaatcactgggactcaacccaccaacatttcaatcactgggactcaacccaccagcatttcaatcactgggactcaacccaccaacatttcaatcactgggactcaacccaccagcatttcaatcactggaactcaacccaccaacatttcaatcactgggactcaacccaccaacatttcaatcactggtactcaacccaccagcattccaatcactggcactcaattctccagcatttcaatcactgggactcaacccaccagcatttcaatcactgggactcaacccaacagcatttccaatcactgggactcaacccaccagcattccaaatcactgggactcaacccaacatcatttcaatcagtgggactcaacccaacagcatttcaatcactgggactc

SEQ ID NO: 41735 - DNA, 1435 bp, Heterodera glycines
gataaaacctcaaaagtatgtatgcaccaattattatgttccattacgatattataactagaaggatgagcgaaccttttatggcaaattaattttccagggcggtaatgactacgaaattttcgagcactccgatacggtgggccatactgtaacaagcccggacaattgtcgtacggtagtggagaaaacgttggccgagttgggcctgtgagaatcagtgatgttttatggaatcgtgatattattttgtgtttattattttgaaatttattctcctattttttttcttcggttttattaatttatttttgtaattcaatttcctttatcaaagtgttaattacatattaaaatttcaaaaccaaattcatttgaaagtatcagcattgacagaatgcaaaaaaagagataatattgggcagtagtaaataaaaaacattgcagaggcagtgcccgccgaaaaaatagacaaaattttttgaaaaaagccaaaaaaaattgaaaatttaaataaatttataagtgaaaaaagtaaaaaagcttccaacaccttcgattcccaggacgtctccgttccaagtacaaagaaggcccaacgttgcttaacttgccagatcggacgggatggcgtactttcaacgtggtatggtcgtaagcgaaaggacagcaattaaagtcatttaaataggcatttttaaaagagcctattttttgccttttctcaagagaatttattaaaaacggcaaaattcgccttaaattaataaggtgaaagtttgaaaatatttattaaaaaatttcaggatgaaatacaattaaaataatcaaaaagaaaaaaaataaatttatttttctaaataaataaaaaacattgtcagaggcagtgcctgccgaaaaattagacaaaattttttgaaaaaagccaaaaaaattgaaaatttaaataaatttaaaagtgaaaaaaattaaagtaatttaaataggcatattttaaaaaagcctatttttttgccttttcacaagagaatttattaaaaacggcaaaattcgccttaaattaataaggtgaaagtttgaaaatatttattaaaaaatttcaggatgaaatacaattaaaataatcaaaaagaaaaaaaataaatttttttttctaaataaataaaaaacattgtcagaggcagtgcctgccgaaaaaatagacaaaattttttgaaaaaagccaaaaaaaattgaaaatttaaataaatttataagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtaatttaaataggcatattaaaaga

SEQ ID NO: 41736 - DNA, 945 bp, Heterodera glycines
tataaaatttctcaaaaaaagagatagccatttttctgggataaagtctaaatataaaaattccctcaaaaataaaaggtctattgcgcaccgccctccctatcatgcgcaagagcatttgtaagtgtataaaatttatcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccctatcatgctcgagagcttttgtatgtgtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctcttaatataaaaatcctctgtgaaataaaatgccgattgtgcacagcccctccgtctcatacgcaagcgcttttgtgagggataaaatttctcaaaaaaaaaatagccatttttctgggataaaagataaatttaaa

SEQ ID NO: 41737 - DNA, 886 bp, Heterodera glycines
ttttaaagcattttaataaatttttgatgataatatcttttgttaatgttaaggctttcagaaaatatacaaacttattagttgggactaaatctggggagctacgtggtcacttttcgatggcttgaaatcgggtctgcaaatctacgaaaatccaattttggttatggtacttagcaatgacgcccaattttgaaatttgtggaattattatcgcatagttacctgattaatcgccacttttagcttgtcaaaaatgccatttatggtaataataggcatcgttaaaaatggcataaattgagtgcaacgattactgtcattttctgaagcgcttgggtgcttgtatctcggcaaatggggaaatttcgagcttttgtgtgattttacgtctaattactatcatttgcttatatttatttcaaaaatttattttcataatgaccacacgaaaaaaccagttttaaaaaagtaacagaatttttccgcactctttgtttagtattttgtttaaatctttatgaatcgaaacggcgattaattggcatcagttggcaaatgcgcatttgctttgctttgtttgtgtagtgacttttgtgtcttcggttgggcccgaagtaccccccccccccgccttaggtcacaatccaacatccattctgaccaactccgaaccccggacccgaatacggtacatacaaggaagagaacttaaagtcataaatacttcaaaaaattattaaaccattttaaatcaaaaatgtaaatttgaaaattttatttcgacttgaattcgggtccgggattcggagtttgtcaaaatggatgttggattgtgatcagcgacccccaaaacgtgggaatttttgtcatgactttttgaaaa

SEQ ID NO: 41738 - DNA, 1357 bp, Heterodera glycines
  misc_feature (1291)..(1291): n is a, c, g, or t
cgctccctaataaaaaagtctaaccaatgccaaaacccatctacctaattgtaaatagggttttacacttttacacatgttgataatattgaatcgtaaggacgatgtaaaaactatgtcaaaagcaaatttcgcatgagatccaaaaaataaccaataaatgccgccggcagacaacaaagcaattaaaaagcatcaagctgtgaaccacacaaagttcgcttggtttttgcattgagtgtgccttcagctcatccaacggcagtgttcacccatttaattgcccttttttactataaaaaatggatacaaaaaaccaaaatatatgaaaacaaaaaaaaaaaaaaaaatcattttttccatgaattaccgtatttgctctttttatccccccgtcttcattaatcccaccgtctccaattatccccccctttctgaggaggttgaaaaataatccccccgtctccacttatcccccgggggataaatggaatttttaatttttcgaatttttttttcaaaaaacagtaaaaatgctaacaaatgagcaattcatcctcatctcccactccatccagctctacatcatcatcagataggccggccttcctcctgatcattccgtccatctttcattgtttcatttcctctaaactcgcgcaaaatctctatcggtccaattgctccttccggtttgaagcaagcaattttttcgtcttcagttccgtccaatggcgtagtcagcccacagacttaaaagtttaggcatttttcctgtattaattttttaactgacccttaaatgctttgatgatcacttctttggagatttcctgccacgatcggtgaatccaatcaagtgttacatgaagagcaggtgccttcggattacccgctgatgtgaactccttttccgcctcattggacatccaaatgctgtagaagtgccgaattcgctccttgaacggcttattccacgagacatcgggagcctagggaagaaaaatgaatttcgttgtgaaggatgatttagttacctgaatgaatttggtgcagccaccagggacaaaaaccgttttcactcccaatcccttcaccaccttcgtagttctctcgctcttgtggctgccaaacgcacccaaaccaagaggcgttcgccaacgaacagctttgccccgatgattttgtgcaggtagtcctccgttgtgtcatcgttcatccatatcgagccagcgaaatttatcaccaatttctagcaaatttggtgacaatctgcggcatcgatcgcttntctgtgaccagcacgtatgggttgagtttttgtcccgtgtcgcgggctgtaaggcacaccgtcacc

SEQ ID NO: 41739 - DNA, 1050 bp, Heterodera glycines
aattctctaattttcttggtcaagaatgacctcgaagtaacaattttttcattttttgaaaattttagcaatattattatttaaaaataattccatagaatgatgatataataagtatataaattagcgaaaacattccgatacattcttttaattattaaaattattctaatgtgaagtattaccatattaagaatttttgttttaatatttattgtttttagatttatttatttgtgaattcagtgccattttaatgcaattttttcgtttattttaattaatagacaccgtatatcaattaatttattttaattcgcctttaataccaatatctaattcatttagtataattaaaatataagcaatttttcttaattaagacccgaattctttaaaaaagtttatggcggtattttttaagcaatttaaaatttatttttgtgagtttacttaatgatccataatagcataaatgtaaaattatccaaaattgatcatttttatagtaactagttttcaactttttaacctagtctacgaattaagtcgtagactaacacacttcagcttctgtctcgggcaatgaggaagcaatttcgagtatttttgtgatttttcttaaattaatatattttcttattttattatttaaattatttttattttgaagaaataaattgcacttttaaaagagtgcgggaattttagtcgcacatggtattattatctaaacggtttttctaatatttgtcattttatgagcagatcatctttctgcaacctaggtttttcttaaatcttggttaagtttttaattattattttttaaagttaaaagatatatttgtttgatataaatacttattaataaggacttttcatacaaatttatttatttccttcaattgatgtcctgcgaatatgcacaggaaactcttcaattgaaatttatatgtaattttatttagtcaaggaattattgtctatcacaaataaattgtctgattaattaagtttaatattttattcatacatattatctcaaag

SEQ ID NO: 41740 - DNA, 1066 bp, Heterodera glycines
  misc_feature (56)..(56): n is a, c, g, or t
ttttgtgctttgaagtttagctctttttgaaaacaatgcaataatcttcaaattcnaatcaatttatcagttttcatttgataaatatttcgccatttttacaaaaaatttagttctactaataataaaatttactcgatttttgcgttttccattcatttgattatgttaatgtttaattcgaagaaattttaatcaatttttgctgtttttccttttgttgttttatatttaaccccatttttactaaaattggtagaagtttagaattaagcgcgaatttatattgctcattttgataagataaattaatatatatttagagattttaaatttgattgaatgttttattatattgttttatttttgaatggtaatgggattataaaaaaattatatacgcttctaataattattaattataaattgttgcatatatcaattaattttgttgtagcttcttaattatattttatttttaatatgctctatgaatttttatcaatttttttaaacagatttgtgatcaaatcatgtatccattcccataatacatattcattgttaatttaaattttttgtattttgtttcaatatttttgttttgtcatttaattgtaacgaactcataaactctttttttgaccaaagccttttggttttgcgtgtcttcgaactttcaaaaaccattcaattttgttcattttatgcccaattcgatcgcattctaagcacattaaaggcccttatattttgttttattttgtttctataatgaattattatttattagatatatttaatttaaccctaacacttgttgtctcattgatcaataattttacatttcacttcattaatttagttgaatccagaaaatttttattaagaatagatatcatcatatttataccttgtaatattgatttatttgtttgccactcaacggctcctgcatgccgaaaaatgtgacagacttcgacttcgcgaagactgtggagcagctgaagagtttgtttgcccagcctcagtccatttggattgacagatatgactgcctgcgtgc

SEQ ID NO: 41741 - DNA, 916 bp, Heterodera glycines
atgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgcaggaaagtgaggcgacaaaattcataatgatagagatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgtgaaaataaaaacacaagttgcatgtgatggcaaaagtgtgaaattcaacgcattttacggccatgaatagcggggaagtgaggcgatcaaaattcataatgatagagaatgtgtggctttacctgttt

SEQ ID NO: 41742 - DNA, 627 bp, Heterodera glycines
cgtccgtttccctttcagctcacttccctcgccaccacctccgactcgggccttttgacgcgttcgccgtcctccgcctccaccatttccggcattcagcagcagcaaaataatgccatcagtgcacaacgaacggaagaaacggaacgacgagcggcggcacatgaaagggaaatgcagcagcagaaacaggacgcacagatggcacggcgggagttggaggtgtacaagcaaatggcacgtcgagagttggaagattcggaacgggtaaaaggagggggaagtaattagtaagtaattaataattaattaatgagcctttgtgaaggaccgcgacgcactgggcaaacagttgcgaactttgaataccgaaatggagtcgttgaaaaatgagctgaaaaaggagcaggaacaaagtcagaggatggaattcgaaatgagaaaagttcgcggagagaacagcacattgagacaacgggtggaggacgaaagagaggaaaaagaagcagagatagcgatggaaaagtaaaaagggagagagaaagaagcagagataaggaaagagaggggaaaagaagcagatatagcgatggaaaagtaaaaagggagagagaaagaagcagagat

SEQ ID NO: 41743 - DNA, 778 bp, Heterodera glycines
atgccaaatttataaaatttggcctgctgagaaaaaagttattatactttaaacttgttcagactataacggccagactatagtgtcccctaccctgacaaaaaaaaagctttttcaaaaatcgacaaaatatatgctaaaaactatcaaactaccaaaaacccaaaatatgtgtttatgagcaaaaagttcaaaatacgttttttatgtccaaaaactcgttctggtggcaaagaaaacggtaaaagtgctctttttgagcttttcatgtgaaagcatattcgcaaaaaaaaaaaattatgttaaaaataaaaatcccagccctggttcattttattagtcgatttattttgaatattatttaatcaaaaaaggggcaattcaatggcaataaataaaagaatacggcatgaaaaaaccattcatacacatttaattaaataatttgagacttcgtcgacgtcaaccactcattttcaacagagttcaatgtgtaattggcactttttcgacttttcacctgctttttggcacattcggtggtaagttttaattaaattctgtttttaatatttctatgttctgttgaaatgtcttccaatgccccagactaattaaatgttttaatttttactagtaaatttggtaaatgccaacgaaaggaaagggcatatttacggtattcatattcaagcaaatattaccaatattgttatttatttagcacgtaaatacagaagaaaaattgaaaatttttattaacaaattgtggaaaaaa

SEQ ID NO: 41744 - DNA, 1308 bp, Heterodera glycines
cggctcgaaacaaataaaaacagattgagacacaaatcccaaaaaatgtttttgccaattctcaagcagataaaacagaacaaatcaaatcaaaatttaagtattataaatttaggcttggtacggcataaataaactttcgccatttgatcttgcaaaaatcaaaaaaatttaaatgttcatacttctaattttattaccgaagagctgtcgaaatctaacaacataaaaattcattaaatctgaatggatacaacatgtccctttctctgacaaacatttatcgctacattttcaacatttgcttcgccaccagcaattagcacatagggactctaaatcaaattagtaaaaattttattaagaaaaattaaattttaagagattgaatcttcgtgaaaatgttccaatttaggggttattttaaaaaatatgcctaaaaatccagtctctaattattatgaaataaaatcaatttgagcaaaaatatatccatcagttgttatcccaatatgaatgattaatttaaaaaaaattattgtcttatttttttttaatcagctgctgatcgattcattcccctaacaaatatccgatcatgcgcaaaatgacacacacccacacacaaaactaatcgtaaatgggcgagtaaaagggcggcacaagagaaagccgctgctgaacccaggaaatccgataagaaggggcacggcataatgatatttctgccccgcgttaaacaaccgcaaaaaaaaaaaaaaatcgggcgcacaaatccattttagtaaagccggtgaattttttttaaaagaatgttacaatttcttcattttttcataagtgggggatcacatcgagaatcgaggcgaccaacatattttttttggcaaaaattgggttcaggatagacacaaaaaaaagaagataaatttgtaagcttgatcctaaacccatcactttttcaaaatgtcaaaagattttcaaaattctatgtttctgctttttagttgaaaatttgtatatgtgaaataagaacaaaaatttgttctattttaacggcatatttcaaaacactagaagtagaataacattttggaaattgttgtcagaaacaatcatatttgaattttacttttttttaaatttaatttgtataaatcagtaattttttatgggaaatatttgctgggaatacatttttgttttgtttttttacattttattaagctaatgagtattatataccagcaaaacataaattatttaatttatcccacttttccagcccctattacaattgatcaaatt

SEQ ID NO: 41745 - DNA, 1403 bp, Heterodera glycines
  misc_feature (318)..(318): n is a, c, g, or t
  misc_feature (1397)..(1397): n is a, c, g, or t
tttattaatctcgtgaatgacccaaaaagcccaaaagtgaaaaacggcacatttaattcacttaattattgcatttgtcctcaggctatatgtagtaatagtttagcttttcaattttgctttttgaattgttcagtaaagaaaacccactcaaaataaacaaaagttgtttgaaaagctttgtttcttttctcaattacatattgcataaaatgaaatggaaagagcattacataataatttaattttccaaaaataaaattggtcaattgagggaaacaaaaagaaaaaagtgaatggagaagagggggggggggngggggggaaatagctgaagctgatgaactttgtgccggtgctgttatggtgcgttaacaaccacaggacccttttaaccggcaccattaatgagaggagccaatgaggaggagcattaaaatctgtaaaagtgataacacatacagagaaagaaagagatggacaccactaaagagagagacggagagaaagagagagagagagacagatagacatactgacagagatagaaaaagagcgaacaagagaaagaaaaagagacagacagacaaagagggagaaagaaaaagagagacatacagaaagacagagatggcgaaaattggtagaagggatgagagacgaacagagaggcaccagtgaaaaaagataccatagattttttatttttgtagttattttttctcaaaaatttttggagagagagagagagggtggcggtgctgatagccgacgcaatataaaaagttgacccagaaattggcaattccttataattccttaaaattggctcaaatcgcaaattctggtaatttctttgaataaaacctattaataattcaatttcagcttcaccgagctttcttccacaaaattcttcttgaaaaagagttccgcaaaaaagagatgtgaaaataaaaaagtgaattcttatgtgataccgagtttttattaatttggttgcgtttaagcaaactttatacgaattttctcggaaaacctttgaaaattggcatttctacgaacgccaatagtggcatttttatgaaatgacccagcacgggccaatgtacgtcgtacggggggggggcacttggttgctctcaatgaatacccgggatacgacccgattggtccggatccaaaaatacactggaaaaataagcgtctgggtcaaattgttgatcaaacttgggaaaggtaaaaagatgaaaagatcaaatatatttttgaaatagctaattgtctattctaaccgtttttggttcaaaatttgttaaataaccttattacttcgattaggaatttttattggatttttaatataattttcagggaatttaataatttttcaatgnggaccc

SEQ ID NO: 41746 - DNA, 1421 bp, Heterodera glycines
tttttgaaatttttatttaaatggcaaacgaagacttccgcttgtccgaatgcatccgtattattgagcgaactgcccaagagtatgattgtgttctgccggttccacgtcttgggtttgtcacggaaaattttcttaataatttttaaaatagctcaaggcgcgatgagcacctggatgcctgtgttctcatggaatcagtgggctcaggccaccgcctctacattttcgaagttgaggactgccttcaggtatttttaaaatatgaggtcaattaattaattaaataaatagaaaaccccacaggtgaaaggacacatcggaaacgaagatgggacaagcacgcgcgtgatgattgagaactatgaaaaatacaatgggttatgtgtatttgaatcgtttttggcgtcatgtgcttttaccttttttggattttttgttcccgtttcttatgaagatgatgattgatttaattttaaaatatttttattgtacattgcgtttcacaaattcataaacaaattcatccgaattacttggtcttttcaaaaattgcataataaactcaaaatcaaatcctaaggacataaaataaataaaaactaaaacataatgaccacaaacattagagaaaatcgattgaaattttcttcgattaaaataaattttccaaaattatttgccaaatattttttgatcagatcgtttggcatctcgccataggagtcaaaaaagtaggccacccccggcgaacgcgcccatattgcgcaccaatgggttcccggcattcccgacggttcctgaagtggcaaaatttattttattgaaaatcttttttggcactcaccaaattgacaattagactgcagggaaatttcgtgcactttggcaatcggtcggccggaaatgtgccaacaaaatattttctcgtcgcccggttctcaaagagagctctgtcgatgaaccgattgtccattcctgtgacgaatccgcctctccctcaaaaacaggtaaaatcccgcagccgcagtacctgctgcaccaaacaggtagatgaggcagagaaaaaagttgattggcgacttctcgatcacatccggaaaacacagtacaatcccttcgtgtgcggcattggaggagggcatttgaacaaaatcggaggaataattctcaccattcatactgtaaggtcactagtgattgatctgttccggtcaatcagaatgagcccgtcagcctcggcataggctattaaagtgaccccctcgttcggaaccgcttcggcaaaccgaatgttcaccgctgtacagccctccttgatcagctcaaagcccggcgagtcctcctgcgcattggtcatttggaagacatagaggcagtaggcagtcttgaacatgctgtagctgatccccgtgctctca

SEQ ID NO: 41747 - DNA, 870 bp, Heterodera glycines
  misc_feature (33)..(33): n is a, c, g, or t
gcagagtcagagaggggtcacaaaagagttcgncacagcatcgaaatatttccttcatttttgggcgtcattcttcccccactgcacttctttctttggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaaattcttgaatttgcttctgaattttttaattttaaatagaaaattactttttcgaaaattttgcacaaataagaggcggagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttgattttgggcgtcattcttccccactgcacttctttcttcggtttaattacccaagtttgaggtacttggcgtgtcctgcccataatatctgtggcatggaataaattttgtaactgaaatgcctaacggcggtgcttaaagtgcgctaaaaatgatcaaaggagtatcaatttttatttttcttaattccataaatgaat

SEQ ID NO: 41748 - DNA, 1293 bp, Heterodera glycines
  misc_feature (79)..(79): n is a, c, g, or t
tttcagtacggtgggctgtcggatgattcaccggcccctgggggactgatcggacagtttggattctgttcggctccancaaggacggtaaaccaacacccgacgctggtggaatcggaagggcggttggcaattgtttgggcggtagcaattcgccattgcccggcaaacaattcatcaacaatgtgccgacttttcactcactcatttgccaatgctatgccatttttgcaggttctgtacaaaacactgacctccggctccgtgctgccctcctccgcctctgccaatgcttccgccgaccccctcaacgccacttcggccctcggccttccctttcctcagtccgtctctttgccgcctgttttggccgctttgttccccgacctgaacacttccaccccaatcactctgaccgccgcccaacaggaggcgatcggggagaatttggagatgatccaaaatttgattgtgcagccgtccagtccgttgtgcagcccaaagcccgtggcggtggccgagttcaatttggacgcatttatgggacaatggtaccaggtcagtagtcagcatggcatgtgccatgaagaagggatttgaatgttgcttatgtttgtttcaggtgatgtacagtcctccgctcgtccaaagtgcgtgcagtgtcgtgtcctatcgcaaattggccgacattaacagcggcggaattggctccatttttgaagtgtttgaggttggaaagttaaagcacagagaggggtcgggtggcaaaagagcataatcctttgatggtttccttttcctacagtacacaacggacggcactccatacagtaagccaaagatcacttccggctacgcaatcattaaacaaatgggcgaactgatcttccggacgaccgcccaccaggaagacgttaacagtaagagatcatttgcgcgggattaaccaattaattaattgaccggctaatttctgttcagtccatgtgttgttcaacggacctttgaacgagcgaggacagtatgaattcactgtagtcagcaccaactgcaattatcccgtgtacgtattcgcccgagaccccgtcagatacaaacaggtcgaattcggaggggggtgccaacgggtgcttaatttgggcaccactcaaaatgcctttcagaggtacgaaatggcggtgcaacagcttctggaacagaagggcgtcgtcaatggtatcaggtgaatgcacttttctggctatttaaatggccaattattcccccctctcgccttaattatgccaagttcgt

SEQ ID NO: 41749 - DNA, 901 bp, Heterodera glycines
aatttttcacaaacaaacgcgcagagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcacaaacaaacgcgccgagaaacaaattccagaacaattagtatcggcgtaattattctgagaatgcagttggaattcctattaatgttgagcagaaaaagagatagccaattttccaaatttttcacaaacaaacgcgcagagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctataactgttgagcagaaaaagagatagccaattttccaaatttttctcacacacacgcgccgag

SEQ ID NO: 41750 - DNA, 127 bp, Heterodera glycines
tccttatttgtccttcctcgtccctcctggactgtcctccgtctgtcttttcttgtactgtctcgcctgtccttggctgtcctgcttcaactccgtctgtccttggttgttcttcttcgcccgttct

SEQ ID NO: 41751 - DNA, 1405 bp, Heterodera glycines
  misc_feature (25)..(25): n is a, c, g, or t
  misc_feature (35)..(35): n is a, c, g, or t
  misc_feature (847)..(847): n is a, c, g, or t
  misc_feature (853)..(853): n is a, c, g, or t
  misc_feature (1313)..(1313): n is a, c, g, or t
gccttttccggacccgctctaatcncaaggccatnagttgtgaaataaaaatcttcttgaatcgccgcccattcccccccccgcctttttgtttcaaaatgtcttattttatccgacctcttgagaaaaaagttgtctattttaaggctttatgagactgtgttgcctttcaaataaatttatcagtgataattagggggggggggcatttaaatgccattcactcttttgtttttgagctgtctttgccggtttcgcttccatttctgtgttcccttctcagcagcactttgtctccaccttctttcaatttttacactttgtgtttttttttgttgaaatttttggcttattttccgctttataatcgcaaattttttccaaaatattttaattttaattcagaaacaacgcaaagtggctgatcagcagcagctcagcaaccccatggaaattcaggggtcttccgccgccacctctctccacttggacaaaaccgtgaagctcgaggcgaagcaggaacagtcccccgaggggccctcctcctccgcttgtaccgtagcaggcgcctcttttgaccagtttcccgcctatcgtagtctatttgcaccatcagccacaaactccgctcaaatgctgcttaaaaggtcagttgaagcgatggaaaaagtgaaagaatggcgatttggatacagtcaaaggggagaaagagagagaggaagtcgagaaaagaatgagagagaaagggatagaatgaaggggaaatagaaagggcagacgagtgacagagagaaagagaaaagagagagatagccgacatgagagaacgaagagggaaaaaggaggnggaggnagagagaaagagaaatttaccttcataccgtatagctcacaattaagtaaaaggaaggagggcaggggtgaatcatgcttttttgttctttctcttttcctctctccttttcttctccaatttttcctttctctctctctctcctttttctctctctctctaattcactactcctcctacagtctctcctccgtcccttttcttcgcattttgatgtctttccgttcagtttcgacttcccctccactgcttcttcctcttcctcttctgcttctcttcccacaatgcaaattcccgctgatcatttccaacaacaattcgtttccccaaattttgcgcaaaatccgccaaaattgtcctccatttatcagcaacaattcggcagttcacttagcaggtaaaaaagatgaaaaacgaactttgatgggcttttggtgccgaattagcatttgccatttcnccccgggcattctttgggcttatgtccactctccgccgtttgttcagttgtcccccgccggtcacttcttcgtccgtccatcagcagctcag

SEQ ID NO: 41752 - DNA, 1002 bp, Heterodera glycines
tttgtttcctttgcagtgaatctccgctcgtcgttcacttcgattactccgaagacaaaggccgcgtgttcggcgcttctcacgtccctttgccgacaatggacgaggaggcgcgtgagcagaagataaaggaactgatagcgatgacggaggaaacgcatcggaaaagggcggaacggaagcgacaaaggaatgaggaggaagcggaagaacgacggaggctgaacagagtgagggcgaggtgagtgggggaggggcgatggacccggggggggggggggaattggacagccatgccattttttatttttaaacacattaattaaaatccattcgtattcttaataggcgtatccatggcaaactggcatctttcattaccacctaacattgtccaaatgacttgtcagttatttgattacatttttccatcggggagagacggacgaactgaaaaaacaaacaaacgaatcgttaatttcagaatgggactcgaacccattccaagcagtgaggacgaagaagaagaacaaaaaggtgcagcagaagcaacggaggtgtgcctttttttgcacttaatttttcgtggtggggttaatattactataattagtccgctccataaattttaaaatgaacattttttgcccgtcattttcatttttttgttttaattttccttttagttggatgtttccgccattccgttgcctccctcttcgcccgaagcaaaaacgactaaagagcctgagcagaaaaagcaaaggtttggagtgcgggagtgggaccgtggcaaaatcggatgcatgcgatgggcggaggaacagcgggacgaacgcgaggacgaatttgcacctccttcattttattacggcgaagaaaacgacgcaaggggggaagaagaaacgcaaaaactgaagctaaagagaatgaatggaccattcggaaaaataatataaataaatttgtatcacttaactcacaatcagtgagcaatgaatg

SEQ ID NO: 41753 - DNA, 1408 bp, Heterodera glycines
  misc_feature (1332)..(1332): n is a, c, g, or t
taaagctaaattaaattaatttgagcattttcctataaatttggcctcaaggagaggggggtttcaaaggttaaagacgaggaagtaaaatgtgttcaagttttatctttttttaaggccgatggaaattaattgctacgctaatgttttagtataaaaatgccttttttcttctcctccgcctcattcaattcattcattcgtcacatttccggtaattttgttgctgcaaaagtctttaagaatttctaaaaatgaatgacaaaatttgatatacatatgtaaaagatattaaacaaaaaaaagtttcagaattaaaatgccatttacgtctttttatattttttgttgtcggtcgtttacttattgtttaggaaagaatttttcaaaagaattatttattctgattgtgtcaccaattaattgtcaaaacggcaaagtgtgttaattgcagcaaaaaatggatcgacggtaaggaagtttttattaagtccagccgatttgggatgttgttatcagtgaaatttggcccatttttgcgacaagcatttgccagttgcgctttgccggaggcgattatttggacaaattgcgtcgccacatttcaccgacactgctcactgatcttgatcaattgaattcaatcgattcatgtggtctgtgccctgatgaaattgctgacgatggaccaaatgcaacttctggccaagcgttgtccaaatggcttcacattccgacaaaaaatggccaaccgaagcgatttcgttgccttgattattattctcaacctggaatgaactggatcaacaatttcatgataataatgtattttatgaagaaaaatcgcaattatatgtgggtatatttaaataaatttggtgtaaccctccaagaattttgatggacactcttccatcttttgatcaaaatgtttattctataaattattaaaaattggattttttaactttcgcctaatttttcaggactttttttgcatttttacgtgctttttgggtttttgcgacttttttcaatttttcgtgacttttttgccttttttatgactttttttgtgactttttggcgattttttatgatttttttagtcgactttttgaagatttttagtgactttaattcccagccctacttattgaatacactaaacttgtttgattaaaaaatttaaatgagtaaagaaaattgtcaaatattctcacgaaaaaatataataaaaattttctaaatattataggctacatttttaattcttaaccaagtaaaaggtgatttcaaaaatctaggagttggtcgggactttttagctgngaaaaaacccgggaatttcccggtcaaaactggtcaaaaccgggacttcggtactcagttgtccgtgttttggtcc

SEQ ID NO: 41754 - DNA, 779 bp, Heterodera glycines
ttttttggaatattttacgtgtcaaagggtgtgcatttaagcgactcgctgtgcttgcccactgcatttcaaatagctggtaatatttatttctccggcctaatccagaaaaaatcactatctctttttttggaatattttacgtgtcaaagggtgtgcatttaagcgactcgctgtgcttgcccactgcatttcaaatagctggtaatatttatttctccggcctaatccagaaaaaatccctatcttttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagg

SEQ ID NO: 41755 - DNA, 1059 bp, Heterodera glycines
gaaaaaattagggtcggcgctatcattcgggaaaatgtggtcggaattcttcagactgatgatcagaaaaagagataggcgtttttccaaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaattaaggtcggcgctatcattcggaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaatttgcgacatcaaactcgcccagaaaaaaattcggaaaaaattagggtcggcgctatcattccgaaaatgtggtggaattcttcagactgatgatcagaaaaagagataggcgttttccaaaattttcgacatcaaactcgccccagaagaaattcggaaaaaattagggtcggcgctatcattcggaaatgtggttggaattctcagactgatga

SEQ ID NO: 41756 - DNA, 1158 bp, Heterodera glycines
atatgaaagtttaattcaacatgtctttttttggcgatttttttttgctttttttagaatactttttttgagtttttctcaacagagttaaaatccggtccctccttattgatgtgtttaggaagaacaaaaaacaaatttttattttcattaattaattagttaataattaattctaattagcacaactcaattaccgttatttcgctcgtccttttctgtttgggttgttggtcggccaggctgaaaacgtacgcttggccgttggcgacgctctcttttcttttggaatagaactcatatgagtgaagcagttctatttgctgaatgaaattcaattctgcatgtgcaattttaattacatgggtttaattaattaatgatgaaatatttctacgttttacgcaaatttggcaataaataaatcatttctttttaatccatccaaattagggttaagccccgaccccgagccccccgacccgaggcgtttttgggacctattccccgacccgacccccgacatgtcgccccccgaggtccccggcccccgattttttgcacccgaccccacgacactaattcgggggattgaggactccgagaatttaaaaagtttaaaagctaattaatccacgaagaagagaaatattgaaatttttgagatttgaacagttttcttaataaaattgaataaaaaattcgaaaaaactttccggcggcacctatcggcactgccaaccctcaaaactcttaattttttcctaaaaattgtcccaaaatcgcaaaaattggttttttaagaaaaatctgttaacaattttgcgacattttttaaaatctgtaattttttacaatttattcgaccaaaatgtctctaattttatattttttatagattgacattttgaaaaaagcctgtaccagtatttcccaaatggcctgcacctatattttctgtacaaaagtacaggaaaaatgcaggttgccaaaaatttgcctttactgtaccttagggtgtcaaaattgactaccataaaaaatgatcagcttcctaccattttcccttgaaatacggtagaaatcagtcatttttgaattgtccaatttttcacgaactgttgctctgtgggtataggtcgtagaccaccttcccaa

SEQ ID NO: 41757 - DNA, 1250 bp, Heterodera glycines
  misc_feature (51)..(51): n is a, c, g, or t
  misc_feature (149)..(149): n is a, c, g, or t
tggccgacgtcagtgaacggcacaaacagcaaacggtcggcgtagcgctgnaagtcagccaaatcgtcgacaagcccggaaagccaacaactgtaaagttaaaaaggcaattgcgtcagtgataataaaaatgtgtgactcaaataatnttattattttatacactgcaaaaccagcgcattttttcttaaagacagtgaatttgaccaaatttttatgtaattattttttgattaaaaattataaaacaaaattcttggtgaaaaatttacaaaaattttttcattttttgaaaaaagctgctgattgtgagggtgataaaaattagagggtggtgtttatgataagcatcgggatcaggcatgactttctaatcactggcgctgaaatggctatgacagtttcagcgcacttaaaataattccaacggacctttgacgtgtccgtcgtcggttgtctccaaatgttcaaagatgtgtgaatatttgcgagaaaatggcttcaacgactcatcgcggtaaaaactgaatgtcgcggggctttttttgcacttcatacttttttttgcgacatttttcacattagccatttttaataaattttcctttttttgcccttttatcgaaaacgtagactccttacggcttcatcatgcatagcattgaataaaccgaaattttcctagagtcgagaattgacccacgagagtcgagaccccaaaaagcccagacccaaaatcgagcaatttgatgcgtaaaaaagataaatcacaatggcgcgaactcagccctgggcgagacggagttggcccctcccaaaccgtccaaaaaaaagaagaaaatccattcaaaaatcataaattgctgctcacaaaatgacgttgtatccttgacgcagaaaatatctggaaattggcattttgtagaaatcatttaaaaaataacgaactctgcactgacggcccctcgggtgcccatggaaaagctgaaaaatgaaaatttacggaaattaaaaaacgatgtttcacaattccccgacttttcgatggcacggaccgcattcttttccagcttcacacgggtgccgccactctgcaaaaaaaagaacagattcagagcaggaaatttaagaaatcgaaacattatcttttattttcttacaaataaccaaaataaaataaataaacattcgaaaaaataatttgtttcaaaagtgacataaaagttgttcaatttctagaaaaacaggca

SEQ ID NO: 41758 - DNA, 173 bp, Heterodera glycines
ttatacacgcatgatttctccgaattttgggctgggacgcacgcgaggtgaacttggccaagatggcagatttcccgattatccgatcgcgccgtattttgagtgcccccggtggtcagctttcctgtttaagatagacgataagcctgttggatttgcacttatcaatgata

SEQ ID NO: 41759 - DNA, 717 bp, Heterodera glycines
  misc_feature (72)..(72): n is a, c, g, or t
  misc_feature (107)..(107): n is a, c, g, or t
  misc_feature (110)..(111): n is a, c, g, or t
  misc_feature (113)..(113): n is a, c, g, or t
  misc_feature (129)..(129): n is a, c, g, or t
  misc_feature (268)..(268): n is a, c, g, or t
  misc_feature (298)..(298): n is a, c, g, or t
aaaacataatttatcttgactttaaatttttttttctctggggtgagtttgaatttttcgagtgtatgtcanaactttttggaaaggaagaaatgagaatgtgtganggnnanatgggagattttatanatttaattttgttggatttttgtaatagaataaaatttattgaattttaaaaataataaatatattatatttgattaatagttaagaattttaaaatataataatttttttatgattaaattgttttttgaagatttgnttgatatgtgtggaatgatagaagtaatgnagaatatttgttagaggttggtaatagtgaagaaaagattggtattaggttaattttaggtgagaaataataaaaattttgaggaatagagaatagagaaattgaatttgttaaaattaatttttaatggaattagaaattagaaaatttaagatttttattttgtagaattagaatgtttaccaatttttttcattctgatgacaatttcataaatttacccaaaaattttccattattttgacggcataatttgctgacatttccaaaaaagctacaaaatatttttattaatgcaaaatacataaaattagtaaattttattgcttaaatctagttaaaattaagaataatatatgaaattatagaaatgtgttaatataaatgacaattaaataaattatttatatgtgttggat

SEQ ID NO: 41760 - DNA, 679 bp, Heterodera glycines
attgttttttgatttttttaatgcgattaattgtaacctcacagaaattaagcaccatttgaaaaatcaaaaattttactttccacaatgaacacctcaaaacaacacaaatctgaaaaattaaagtatctgtaaaaatgtgataaaccaaaaatagaccccacaaagtccttatttattttttaaaaacatatccaattgaataaataatcaaattttgataaattgttatttttttttaaacttgcactaatttaaaatgggacaaaaccaaaaagagtcccccaaactccttatttttttcaatttttcaaaaatatatccaattgaataaaacaatcaaatcacttcagtaccaggcgaatgctgcgccagtgtttgctcgcagaggggggtcgccagcagactttttgtagagcttttgaagggctatcaaccagattttcagatttcgaaaattttcaaaaattttcgagctaggcctaaaaaacgattttttggtttttgaattttaggaatttttaacgaattttccagggaaaacggagacaactatcaagcaaccgttttttgagctctatcaattggtgaaatttttagaaatttttcgtttttttcccggaaacggaaaaaattttttggcctcagcgggacatttgagtcccgggcccataactcg

SEQ ID NO: 41761 - DNA, 967 bp, Heterodera glycines
  misc_feature (7)..(7): n is a, c, g, or t
  misc_feature (17)..(18): n is a, c, g, or t
  misc_feature (805)..(805): n is a, c, g, or t
  misc_feature (826)..(826): n is a, c, g, or t
  misc_feature (927)..(927): n is a, c, g, or t
tatcctncattggcatnncttgcccatgagggtaaccttccctctagagaagaataaaatttcaaatttgtatggatggtatcctcattggcatcttgcccatgagggtaaccttggtacaataagcctatcaattctttgtccctgtacagctcatgtaatgaacggtagcgctggtctgagcccggattcgtgatcagcgacctcgaaaaccccttaaaacttattttcattaatttcaaaaacacatttataggcacctgaaaatgtatgttaaaagtatcatgtaaactccacaagtaccaaaaaaaaaatgccaaaaattgtggtaaaattcaggattgactttaaaaacaggaaaatgctttatctcttccctatatatcgatcatgaggacgaattttttgactggggtcatccttaaaattagttggttatttctcatattccgaattcaaaaaaaaaagactattgaattccaatccaatttttattcccttggctttcaaatttctaaatttccgacaaatttcgattaagggtaaattaaaaaaaaattttaccatgaaaattttaagtttttgtatttttattatttatcttcggaaaatgaatcattgtccctgaaatatttaattattctaatcaagctccgtatatgaaatttttaaattgatttttcatttacctcgtctcgctgacatcgtaaaaagtctaaaaattaaataaatttttgttttttattattattacttgaagagctaattcaattgccacagtgactccatttggttccggaattanatgtttgtcatatcgatttgngtggaaaatttggttaaaatatgtgccgatcgatctgcgacaaatttcggcgtacactctgtaaaattttttataaaatataataaattaatttacatatntattttttattggatttttatgacattttggtaaaaaaaa

SEQ ID NO: 41762 - DNA, 1306 bp, Heterodera glycines
  misc_feature (9)..(9): n is a, c, g, or t
tccttttcnctttcacttttgtttttaatttttcagccgttctcttcgtctcgtgctgaaaaatgtgcgcgtctacgcgcggatgtccccaaaacagaaggaacgtgcaataaacgcgttgaaagccatgggtttgacgacactgatgtgtggcgatgggttcgtccgtccattaaaaaattgtcaaaaaagcctttgcaacaatttttaatagttttattttgacctataaattcttcctacaaggaccaacgatgtcggggcgttgaaacacgccgaagttggcgttgcgctgctgacccatccgctgaagcccgaagaggcgacggctgccacctccgcgggcagtggaacaccgacgcaaagcacctccggcaccagtggcagacagcagcaaaatgagggcggcggcggtgagcaggtggcacagccccaagaaacggcaaaaaaactgccagcaaagactcggcgttacaacaaccgcgagccgacctcagcggatgccaatggacagcgacaacaacagcagcagttggccatgaccacggcgggcggtggtggcacgtcttcacgacagcaacagatgcaggtgggtggaagtgggcggagcagacgaacagaagcagcgtgacggagggttgttctaggggcataaatggagtgagttatccttccgtagcgatttgctcactttgctatttggcggcccatcgccctcggcattgtccccctcccaagaaatggggaacattcctaaattcaagccgaaaaatgggtttctccaatacggtttcgtccattaaattaaaaaatccctccgctgaatagggtcgtctcaatcaaatgatgcgcgacttagaagaccaggaggagcaggcgaaggtccgtcttggtgatcgcgtcgtacgccgctccgttcacttccaaatcgacttccatccaatcaagtgagccaatgcaattgcaccatctatccaattttacagttttgctatggttcagtttgcagcatcatcatagcaggtgacgcgtgctacgcatctgtcgacctacactatatcaatatgattacaaaaatatttggacagaatgaatcgtccttgtgtggtgtggcagtacatgtcatatcgattgccgctggaaagagtacgcgtttttattttgttatttaatgatttaatcatttattgtttttgctataattatgtttttgacatttttcaatggattttctagccacaattttttcacgttctggtttcagtgaagtataaaaatatagaaaatttgcttacagtttagaaaa

SEQ ID NO: 41763 - DNA, 830 bp, Heterodera glycines
ggcgatcgtcagactgtttcctctgccctccgtctcaccccactacttgctccgtcttcgcatgctcccttttgcgaaaatttatttcattttgtttatccatttttcaaatatccattaaaaaattaattaaaaatgcccaattttcttcactttttgtgttttgaatcggttcaaaaaccggtttatacttgtcggatcaacttcccccacccctagatcgatctgtctcatcgagagctatcgactggtaccatattcgtcgagattggtccatgagaaaaaaacatcgtataagtcaagagaaccgggaattcctccgatacgttcaaatgacagttcagattcaattggactgcccaagccgtggggaaggccaattcaatcggacaattgtccgggtgaagaaatgcgcatgtcggaatattgcgctggagggggaggaaggaaaagaggacgaagccgaggaagtgaatggccaaaggcacgagacagaaacgccatagggaaagaccatggaaaacagggacaaagttggaccagggaacaaaccaaaagagttttagaatcggttggagtcagtgaaatattttttgtatttttaccattttgcattgtgcaattaattaatttttatttgtcccaccgtttggtcctccgcccctcaggaagtgaaagatctctgttattatgatttgctatttaaattttaaaaaccacatgaatgtaaaggaatctttgccattttattccccaaatgactaccataattatcatgtatgtctcaataaagaagaaatgagtgatgacgaaaaataagtgtacaatat

SEQ ID NO: 41764 - DNA, 1249 bp, Heterodera glycines
ttctttcccctggttcaattccctttacagaaaattagattattgtcaatttttttttttggtatactcgtggtttcctataaagaaaatatgattcctcatagttttttttttaattgatacatattttatcattttttaaatgaaaatcttaccaattgagcttaataatcgcaaaaaccaacctttttttgttgaaaatctgttaacaaattgcacccaaatttttaaaatttcccccggcggcgcctatcggcaccgccggaccccttctttcccaaaagttttttgaaaaagcgagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaatttttttttaaatttttaaaatttttttgaatttttaaaatttcccggttggtcccggttcccggtttttcttgcggtcccggtcccggtcccgaaaaaaaatcgaggtcccggtcccggcttctcaggtcccggcaagtcccggtcccggttttggcaaaaattcccggtcccgtggcactctaattttaacttaatttccatttgcattgtaacaaattataaaaagaatgaaattttttaaagaaagttagattaaataaattctatttttaattaaaaaaaaatactaaaaccctataagacatacacaaaaataatattcgcctaaaaatataaatgatatgccaaggtcacttgtacattacaatttaatttataatacgtcataaaaacagagtttttaacaaaataacttttatgtatttattaattaaatagttaataataaattaaaatcatcctaaatgaagaagtgacagcatattatcaaaagcatatttgaaataaaattatttaaaatttttttctgaataatacatacactcaggtgcaaaagtatatgctcagagttttttttgccgtaacttggtcaaatgacgatcaatcttaatgattttgttatcaaaaaatagcttaatcaaaatctctcagttgacctatttcggcattttgcctcattagtgaaaaaataaattcactcaaaaatactagtcaccctcctatagtcccgaagcaaaaaattacttttatttttataacattttttaaaaag

SEQ ID NO: 41765 - DNA, 1346 bp, Heterodera glycines
ttttgtaaaataatttttttctgtaattttcatcaaaatttgatggattgaaaattaaaacaaaaacttcccggggagggggcaagaaattcgatgtccccgcccgtctcggtctgccaccggttggtcactcgcctgcgctgcgttgccctcctccaacacttcgcacccgtttattgtcaattcagcagccgctcccgcggatgatgtttcatcccccgtttgtgcccttccgtcttccatggttagcattggcgccacactttcgtcgccattgccatcgtcggcaaagagtgccgccgcgctcggtccgctgaccaattggaacaccgccactttggcacccaccgcaacccccaatttgtgctgtgccaacccgcaggaggggccgaaacagacggcgctgacctggtcagcaaagttgaactgcttcccgtcgccgccgcccgcagttgggttcaagcggacgagactaaaaagcaatgacaaatttagctaatgtattaaaaagggtggaaaattgggagcacttcccccccccccccccttctccgtgtcgtttctagttctgttcgacagtagcggtttcgagatgaaaacaaaaaaaaagtaaaaatttgcaaaaaaaaaagaccaataaaattgttttttaaattttataaaattattaagcgaacaagaaaattttttgaaaagggtctcggactttttgggtctcggggggtcaagtctcggtcttgggaaaattttgggctcgaacagcacaaatcgtttcccatccaaatttttttttaatttaaaattttgaaaattcttttacacgaaaattccaagtaaacaaaattttttgaaaaaatagtaattcttcctaaaaagttgagaaaattgttgaactttttttttaattattttaagttaaattttacaaaaatttaagttttttacactttcgagggtggggggacgtagtgcaccatggaaaatgtttatacccgcagctggaattgactcgaaaaaggaacactttctccgctggagcagcatcgacatcatcggacgcgacaacaatatgaggagggtcctaaaaagatgggacaaattggcaaaaaaaaatcgatttaaaaaagttaaaataatttttttatattacaaatcgatttgtgctccacgaaagggaactaagccgattctttgtcacttcatagtcgtggagaactaaaagatgaaaaatgtatacaaaaaaaaaacaaatttaattaattgtaagttgtacaaaatccggggatgcttttcgcccgcaaagggcccaaaatgtctgacctttcgctaggggggggggggggggg

SEQ ID NO: 41766 - DNA, 1160 bp, Heterodera glycines
atgtcaaaacccaaggacggccctgatcgatagtcattcatctttcgaaaattggtcatcacagatgcccacacactgtgccattacccttttcggtggtgaacgacggcaccgcgttcatcggcagctgcagtttaaagtgcgtctcgcgcaccatcgcggtcaccatgtgctccgtgccaaacgcatgcacatgagtggcactggcggcgtctgttggccgactattgctggtgtccgtgttgtcatccaccgccagattggtctccaccacctcggcacggaccaatgccttttgagaagcgggaaaatttgatggaattttgcgcaattttaaggacaagcggacccaatgaaaacggtggcctgaattgatcgagcaaaaaaaacgtaatttaagtgggccatctcaaagaaaagtgatcagagctgctaagcatgcttttttgcctggtctgacgagaaagcttgtaagcaggtgagacggcatgttttccttgttaccgaaattaaaaatccctaatctacagtagtcagtcataaagttttggacaaagcaaaaatctgcggattatttatccccaaaattctttatgatattgatggccatatgaatcaataacattcatttaggctgaattaaggcctaatttcccgcattgatcacagatgttctgacaataaacatgataatggcattcattttaatttatctcttcttgacactctctccctccacctgcaaacagtgcaattcgttctgggcaaattcgagccgtccgagcacgtcgtcgcccaatttgaacacattcctgaagatcacgacggatgcgatcagtcggccgccacttttgatctcgtagaaccgttgtttgcgcactgagcaaatttcttcaattcgattgaccgccaattcgacaatggaaaggctaagaaagggcagggaaatgtttaaagattcaaaaagtgatccatttgaaaaatgccattgcaatttgatctaaaccgggcgtgatcactgtttgattaggggaaactgtactgagggattacgtgtctcgagagcctataatcattgggattcataatttagagaagttctacattaagtcaagtcggagacccgttttgggatcattaattcgcctgatcagcatcag

SEQ ID NO: 41767 - DNA, 875 bp, Heterodera glycines
  misc_feature (26)..(26): n is a, c, g, or t
  misc_feature (33)..(33): n is a, c, g, or t
tgtaatgaaaaataaaaaaggtttcntgtacancgtccgcggaattaaacccaagagacaagcaatgaaaatcagaaggtttaacccttagaccaaatatgcatataggaaaaaaaataataaataatttatctatagctactagaaaccgaacaggatcagggcgtccggtggtgcttcggatcccgatagccgtgatcattcgaaaaaatgtcgggacaaggaattagtcaaaatctgaatattcctatcttggcctataccaataaaatctcaatcatggcaaattggtgtcactgacacgacattttcttcattctaccaattcattaaaatttatattaatttgttaaaattacagcacctttttatgtctgaaattacaattcgtggatttttgaatcagaaatcgtaattttctcacaaatttgaaccaattttttttaaatttccaatttttataccttttaggaatgttatttgaatttttcaatttttgaacatgcctatccacgcttatctatgataacaggaaacttttgtttttaaaataattttaattttatttaagtttttctatttcgttttttctgagttaatttttactatttgaaatcgctaattatccacacctgaatatctttgaaactgctcaaagccaacccggcaccaccgccgccacctgctccattttgttgtggcattttgcccacggcattgttttcagttggcccatttcgaatttgtggtaaaattggggaaattgctgaagcaacagccactggtgtcgtagtggtgccaccgttgttgttattggacgaagcattacgagaatctaaattactttattacatttatgcaattttttgactttt

SEQ ID NO: 41768 - DNA, 1222 bp, Heterodera glycines
aagcaattgatcgcaattggaattgacagggacaaggtgagtgccatccataacagttatccgaacggaccgggccacaaatgccaccaataataataatcgttgtgccattcattttaggccaggacatatttcgccccctatttaacgcattgtgcatttgaaagcctcacgcaagcattcacaaattcaatgtttgtctttccttttgcgctgcttttcccccgttcatccttttttaccccagggcattgatggaatggttcaaacggtgtgcccaccaaacgctgaaattgggccgtccgatggaatgggtgactccgcttgggctgcccgtggtgcagccatatgttacggtggacaaggagggcaccggccttgtgtttcggcccgtcccacacaaacaggtagcccaaccaccacacaccgcatgggcatgtctattgaagtttggacttgggaggagggggggggggagcggatgccatcccatggtgcaacttgaaatggcacacaatgtgccaatgtatgacataatttcctctctaattcaccgaacaggtcaacgcttttccgcccaattttgtgcactctttggactcctcccacatgatgctgaccgcgctgtgctgttaccgacacggcatcacttacgcttcggtgcacgactgtttttggacgcacgcgtgcgacgtggacgaaatgaacagggtaagacaaacggtggcagggcgaggggaggggggggggaatccacctgtgttgatcaatcagatcagttaaatgatttttccagatttgtcgtgatcagttcatcgctttgcatgagcagccgattaccgagcaactctcccgggtgctaactccacttttagccccttttttattcccattattctttagtttttcacttcaacatttttaccacccgaactgcgccaattaatgtccgtcgacgaccaaccgttgctgaacaaaattgtggaggagttcaagctgaacatacccccgggcaatttggacattaccaaagtgcgcgaatcgaaatactttttcagttgatcgtctctttttccttttcgccccttcgcttttttatgctcaattcatttcagatttcttttttggcaatcctgaaaaatgggggtttctattttcaattgttttttatgagcacaaaataaataagttaaattagaaacccctattcttcaggattgcc

SEQ ID NO: 41769 - DNA, 1481 bp, Heterodera glycines
tgtaggaaatgatgaaaaaagtggtgcattgtgctggaaaatcacatgccctggaactgttcaagcaatgccaagaagttgagcggaacggcggaatgttgacacaaaatcgcttaaggagaagaacacccgggggcgtgtttatgaaactgttcaacgaaagcaaagaaatcagcgaagagaataaggcacatttaatataattttccattattcaaataaaaattggcagtttagaaaacaatgcacgaatttgggacagaaaaacaacggcagagtggagaattaccaaaatggtgggagaaaatgaatcagagagaagaatacacacctgagaaggcaaacaaaattttttgtcaaaaaatacatccctaagaatggggcagaaaattttcaaaaatgcgtccttaagaaatgaaaaatttctcaaaaatttatctccaaaatttatttattatattttcttgtcgatagtttttgattttgaaaattatgtatatctgtaatggctgggcaaaatatttatggttataaaagaaaattttggattttagacctcctaaattcggaactttttgtcacctattttcccatttttagcatcctattttgcgggttttttagaacactaaaacctccttattttggcactttttagcatcctataaattgcatccgtattcataactagaaaagtgcttaacaacagccccaataaaaaacatgtttttcttgcatttcaggccacggggagctcaggaaaaaaataggcttttgcctaaaaatcccatccctaattatgactttaaaaaattgttattatttttaaaatttataaattaaattaaaaattttatgctattgcattgaaacacatttttcaaaaatcttaatagtcgcgccccataccccacctttattaagacccccacctgaagcaaaagtcttaatttactcatgaaaaatagttgtcaaaaaattaattttgaagtttaattaatttaaaaaataaatatcataaattcaattggaaaaatccttacaaaacctgacattattaatttttattcaaactttcgaaaacatttatttaactttgaaatattattaaatcgtttagttggactttaattcaatttgattattccacttaattaaatatttagacaaagaaaacaaaatgattttttctgctccattaatttcttttgttatttatgctttccatttctcatttccaatttcaaatgcaaatccattgatgggttaaattttggaaaattctattttaatccattaattaggtgacagacaattggctaattgcatttatgaaagaccataaaaaccactaatttgtcaatattcaacgcaagaatatgaggcttaccttggaattgtgcatttaatgagaaagaattggcaatgtgacaaaattgggagagaaatttgcagaatatgaacggatagaatgccaaaaa

SEQ ID NO: 41770 - DNA, 961 bp, Heterodera glycines
  misc_feature (10)..(10): n is a, c, g, or t
cacatataantttttttatcaaaagatttgaattgctccttggcgtctccatcgaaagttatgacgaacggctcgagaacatggaaagtgcagaaaatatgtactgttttcctggtgaccattattgtgtggctgtaatctgtacaaaaggttgatcagtccttcgtggtactttgcggtggatcatagtccgaaaatctgcatttttggattaatatcccgcaaaaaatattgagtttcaatcccgttgaattataccgggcattcattcaacttttagtgttttaatggacaaaattaagaaatcagattaggaaatggataatttatgggcttaattctatcagaaaattatttgtttctaataaaaactgatgaacttatttgaataatatataaattaattgcattttcggattaatctagcaaagaaaaaataattgagagattgagtttcaatccagcaactgttacgcaaacagtttgcattgacagttttttaatatttcggcaccaaaaatgatatttattgttgcttattagttttatattctttatgaattttaattgcatattgtacggtataatcttcgggaattaaattgataattgtctatttcttttaataaatcatttgtgattttgcttttgttctcagttggttcgcgcggatttttcggcaatttattggggttgtgctgccgaatatatgaaagccgatgtttactatttgggtataaaggcaatgctgaaggagaaattcggcaattcgtttaaatgttggcgtcattatggcgaaaaagatcagcacatggacaatttgaagttcacgcgtcctccagtgccgaacggtttgatgtgcttgaagggcgaaatggatacagcgggaaatggtgccaacactcgaggatcatgcacggacgaaaaacattattgcttcaaagcacgctgcgcaaaaggt

SEQ ID NO: 41771 - DNA, 605 bp, Heterodera glycines
ttacattgaattggtgtgcaaactcttttctgcgttcttttaggttactatttatttgttattttgttaaaaattttaactaggtttatttttaggccatttttataacctttggtctctccgggtttcctattggctgtacccctggaaaatatttgttggggcttcgtgtgatttcatgtcttgatgttcaaccaatagttggctcttcggatcgtgtgatggtcacctgcatgccgagtgttggtttcagaaggtgggcttttgtttggtctgttcctacaaaaatccctccactttttctttggctctccgattctcattttgtttaacctgccgttcgtgtccaaagactcaccaaaattttaaacaattggatcgcaaaacgtttttttctgttttttaatttttttttattttagctcactaactcgcgctgtgatcaaaaacatgctgaccacctttttgttccctctcagtaccgccttttatctgttcaatcataatcgtgctatttatgatttggctgcaaaaacaatggttatttctctggtctaaaagatcttttttatgcgttgatttattttttatttatagacttattt

SEQ ID NO: 41772 - DNA, 830 bp, Heterodera glycines
tggtggattgagtcctgttgattggaatgttggtggattgagtcccagtgattggaatgctggagggttgagtcccagtgattggaatgttggtggattgagtcccagtgaaatgttggtgggttgagtcccagtgattgaaatgtaggagaattgagtgccagtgattggaatgctggtggattgagtcccaatgattggaatgttggtgggttgagtcccgttgattggaatgttggtggattgagtgccagtgattggaatgttggtggattgagtcccagtgattgaaatgttggtggattgagtccagtgaaatgctggtgggttgagtcccagcgattggaaagtcagataattgagtctcagagattgaaatgtggtgggttgagtcccagagattggaatgtcattgaaagttggtgggttgagtgagtcccagtgtttagaatgccggagatttgagtccattgtttggaatgccggagatttgagtcccagagattgaaatgctggtgggttgagtcccggtgattggaatgttggtgggttgagtcccgttgaatggaatgttggtggattgagtcccagtgattgaaatgttggtggattgagtcccagtgattggaatgttggtggattgagtccagtgaaatgctggtgggttgagtcccagcgattggaaagtcagataattgagtctcagagattgaaatgtggtgggttgagtcccagagattggaatgtcattgaaagttggtgggttgagtgagtcccagtgtttagaatgccggagatttgagtccattgtttggaatgccggagatttg

SEQ ID NO: 41773 - DNA, 1083 bp, Heterodera glycines
ctctttttcgctgctttgtccctctttttcgctgctcttctctctttttcgctgctttgtcccgcttcttcttttaccggtggagacaatggcctaaattaagcgaaatttgatttattaaacaaaacaacaatgttttattatttattgctcacccaatgcattcggcaccattcaaaaaaatgttgaaattgttcaaatttttgtctttccgctgaatcgccgccgtctccccaattttgcatcgtttcattatccattggttgccccaatcagtttcgtttgctttgatcagtgtcagcttttccttgttctgtccgttcaccaattcaaatggcacaattggcgtttttgactcgtcaacggcaagctgaattttgtagctgacgcaagtggtggccttgataaatttctaaacaatggaaaacggggaaaggcaatcagaatcagttgcttaacaaaaaagtggccacccctctttgaaattgatgacccatttgacatttggtggattcaaattgcaacacaatcgcttcggttttccatcttttctcggagtgtgcaaccattttgtcaacatttggccagcagttggaattgcatttggcccatcaacatgatcagcagcgatcacagcggggaacaaataaccggaatcgattgaattcaattgatcaagatcagtgagaagttttggcgaagtgcggcgaagcaaattgtacaaatcacagccatcggtaaaggacaaatgatgaatgtttggcgcaaaaattggccaaatttcacgtgcaaaaacatcccaaattggaagggcataattgtagttgttgccaatatacaaatccaatttggtgccatttttagctcggaaattcttcgtttaacgcacttattcgagtttagaaatccttattttagaggttcgcccttaaaataagtttttgcacttattttagcgttttatgcttattttcaccctatttcgcgatttttaaattttttcctgtaaaattcacaaattttttaacaaaaaaacaatgaaaaaattttttttttgacgcgatcactttttttggcaacttg

SEQ ID NO: 41774 - DNA, 885 bp, Heterodera glycines
atttacaggtatctttttactccttttctggcttattcattgtttctacaacaaaggtactcgccccttcattgtctccgcctcacgaacggcgtgaattggccggcaacactgctgatgagtgccgatcacgatgtaagagttttttctgcagcgggtcccaaagggttggtgggggcgaggggtacccgccggggttgggtgtttaccagaatttgcctttttcattcgtttacatttttaaggaccgcgttgtgcctcttcacacattgaagtacgttgctcagctgtaccatttgctgcgcacggaggcaagcgaatggcaacggaggccggtgctggcgcgcattgagacaaaggcggggcacggagccggcaagccaaccaccaaaacggtaacgcaaaattctcttggggaaacaggcaactgatactctctgtgctgctttttgttcagatcgccgaacttgtcgatttgtactgttttttgcagcgggtgctcgaacttgaatggaaagaggagtgatttgattttgcgatgttgtgcaaaacgtaattctatttatatgaaaatgtgtgtctttttctttgtttcatgtctataaatatgaaaaaacacgatttcgtttcactccctccctccccctcgcccatgtcagattctatcaacgaccacgaaaactcataaatgttttcaggctacaatgggtactattaccaaggcattgatcgaattgtacaataatacgaagaaaaacacaagggattcagattgaaaacggaacaagatattggctgcattcaacaagcaatgtttgtaaaaaaatgagaattttaaattgtcaaaaaatattcgagtccgtgttcggtgttcagaattgagcc

SEQ ID NO: 41775 - DNA, 1481 bp, Heterodera glycines
ttttcctgcatattctcgccagtgctcactcacctcccaaaataagtgttttatatgcgccctttggtgcatccaatgactgaactttctttgccaatttatccggatggcatttcaccattatatgcctaaatcgaccatattaagttaaggaattgaattaattcagcttcactcaaccttaatctcctcagttgttcttgggagggtgcatccattctgaacttctcgggcaacttctccaccagaatcggatttgttcagaagaagcgtcagctgatgtctctgtttgttgatttcctttagggccttagggcgaagtcctagggcttcgattgcgtgagcgttctgtttgaaaatggtacctcatttttcataaataaccaaaatttatggtcaaaatggcaagaagaaagttttttgagtattctggttatgagtattttaagatgaatttttttgcgcaaattaatagtgacagtaacaaatgtttattctggaaatctggctaatattcctttacaaatctcctttaattaaatttgaagtgcttggtctgtggcccacctcttcctcatagtcagcagcaccaacagtgttcagaattactgtcaaatcaccaaagagtcgagcctcgccaacagcacaccaaagaaatctttgcttaatcacttcggacattctttttcgtctctcttccgttccgtcctcttttgtgcttgaaatgaacaataatggttcacgaacggagagagccgacaccaaagtgacggcaaaaggaagaagtccgccacgaattgaactgatgacgaccttcgcaaaagaaggagtgagaggcagctgcgcaagtgattgtccaagttgtgtgatggtataaagcccctgaaaggacaattataaaaaacaagaaaagtgactcatggatcaacttcttgaactctaagcgcccctatgtgagaaagtctcagctcagaagatttgatttggtccaatcttggaggagtcgggaaaggaaaattgtcgattttcgtgaaattcattgctttcaacataagaatcaattggtcgatcggtttattaaggatctcaggagtagaatgatcgcgcatatcttcgtaaacagccgaagaatacaatctaaaccaaaatgcacaaatcccttcaaaagtcctaattttactatgtcacctgaatgcgtatccggactgaactcgtccggcacgaccggatctttggtctgcagacgcctttgaacaccatccgaccacaaaccgagaaactcccgtaatcgggtcatattccctcttcttttcccgcccagaatcgatgacgtaacggacatttggaatcgtcaacgaagtttctgcaacatttgtagaaactacacacaccctgaaaataggatagaaactcaaaaaagtccaaaaatgtcgaatccaacctagacccgtcatctggcggttcgttgaaaatttcttctg

SEQ ID NO: 41776 - DNA, 916 bp, Heterodera glycines
caaaatgtgcgttcaccaaaacatcgaaacggggcgaaatcagtgccaatttgaggccgagttgagggcggtcaaaaaagggcaggatgtccagccaaacatcggcacaaatccagctgaatttgcggggaaaagcatttggagaggctttaaaacagggttgccagatgaaaatttacaaaatcagagtatttgctaataaaaaatcaccattttgaaaaatttataccaaaaaaaagtcaaaaatatttttttgcagcgctttttccgaaaaaaattttttgggtagagggggctggcggtggagataggaaaatttttgaaaatttgagtgcaatttgttgatatttttcactaaaattgactaattttctcttttttgagccaattttattaagaaaaactaggcgccgtggggtgagaaaaattagatcatttataaaaaattttcactgagaattggatttttgagtgtttttttcaaaaatccgtaaactttctcaaaaaaagcggcaagcatcaacaaatgatcatctcaatatattaaaaatcagctttgaccccttctaaagcagtaaaaataaagccctactttaaaatgaaattcataaatttttaagccaacaaatttttgctcacattttcctcaaaatttgtttcattttccttgccactcgaacacttcgccgttttccgagtgacgtcataagtgaacccatcaattgctgctgctgttcatgtccaccaagtgcggttgaagaaatgaggcggcggttgtcagaagaaaacgttttcttttttgtgacgggcggtgccattaaaaataattctgtctaaatgcaaatgattactaattcaattttcaacaaaattcaccaactttttgtgactacacatattaattctaagaagccta

SEQ ID NO: 41777 - DNA, 1051 bp, Heterodera glycines
gcagcaatgcggtgaccgccagcattttcatcccaattgtgcccagcatggcccagcgggcacagctgcacccgttggcactaatgctgcccaccacgttggcatgctcatttgcctttgtgctgcccgtcggcacgccgccaaatgcgttggccatcggcagcggactgttgcgcgtctccgatttggtcagtcgatcaaccaatttgtgctgctgttcgagagttaaaatccgtaccgagaatagagactgaaaagtccaaaattccaagagaattttctcgaatcgcgtgactaaacactcttgaaaacaaattaacaaagtgccaacatactgtttaaatttggattttgttggacaaagaccgacaattttttttttttggttaattgtacggcttacgacaattttcaggataaaacacaaagtcgtaaaccatgacaagttgtactgctccgtttcgtactgtcttcaacaaaaaaaatgtcattatttttgtcaaagtccaccaaattaaacatttttacaattagtatcattcaacagcttcttcatctcgctatttaacatgcaaaattcaagaaaatttaccatgattcaaaaaaaaaagttatgacgattttttgtcaaaacaaacagtacgagtcggggcagtataagttgggtttcgtccaattttcagccaagcagtgccagtcgtagatggctatttgtttgggatctttctgaaatatggatttcgcctaattgtcgtaaatttcaaaattcccagattctatcgcttttccgtcggtacgctttgaaattcttaattttttgcagatgctctccggacttgccgtgtcggccgcttccgcgctgctcaccatcgcttatctgtccacttttgcgcctctcattttacccattgactgcttcccggaatgggccgcggttacgacggcgacggcatttgacgccaacggcacaacgctaattgccgagggggcggcggaggaaatgggcggaattgccgcgcttggccggctaataatggcggaggaagcggtg

SEQ ID NO: 41778 - DNA, 1270 bp, Heterodera glycines
  misc_feature (195)..(195): n is a, c, g, or t
cccaaacttctgtaaaaagtcatctggacgaacggcggggccctgcttccgtctggctacagtctcgagagctaatttggcaaaagcctcatttaaagcctacctcgaaacaggtacaataaaattcctaaaaaattatttgggctcctatgacaacggcggcatcaaattcgggttcagcgcagccaaaaaacnccattcagcagattctcagttggatacgatcaataacagtataaaaaactgattggtaaaaataccaccccaaacttctgtaaaaagtcaactggacgaacggctgggccctgcttccgtctggctacagtctcgagagctaatttggaaaaagcctcattttaaagcctacctcgaaacagtataaaaaactgattggtaaaaataccaccccaaacttctataaaaagtcaactggacgaacggctgggccctgcttccgtctggctacagtctcaagagctaatttggcaaaagcctcattttaaagcctacctcgaaacaggtacaataaaattcctaaaaaattatttgggctcctatgacaacggcggcatcaaattcgggttcagcgcagccaaaaaccccattcagcagattctcagttggatacgatcaataacagtataaaaaactgattggtaaaaataccaccccaaacttcggtaaaaagtcaactggacgaacggctgggccctgcttccgtctggctacagtctcgagagctaatttggaaaaagcctcattttaaagcctacctcgaaacaggataaaaaactgatggtaaaaataccaccccaaacttctgtaaaaaatcaactggacgaacggctgggccctgcttccgtctggctacagtctcgagagctaatttggaaaaagcctcattttaaagcctacctcgaaacaggtacaataaaattcctaaaaaattatttgggctcctatgacaacggcggcatcaaattcgggttcagcgcagccaaaaaccccattcagcagattctcagttggatacgatcaataacagtataaaaaactgattggtaaaaataccaccccaaacttctgtaaaaagtcaactggacgaacggctgggccctgcttccgtctggctacagtctcgagagctaatttggaaaaagcctcattttaaagcctaccttcgaacagtataaaaaactgatggtaaaaataccaccccaaactactgtaaaaagtcaactggacgaacggctgggccctgcttccgtct

SEQ ID NO: 41779 - DNA, 871 bp, Heterodera glycines
tccttccggaatagcttccctatagcctgtactttattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattacttcataaatattt

SEQ ID NO: 41780 - DNA, 1394 bp, Heterodera glycines
  misc_feature (1271)..(1271): n is a, c, g, or t
tgtattttgcaattttattttgaaaaactgcagaaaataataataaaaattttatatttcaatcacattattttgctgattacgaatggatttcataggaaattatataacatttaattcatttagaatgtcagagctacaaaacaatttgttctaaaatatttatgaaatattttttcgaaatttttttttataaattataagctgggaaattgtttcgctaaataataaagaaattatatttaaacaaattttattatattttactaaaatatttttctcaacagcaccgcactttgaagcatataaatcaaaaatgaataaaaatatttatgtatcagctttttaaatatttaattttttaaaaaatattggttattatttaattattatatgatttgttagattaattagtttttataataaatttgtttaatattgaaaacacttggctcaaattgatgtaaattcacttttactggtttttgccttcaataagaatactacttaaaatttttgtttttttattcctttaaggcttcattagcttttaatgttgtttttccattacttattttatatatcagatttgatttagcgcttacaataaggtagtttttttaatatataaattttatcaagtaaaaaatttattttatacatattttcatatttataaatatttattacaaaccaatttaacaatataatgtgtattattattttatcattaaaaaaatttatatacaatttataagaaaaacttttttctcttttttgtatgtttaaaaaccaactctttatttcatataatctttgacctatgaaaattcaaatcgctaaagtctttccaatttttttgatttaaaatgttgtttataaataactaaaaattgatacgatagtttaggttatataatgaaaaatttgttgatatatattaaataatttttttaattcatctattttatcatctagattcgaatacaattttcttttgtactttattctaacaattaactaatatttgaatttaaatattattttgcaactttttttatgatttttaaaattttatcgaatttttaatttttttataggtatttattatatacgctaatggttaaataaagcttaaataggtctattctcaatagcgcactcttgcaacatgttgacattgttaacaagatgacaatgaagattatttggtttttggttcatattttttatttattttttagctggacgcttaccctatcgttttctanaaattgaagcttaaaagaacaaacgaaaatataaaatttaaataaaatttaacttttatccacaattgcaaagtcattcatgttaattaaaaattcatattatcataatttaaccataaaatt

SEQ ID NO: 41781 - DNA, 1103 bp, Heterodera glycines
  misc_feature (49)..(49): n is a, c, g, or t
  misc_feature (52)..(52): n is a, c, g, or t
  misc_feature (59)..(59): n is a, c, g, or t
  misc_feature (91)..(91): n is a, c, g, or t
  misc_feature (96)..(97): n is a, c, g, or t
  misc_feature (100)..(100): n is a, c, g, or t
  misc_feature (104)..(104): n is a, c, g, or t
  misc_feature (110)..(111): n is a, c, g, or t
  misc_feature (115)..(115): n is a, c, g, or t
  misc_feature (120)..(120): n is a, c, g, or t
  misc_feature (122)..(122): n is a, c, g, or t
  misc_feature (125)..(125): n is a, c, g, or t
  misc_feature (1063)..(1063): n is a, c, g, or t
aaatttttatttttaattaccaaaagtgttatttttcttctaggtattnggntaattanttattatgatggccacccctttttgttgttgnagatnngantggntttggnntggnattgngntanatgacactgttgcatgtcgtgaaaacgactgatgcttaaaacaagaaaatggtggtggtgatggtggcacactcgtgcacagttttcgcgaactggaaatcattgccataatttggtattacaacgaacacattcgccaactttttgaatttggcgaagcattgcaaaacacaaatgaaacatttttaaaagcattaaaagaacacaaacaaaactggaacaagctgaatgacataactattgctaaaacgggacagttgtgttggctttacaaatttgcatattatttggcatttggtgctttgaacattgcaaatgccgagtgggcacggcatgttgccagcctggtccaagttgttggcagccctctgttgagtgaggttggaaaaatatttgcaattttcttgggttaatcagaaatttttgcctccgaatgggtgctaatgcttttcctaaaaacagtcatttaactcacttccgaaaaattcatgataattttaaaaaattttgaaaaattttccttttttctttaaatttttgcttgaatagtacaaaatttttaaaataattaatttagaaaatttttgttaatcaaaaaatttcatgaaatttaattaaaaaataagttttattttatcaaattttctttaagtatttttgtttaaagttggaatggatggtaatttaattttgataaaattcaaaattattataatgataatctatcatttatcagcttctaataactccatcggctgctgagataaatgatgggtttgactgtgccaacaaagaaaatgtagacaaattgttgcaaaaatttcaaaacaccactaattggatgccgacggtacatttcttttgcctccagcgtttgattaagcgctttaaacaggtgggaaatcataaaaaaatattttgattaaaaatgtccccgnattgctaatgaatggttaaaacgctttgactccttattgt

SEQ ID NO: 41782 - DNA, 1164 bp, Heterodera glycines
  misc_feature (1047)..(1047): n is a, c, g, or t
aaacggcctctcaaatgcccaccattttaaatttaaataaaattcagtttccataaaacaatggaaggagactttttgaggtttttttccaaaaaagcagttggtatcactgggttttttatgcaaaattttcatactccataagaaaattgcagactcaaaggagtccccctacagaaatttttctaatgttaaggtataattgaaaatttataaccatcacaacaaaatgtgttctttttaattaattgcactcaattttttaagttgagaatgaatccaatcagcgccaaaatattgaatgcccactctacgtcagaattggggctataaaagtggcgccgatggacttagaacacgcactgaagtgtaagtgggcgaaaaagtttctaaatacctaaataggattttcggcccaaaatgcgaatttaaataattttaaaaatgatttcgttttggccaaattttagatttagtgcgaccttaacaatacttggtacttgttaattatcttttcaaaaaaatttttgagaataaacttgttttttggtttttagggtcggaaaacccgattctggcatctattttggttccgggtttgaatttgggccaaaatagatgccagaatcggatttcctgaacctaaaatccctaaaagttttctttaaaaaatttaaaaaaatttttttcaatgtttccttgcccgtcccgaagaaccgcatggatttggcgaagcaatgcgtttcaatggtgactggccaccggcaattttgacgtgcggtgtgcgcgagtgtttcgactcggaaaacaacacgcggttgaccattgccgaagcagtgcgccgaggaattttgaatctggcgaccaacacattcgttgacacaaagaatggcacacagctgacccttccacaagcacatcatcgcggattcattcataaaccgttgactctgacggaagcggtgcggatcaaccttttggatgagagcgaacagtttcgagatggcgccaacagtcacacactgctacaggcaagggcgtatcaangggggagggaattccccacccccccgaatgaaaaattttttaaaattttccagcaaatggaaaattttttcaaatttcccccccccccaacgaaattttctaagcaaatttttgtaa

SEQ ID NO: 41783 - DNA, 1643 bp, Heterodera glycines
  misc_feature (1559)..(1559): n is a, c, g, or t
tttaaatatgtttttttaaaggaaaattttatagggaaatttggtggaaaaaaaaaattccaagggggtgccaaaaattttttaaatttacgaaatgcatcaacaccaagacaaataattacattttccttatttagcatcacatacatctcaaatgtataaagcaaggggtaaaattttcatttttcgattcttctacaatttttgtaaaaaattttatttagcaatttcaaattacctgcaaatgcatgccctatatgtcgtgcagaagtatcagagaatttcatggggttattaagaaaaaatgatcaggtaaaagttaaaaatatttttaataattattattattattattattattattatttattttaaaggcaggccgcccatcaaattcaaaaacagaacagacgaaatacggttatatctagggaaccaatttttaagctgaataaatgtttattaatttacctaattaataaataaattaaacaaaaaagtcagaatattaattaatttacctaattactaattagaatattgaacccaagatttcataataagcaaaattaaaatcgaataatgcaaaaaaaaaaatagcaaaataaacattaaaaatcaaatataaaaaacaagtactcactttacaaatgttgaaaaaaatttttttttacaaatttaactggaaaaatttataaatttaagatcggcaaattgctcttagcctatcgcattatgataattcaacggcaaatgacgcacaaattgcggaagcaatggataaagcgtggcaggagcaagcggatgccgaattagctagacgattggctgatcaactatagtgtaataataatttgggcagacaatttttaatgactaacaataacaagttatccaaattaataattaattaagaattaagaaaaaaaagccaaaataataattaaatgctcggtcaataagcagtcaaaaagatagatcagaacgaaaataaaaaaaaattgttaaccaaaaagtttttaacaaatctttttaattttgatgcaaatgtttgtaggtttgtctaaaataagctcgtttttaagcgtttttaaaatatactaaatatgaattatatatcccttcagtgaagacaggaccgcctggaaatttttagattttggtctgattttttttttaaaacccatagaaaataaaaaaaaatatgaaaattttattaataataaaaaaacgactaaaagtgcttaaaaatttgcagtatgccatctatgaagcctttgttaataacaacaataataatgttgtgatgaattaattttccttaaaaatttttttatagcaaaaataagttttatttattttaaaaattaaaaaataaataattattaattacacagaatttttgacgaattggacaattctcgagcaccgatgaacacaatggacactgagattttgaaaataaattacgctcttgaaaaactttcttttttgatccgtgctggtatcgttttgtaatcctaaatgggcaatcccctagcaattaacgaaaaaaattnctaaatgatttttcctcatacctttttcaaaatcccaaaattattttttttttatcgttcgttcctgtccataaattttttttt

SEQ ID NO: 41784 - DNA, 987 bp, Heterodera glycines
tacgttacaatgctctcgagcatgataggaggggctcttctcgagcgccatttaatttctcagagaatttttaaatttatcttatatccaagaaaaatgactatctcttattttgagaaattttatacgttacaaatgctctcgagcatgataggaggggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttctcagagaatttttaaatttatcttatatccaagaaaaatgactatctcttattttgagaaattttatacgttacaaatgctctcgagcatgataggaggggcggtgcgcaatcgccaattaatttctcagagatttttaaatttatcttatatccaaagaaaaatgactatc

SEQ ID NO: 41785 - DNA, 1183 bp, Heterodera glycines
  misc_feature (1130)..(1130): n is a, c, g, or t
cgggattttgcgggattccagtccgcaatccagcattttttggataaatccgggatttgcaggattaatcctgcgggaccaggtcccgcaaaaaaatttgaattccaatcccgcagcggggtccgaaaatttgaaattttcggacactaatcagaagcctccaagtgccaccgagacgttttgtgactgtgccgggttcctaatccggcttccaaatcttgacacaattgggcgtgaaacatgcggtcgcgcaccacgcattgggaacatcgaaaattatcatattaaaacctgccggattggtacaaatcaaattccgacgctcaaaagtttagaaaatttaaaaacgaaattccgaggcccaaaaatattatttcttggcacccctcggcattgtgacaagcggatttggcactaacaacagcagccggcccatgaataattgcccccgcttctcagatcactcagctggcacttgttcatcggagcctccattcggcgccggacagtgacgtggacgtagtggacggagaggaggagcacgaggaggaagaaacagaacatggaacagaagtgaataatggtgcccgagtggtagatgatgaaactgaaatgggcatggaattggagcaggagcagcaacaacaggaggagcaggaagaggaggaggaaggggatcaaatgatggcactgacaattgaccacagtgatgacgagggggaggaggaggagaagccggaaaaggagcgggatagtaatgtggaagaggcagacaccaatagtgccaaatttgacgacaacaacggcacaattgccgccgacaacggcaccaatggcaacaacaatccgttgcggttgctaatttcggcggttgaagagcagcaacgccaacaacagagggacaacaacgacttgtgatgctgacagacagacggccagagttggcaaaaacaggcacacaaaaccaaacaacaccgactttggcaccgttttttggcactttgcgctttgtggcgccaattttgtgaaaaattttgaacagattctctataacattttgtttactttactattcttatatacgagagccaatggaaatgggtaggccatggggcttgtgccgtcctccncctcatttgttttcccccgcaaatttatgccaaaacgcaatccatttttcatg

SEQ ID NO: 41786 - DNA, 1380 bp, Heterodera glycines
  misc_feature (1347)..(1347): n is a, c, g, or t
  misc_feature (1368)..(1368): n is a, c, g, or t
  misc_feature (1374)..(1374): n is a, c, g, or t
ggagccgatcagtaacaattccggagcggtaagcgaggggaaaagcgagtgccaatacggagggctgaagccaaagcagcattttggatgagggcaggacgacggcgacggcattgcaagtgtcgcaatgaaaaggcgggaagtgacgaaggaagtgggaaaacgaaagtgccatccaacggaggaagaaggcttttggaaatgtgcaggtaaatgatttgccgacattcgcatagctctgcccaagtgctgctcgagagtgtggcctcgggtaattctgggggttttcatggtttttctgtctgcgattctgtgttttgagatatttagtaaaaaacagctcaacgcatatacagctgttgtgttaatttgtgtattagtatgctaaaggatatcggtatttattcatagcaatttagtagagggaacaatttttttaggaaaagagttctaccggaagcatacaaactcgtcagggcaaaaatactcaaagatttggacgattgtgccaatctcagcttcacaattgattgttgggcaggtccatcaaacaattttttaaggtaattttaggcttcaagaagcggtatttcaaaaaataattaagcttgactggtcacggcgtcacaaaaaattgggtgcaaaagaattttgtactcgctgttcaccatttttccggccaacattctggcaatgcgattgcgtgcaatgtccgtaaattattggacagttggaaaataaacgacggacgagtgtttgcttttgtaaccgattctgcagcaaacatgcgaaaggtaagaaaaagttaattccaacccaatcagaaattaaggcattcactgaagttgacgaaaattttaacaaaattttgccattttctgacccgtttgaatggtggaagaagcatggaccaaaacttccaatgttatcaaaattggcgatgaagtatttgtcagcccctgcaacaagcgtgccgagcgaacagactttcaaagtggcgagggatgtttatgattatcgacgttcgagattaaagccgaaaaccgcagaaatgttgatatttttgaacaaggccatcccaatgttggactacaaatactgatttaattttgttggatgataaaaagttcataaaattttccataaaattttggtttagaacaaagaaaagaaattacgcaatttttttatatttataaatgcatttttaaaatttgaaaaaagcccggtcccgtacgggcgcccggtcaaaattttggaccgggcccgggacgcccggtaaaacgggctttttttgaacgggcggcccgccccggtcaattttcgaagcccggtcccgggcccggntccggtacttccaaaattccngtctcntataaa

SEQ ID NO: 41787 - DNA, 1118 bp, Heterodera glycines
tgcgcttcaactgtcaaatggaattgctgtttcaaaaattgcttctgctggtcataattccagccaaaatatcacagacggacaatggcaccaattagtgataaggtggggctgtgccgctttcggaaacggaggatttctgtttttttttctaatttctaaatatttaaatatacatatatgtatttatgaaaaaattgaaaaattttacaaaaatactaatctattcattaaaaatgaaaaactaatgtaaagactaacataaattagcaaaattgctaaaatggtggcttttgtgaaacgtcctagcactctttatatattggaatttaaaaaaatcaaaaaataggatcccatttttttatccaaaaaatcggagcaattttataatttaatttaaattttattaaactaacaataagtaaaacattctctcttagtcaaaatgccaaaggagaagctgatgtcatcgcattgtccgtagatggcaccatgttgtaccttagcaaagtgatcagtttttcgtttgcacattttggcatggacaaattggcacggatcagtgttggccgtgtgccggaacaggacgggtttaaggtggattaatcagtctttcaattgtttctcacatttacatatttttgaatttttaaattttccagggctgcttgcgcaatgttcgtgccgggcccttgccaccgctcattttccattcgctgcaaaaagtgccgagaatggccgatgcaatggcacaggcacacctcacccattttgagcttcaacaccatgaaaatgttgtgccaagcgggtgccaatcgtcaaatgtttggtgaatattgttttaacttttattggcataatgccaatagagccaaaaatttaaaaatgttttacagtgccaagaacccatgcctgaacggtggcacatgtgaggacctgtggaatgcgatgcgatgccaatgcgcgcccggctttgaaggcgaacattgcgaggttggtacggtacggtacggtagcactcgcggtaaacagcaattttttctttttaaaaattcccaactcacaattcggtaggcctaaagaaattccggaaatcagggactaaattctgtggttca

SEQ ID NO: 41788 - DNA, 1369 bp, Heterodera glycines
  misc_feature (34)..(34): n is a, c, g, or t
  misc_feature (56)..(56): n is a, c, g, or t
  misc_feature (72)..(72): n is a, c, g, or t
  misc_feature (88)..(88): n is a, c, g, or t
  misc_feature (92)..(92): n is a, c, g, or t
cagctcggtcctccgcaaacactgatttcagttnatatttagagaataaggagtgnaaatggtggattccanaaaaggtgaccaaganaatngtatcgaaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcggtttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattgacgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccggaaacactgatttcagtttatatttagaggataaggagttgaaatggtggaattccaaaaaggtgaccaagaaaattgtaatcgaagattaattggcgattatcagctcggtcattccgcaaacactgattcaagttatatttcgcgaagaatgagctgtaattttgccaattcaaccaaagtgatcctaaaagaacaaatgaaaagaatttcccattctgctaattatggtttaaataaaacctgttaagtggtgccgacggatcaggttga

SEQ ID NO: 41789 - DNA, 1028 bp, Heterodera glycines
  misc_feature (56)..(56): n is a, c, g, or t
  misc_feature (60)..(60): n is a, c, g, or t
caacccccgcattcgtacaactcctcggtagtgccataatggcttagcaacgccgncaancaacagcccccgaacctcaagaagcgacaacaataaaatctccgtgtcgtttctgcaataatttctcaattcttcatccaaataaaagggcgtctccttgttctcattgtacctgaaaaaaaagaattttattcaaaaatttttctattttcctaccatttttcgaattttataaatttatccttgttcatagatcccggcgaatagtcctccatcggtggcagatgttccaatcgtattccataattttctttcttgttgtaataataggggaaaaagggcttgtcctcacagtccaaattaaatgtcgccttcagcgactcaagcttcaccggcatcaataaacatgagtctctccaaatcagctttgaatgtttcttcgagttttgcactttaaattcataaattttcaatccattgatgagcggtaacgggttcttcccggtacggcagaggtaattaaaaacaaaatgacctaaaaatttaggatttaaaaatttagattaattttttttttcattaccgtcaaaacgtccggcgttatgtgcaaatatgtacgtatcgtaattcgtaaacgcagttaaaatccactccacaaaatccttggtcggctcatgtccctccgcctcgctccaatccttgatcctctcctccccacaaattttgcaattcgtcctgtttttgtcatcacagcattccgtacacgtaactctcaccgaaatataattaataacatgctccttctggtcccccttgtaaatagtatcctgcgacgtttccgaatcctgtaaaacaagacctattttgttgttttgttgtaaaacttacccaaacgacaattctatagacatcttttttctccttctcctcaatcggcattatataacatcccccgcttggggtcgtggctcacactacaaagttggcaataggtctctccgcattcatgttccttcttcggattaatt

SEQ ID NO: 41790 - DNA, 914 bp, Heterodera glycines
aaaaattttattggacgcataaaaattgatgggactcataaactggacttgagccggatttggcatgtcaaatgtggcacttttctccgttttaggcgaactcgcactgcccggtggaatgttgaacaaaggcgaaccgccgactgaagccgccgtccgggagtttagtgaagaagcaatgggagggcatcgacgggaggacaaattggaacatttttggaaaaaggggaaaactgtgtaccagggatacgtggatggtgaggaaatacgaaaaaagcgaacacaataataatttaattctaattgtaagaccaccgaaacacggacaacgcgtggggagaaacgacggcggtgaacttccacgacacggacggactcttggaagacatcgaattggaggtagagcaaacccattttagggataaagacacagactaaaacattttagggtggcgacgacgcagaaacggcacgttgggtcgacgtcaaccaagaactgaagctgtacgcctcacatgattatttggtgcacttatttcataaaatgcatgcaaatctcgcataaacgtctttttatactttgaccaaaataacaaattcttaaaatttattctatcatttgtataaaagttatggacggagaatatatttcatcgagatttcgcacaaaaattaagtaaaaaacaaacatttggtaaagagcaataaataagtcaagtgaaggcacaaaagcaccaaattgaacatgacgtcgttcgaatcaatcaacgaccgctgtgcggaattttgggtttttgcctgtcaaaatgagtaatgttctgaaaaataacaatggcagctgaccagtactgctcggcgatgacgaaaccgtcaatttatgagcaaattttagttgaatctccgaacgactggaa

SEQ ID NO: 41791 - DNA, 1255 bp, Heterodera glycines
  misc_feature (1151)..(1151): n is a, c, g, or t
cagtaaaataaatgaaaatagttcactgtagaaatcggtcactgtagaaatgttacagcaccttaagatgtacaaatgaactttatttttggaaaattttttaaaataaattcttattgttagcctttttatgcaataaataattaatttccaagtttacgtcgacactcaaaagatgctcacggcaaaagaattaatttttagctccttgaatatgtcgtgaaacatttattttccaaaagttaaatataaatttagccaatgcttcatgagtccttgcaaataaaacacttaattaattacctgttcctctgagacttaatttctttttagtttggttttaaaagcgcttataaaaggttagattattgaaaaattggctgaaaatttttggaaaatttttgattacagctctgaatttgccatttctgtcactatttttgctatttgcccaaattttaggcctttattctggtaattttcgcctcaaaaaatctaacaaatatttaattctgatataattacaatttacttttactagtttttctattgtattttttttaaatataaaattttaaaaagttaaaaaaattgaaaattacggattatggattacgggaaattacggtgtccttggacccccgtaattagggttacggatttctgtaattgcaaatccagttacttgcagccctgatttaaacccttaattacctataattaaagtgtccttttttgccagaacaacccgttgtgcaaccttcaagcagcgatgccgccaatttcactcttcgagtggacctttgatgcggacgggaaacaaacatatgatgtcagttatgtggacggtgccaatgtgccgatcagtgtacgtgtgctgaattgtcctggtgtcaatttcaacaaaaaattgggcaacagtttggacactttggtcgaccagttgcccgatgcaatgaaaatggatgtatttggtgtacgttttattggcacaattagggggtaaattagcaacaaaaaaaaaattaatgaaaagggtatagggctgatgctagtgagagtgcttatttgtaagatttgttattttaatttatttttaaatgtgtcctacccatgatttatagattttttatagtgtgcgcagaaaattncttaaattttcagccgactcgaaaattttaacactaatattttccatttgattcaatttttcaaaacttgggtgctcatttttggtcatattttttctcatact

SEQ ID NO: 41792 - DNA, 920 bp, Heterodera glycines
ttcaaatcgtctattttttgaagaatttcaataaatctttgtagttaattaaatggccaatcccactattatatgttgatgaacgactaatttggaacaaatttaattcattgtttaaaatcttgtgcagtccttcggcaatttgcgacaattctaaacgaaaaataacagaatttttaatattaattaatcaggcaaaattcgagagcctcgctttttgttttggcattagtccaaatgatgccaaatttcgtttcttacctctgcaataatcatagtcaattttgatggcatatgcaaaatatcgtacttgttcattaaatactctcttaagcaatgcttcactaaataatatcaaaattttattataagaaaaatgcactcaaaaaagaggtcgtcgcatttataaattttacaaaaacccatcacttgggtaccgcggatttttgtggcaaaaaccccaaataagaacttaataatggaaaatgtcgaaaagtattaaaaaatgtcgaaaaaaccgagttttttattctccatatttaaaaaaatatatcttagaagcctcattttaaatgggccactgacattgtgttgcaattttcaaagaagaaatttctggtcttctcatattccatatgccatgtatctccaggatagaagaagtcgacttgtcgaaacaaatgacgaccgaaatggacgaaaatgcaactgatttggccacactgtggcaaaccatcgccaatttttggcaacaaaaattccttcaaaaacgtataaacttctgccggttgttgcgattgatcattttgggaaattatcgtttcattttgaatttttttgagaatttggtgcacttcgaatggcgtcaaagaatattttgacaattgcagcacaaatttaaaattttctaaacatttaat

SEQ ID NO: 41793 - DNA, 852 bp, Heterodera glycines
cgaaggatgtctgtgttggccaatcggtccgcggttttttgggctcagccaacactcacaacggttaacaattccacccattccgtttcgcaatacgccaaatttatacaaatcttttagattaattctgtcgatcggtctgtcggaagtgaatttgcggatgattttgaccagtcaaatccgtccttcgtccatttgtcgatcactgtcgtgctgacccatcccgtcgctttgactttttttgtggactttttgaacgaagttggcggtcaaaattacatcgatttctacttggccattgaggtgtggttgttttttaagcagtgcgtctcatttggttgtatcaacagggtttcaacgtgtccatggagcatcagttgagggggttggcctcgggcgacactttggacagcgacgcgcgggagacaattcgagaagcggctctcttcatgtaccatcagtatctgtcacaggaagtgaacctctaaacaaatttggtcttcaaaagacgaagatgactcaggcaatcactcgagttccgttgagcgaagcaattgtcaacaagtttttggcccgactgcgcaacgacgaaccatcggatggatggtttgagcaaattcaggaacaggcaaataaaccaagcccaaagcgcaatccgatgcccattttgataatgaacaccccctgaagattgtcgaaattctgaagagtgaagagcgctttttccccgccttcaaaagacacgcgctgtacggtcggatgctcgaccaactcggaattaccactggagggagcgaagtcgctgccgagtcggccgaatcaggtgctgcccaatgagtcagaccaattaaa

SEQ ID NO: 41794 - DNA, 1011 bp, Heterodera glycines
  misc_feature (14)..(14): n is a, c, g, or t
aattattattaatntggttaatctaaagaaagctcataaataaacaaatttgttagtttttaaatcaaacaacgaactgatgaaaagggcaataaaagttaattaaaaccaattacaatattaaaaaaaccaaataaacaattttaaaattaattaaattaaaaaaacataaaaggtacaatttgctgtataaataaaaaaacatttacgaatcactgtaaaaaatttccaataatcactatctttaataagattcccgtaactagagtatgtaaaaaataataatttcattggtattaaaatttaaaaaatcatagtttttaaaactgatttatatatttaaaaaaaatataaagtggaatttaaattaaaaaataaaattttgcttttttaaaaaattttatttaaataataaataatgttacaaatttaaaaaaacatcttaaaaaatagaataaaaatttttctgtttttttatttatgaatattacttccaaaattttttagcaaaaaatgacagttttggtaatagataaataatattttttaataatttgttttttaatataaaatataggaaaactaagttatattaataataagtcaggagaaaggtctaatatacaaattgtggcaaagaattcaatatcatcgtaaactaaattacattattagaaattaaataaataaaacataaacgaaaaccgagctgatgacatattaataaatatattttataatgtaatatttattaaggtacatatttctaaagaatataaattaaaataataaatctattatgtatgaaaattcaaattaaatagaaaaagaataaataataaattcagtcaaaatatggtcatgttaataacttaaaagatatttaaaaattttgattattctataatctatataaaatagagtgttaactagataaagtaataattaaaatctatatatttattaattcttcaaatgccagagctttcaataataataaattttaaaaga

SEQ ID NO: 41795 - DNA, 949 bp, Heterodera glycines
atttttaggctaatccgaagcaaagcacgaatgaatattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatgcttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacagtatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaatattaaagaggcgaaagaattcacagtatcgtttctaatagggaaatattgacaggatattcggctaaaaacgggttgatcatt

SEQ ID NO: 41796 - DNA, 352 bp, Heterodera glycines
  misc_feature (20)..(20): n is a, c, g, or t
ataataaataaaaattattnggttgcaactctttaaccttttaaaatataatgtttcactaaaattattaaatttctgttttttataaatttacttaaccatttcattttgatacagaatatattttattttttacaaaaaatcaattaacaaaaattattaaattaattcatttcttaaacttattatcattttctattaattatttaatttacaatttattcattgtagtcttcaaattgtgcttgggattaggtcaagccattcaacgatcttttttctatcaaaatagttttttacggcgcgcttttttgaaaaaaaatttgggaaacgagggggggggggggtgggt

SEQ ID NO: 41797 - DNA, 281 bp, Heterodera glycines
aaaaaaaattttttgagaaatttttcagcaattttttagaaattttttgaaaaaacttagtagttcattataaaatttctaaaaaattgcagaaaaatttctcaaaagattttttttcttgaaattttcgtactaggaatttttttatgaaaaatttctaggtttgaaaattttttttaaaaaaatttttcgggggggaaacgacgtgggggggaaacgacgggggggaaacgacacgggggggaaacgacgggggggggaaccggcgggggggaaacgac

SEQ ID NO: 41798 - DNA, 525 bp, Heterodera glycines
tttcatttttaggatgatggctccattcatttggtctcccgtcgcgtttttgtcggctccaaatggcactcccttccgatcagttcctctccttctttgacagcttccgtggacgcttttcgcgtttgtctgtgccaaaagcgaccaaaactgtttctggtgcccggcaaccgcccgtgcggtgcgcattcggcaatttgccaatgatcggacgattgaccgattgaatgccgatcaatcgaaggacgcggcggtcattgtgtcaataaatttgctcaataaaatatgctttcattcaaaatgttgtgtttgtttagccatttgtgttctttaacccatccgaatgactcattagcggttaattggctgacctttccttttatttattcaaattgaatgattctctcatccaattccccattttttgctgattagcattagcttttccatttagcaatccaatttttctgtcaaatctttcgtctgctgatggaattgctctttaggggacctcgtccatccccc

SEQ ID NO: 41799 - DNA, 961 bp, Heterodera glycines
aaaaaataagaaaaattcctattttacaatttttttagcgttttcttattttttcttaaatttccgcgggcgcctgtcagcaccaggggatgttaaacgacgcccaaaaaaaatttcggaaatcggaaaccggaattacggggctccaaaaattccggaaattggaaatcggaactcccaaaaaattccggaaatcggaaaaggaattccgacacccaaaaaggccggaaatcggaaatttaaaaaaaaaattttggcacaaaattacgaaaaattttataacaaattaacaattgatagatacaatggctataatgagattagaatttttgaaaaattcgggacagattcaagaattagacccggacaggtgcagaatttaaaatccggtttttccggactatctgatccggtttccaaaatgtcgacatggataaggatttctcgaaaaaaagaaagacgataaaagcaaataaaatttcaataattcttccaaagcttaaaattaaaacagcgaaaagagcacagtaaaataaataaataatattatttttattcaccacgataacttaaactctttcttattcatgtattttcggcgtatcttttgatatttttaaggactcaaagggacgagaccagtggtgccgataggcgccaccgggtagatttgaaattttttccgaaaattttcgaaatttagcctaaaattccgaaaatcggaattcccggctcccaaaaaattccggaaaccggaattccgtacccaaaaagaccgtaaatcgggattccgtgacatttctcgttagcaccgccggtcactcatttcttttgaaaattaaaaataggacccataattgactattttcggagaaaatctgttaataaatgggccataaaaatactgccataaggaaaaaatagctaaaaaatgcaattttaacctttggagtgtgtttta

SEQ ID NO: 41800 - DNA, 1462 bp, Heterodera glycines
  misc_feature (80)..(80): n is a, c, g, or t
  misc_feature (1435)..(1435): n is a, c, g, or t
aaagggcaaaattttatcattttgtaaaaaattaaaataaattatttgtgggtgaaaattgacttaaaagctttttaatnttagttgggaataaaatatttgattaattggttctaataagcgtagaaatatcttgacacactttttttgttgatatttgtatctcaacaaattattctgctgaagtggcaaaaaatgcgagaaaaaaaaagatatttttgccttcattgaattaattaaccttttttaaaacaatattctcaatgtcaaagtaaaaaatgctgcttcgattttttttgatttaaaaatgaaaaatttttgagcctcgagactttgacgaaaaatcttcgaaaacatgactacgaaaaaatgaaaaactcctgatacaactcttctcgaatctaaaaaatctaaacttttttgatttgacgaattattgaatagggatgatattttcaagtgaaaaatgaatccgatgaatagaagttttgaaaaatgcacaacgctgacgtctgttgcttttccgttagctgttttgtgggaaatgaatgatccaattaacttttcttgaattaattcttttgaggctttgtggtttttgaagaatgtatgaattacataaaaattttaaaaaataagtcgattaacaaaaataatatacgtaaataaatttcttcatagaaattaattttgattttcaaatttctttagtttttagaattgctttgctatcctcttttattgaatgaatgctggtggataacaatggaaaattcgcttaaaattataaattaaaaattgattggttaatcaattataaaaaataatacaaaaaattaattgtgtaagaaataaataaattaatattaaattgccgaagcattttctcattttattttcacattcattttaatgccttttcatttcatttaattgcttctccgttagccaataagcgatcgatctgactcctccccttcccatttatgtgtatttaatatgcgattttcccactgctcatcacttaatacggattttgtatttttatgtaatttaatgcttttatttaattgtatttaatctgtaatactatttaaatatttaattcctttatgcatttattttatgtaatcgttttaattttatttatatttattttccatgcttttcctgaaataaagccattcctaacatggagttggatttgggagggaaatgggactgatcaccccaggaccccctcataacaatgattggaattctgaggcttgggagtccaaagcctaattcagcgcgttccactggcacatgtgttactttatttatgctttttattgtgagcaatttatgtaaaaatgggaggcaataggaacgggtcggggtcattttggcgcagacaagtttaaagattcataactttttttaattcgaccanaataaaataatgttgatattaatcaat

SEQ ID NO: 41801 - DNA, 1150 bp, Heterodera glycines
  misc_feature (1079)..(1079): n is a, c, g, or t
gcaacggcaatcggactgggcaacaaagttttgtcttaaatattttaatttcagacgtttttgggattggtataaacctgatgaaaggtccttgcgttaaatgtagtacctgacggaatcaagaccccgagaggatttgaatcttggggtcgaaatcccggtaaaattttttaaaaatcggcgccatgagaaaaaaaaactagccattttcgccaaattatggccatttgagacaaaattttaaaacaaggaaattagaatctggcggtgccgttaggcgccgccgggaaaatttagaaaatttagggtatttcattaagaaaaatagtaaattaaaaaaaaaatcatttcaggataggaggcggcattccacccctggaatacggcctatttgccgacctatgtgcctaaggctcgttactcggttttgccatttttagaaaattgcttaattttaatctcgactaaaataacacccttatcttggatcccgacaaaatcgagattgaatctcggtaaccctacccctggacgatgccaatcccgaattccgatccagactcaaaattccaggttatagttaaatgattcatattttttgcagtatgctattccgtatgcccagctattgctggaaccagtatttgtctgtttttctgatactgattcgcgtgttcggtacttcgcttgtgaggtctgttttttggaaaaagaattgctatgctcacattagagtttctcttaaggcactttacaacattgtaaaaattattaaaatggctgccttggatcactttgaccaactgttcgatattctatggaaattgtcatcggaccctgatcaaaatgttcgaaatggctccgagcttttggatcgacttgtaaaagtaaacagaaaacattaacataaagtaaataaaataagtttcaggaaattgtcgtttccaagaatgacttcgaacttgaaactttgattttgctaattcgagaacgaatttactctgttaactcatcgaatagacgctttatcatctcatgggtaatcacaaacacttcttcagtcaggccgtatccagaanaaaatttcggggaagcacccgacgagtttcttctaaactgcaatttttgcctgggtgcaaattttcaaaaa

SEQ ID NO: 41802 - DNA, 609 bp, Heterodera glycines
tttttcggcgcgaccaattcggcgccctatgtaaaatagctttttcggcaccagtgtttaaaaatcccaaaaaattttcaaaaaagttttcatttgctgcctttgattgtgcatataacttatgccattttctttcaaagtaccgtgctaatgcaatggtgagcaatggtgcataattgtggttcctaattaacttttattttttggttcaaaatcacaaatcggggggtttcgagggtgctgattacaatctgaccataggtttgcctaaatcagaaacccatattcaaatttcgaatatttatattggattggacttaaaagttccaaactgaccagcaggtattcgaaggtaaataacactgcaaaacaattttttttactttttctcaaaattagtgtgtatgtagttgtcagcaggaaatttttgcttttgatagggtttgctccagattttgaaattttttcaaaaatttttcggcgccgaaaaaggcgccgaagtggccgcgccgaactggccgcgccgaaaaagcccgcgccgaaaaagctcgcgccgaaaaaccccacgccgaaaaacccgcgccgaaacggttgcgccgaactggccgc

SEQ ID NO: 41803 - DNA, 933 bp, Heterodera glycines
gtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaacccgacattttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagaaagcaattttcaaaccgaccttttgtagggctcaccgcagatagaatgcgtttttggggaaacccacatgtacaacggtgtagaaaaa

SEQ ID NO: 41804 - DNA, 653 bp, Heterodera glycines
gggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttt

SEQ ID NO: 41805 - DNA, 1129 bp, Heterodera glycines
tttttgtggcatagagaataatttaaaaaattccttgtataatagaatggccattattctcggcgctcctctccccatgcggggaacatttgtgtggtaaaaattttctcgaaaaaaagagatccccatttttgtggcaaagataatattttaaaaaatcccttgtagaatagaatccccattgttctccgccctcttctccccatgggggcaacatttgtggggaaaaatttttctcaaaaaaaagaaagccattttttgggcatagagaataaatttaaaaattcccggtagaatagaatggccattgttttccggccccttttccccatgctgggaacatttgtatggtacagaatttctcgcaaaaaagagatagccatttttctggcatagagaataaatttaaaaattccctgtagaatagaatagccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatagccattgctctccgcgcccctctgcccatgctgggaaaaatttctcgcaaaaaagagatagccatttttctggcatagagaataaatttaaaaattccctgtagaatagaatggccattgctctccgcgcccctctgcccatgctgtgaacatttgtatggtacaaaatttctcgcaaaaaagagatagccatttttctggtatagagaataaatataaaaatccctgtagaaagaataggcattgctctccgcgcccctctgcccatgctgggaaaattttgtatggtacaaaaatgtctcgcaaaaaagaga

SEQ ID NO: 41806 - DNA, 975 bp, Heterodera glycines
gagaattaattcacaatttccgcagctcttacggtaatggaaaaaattttgaagagtctctccggaacggattagcatcggggttgcgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacaagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacg

SEQ ID NO: 41807 - DNA, 954 bp, Heterodera glycines
  misc_feature (800)..(800): n is a, c, g, or t
  misc_feature (886)..(887): n is a, c, g, or t
cggtttcggtttttttcggtttttaaccgaaaccgaccgaccgaccctcttgtccggtctctaataaataccaatgtaattttttatttttataaaattgtaaaaataaacatcagatcaatgaacaggtcaaacaaaaattaagaataaactcaaaaaataagatcaacaagaaacaacgagacaatgggcaaatccgctggtctttcctttgtccgtccttctctctctttcattccttttctcctccaactttgctcttcttcttcttcatctttttcgacttcttttcctcgccgttttcctccactatttttcgcttcttctttttcttcaactgttgttcgccttcattttgtaccaatttgttaatttgctcagcaaaatccattttcacccgtcgaacttttttcttcgttttcacccgttccgccgtttctccgccgtcggtcccttcaccattcattgcgccgatggaggccaaaatgctaaaaaaagcattaaggaacggctgtattgtattgcggttgccttgtaagaaaaggcaaaaatgatttggaaactttcacttttaagtttttaaacatttcttattctattgcgtttgaaggcttttccgaatggttaccccacatttgcgcctcgggctttttcaccccagacatttgcacattaggaattgaaaaactcagatttgaacccgattttagacaagtgcaaatgtctggacacgttccgaatgactttccttgcacaaacgttcctccaaattcactcaccgttgcttcttcttcttctgncgtctctgccgctttcggtccgtctccgttcggtcatctgtcccttttcgcgcacttttcacgcgtcgcttcacttcctcccgtgnncacaattcacctctggtcaaccgctgcttgggtccacttcctttataagattttaatgacttgcact

SEQ ID NO: 41808 - DNA, 256 bp, Heterodera glycines
ctccatctccctttttgatagaaaaagcatcagagtgcctaaactaacatgtaaataaaatttggtgcgctttagagcactttctgaaaaatatttatgaaataaaaaaatcgatttattcaagtgtccgtttggggtactcaacaattatggggagcaaaaatccaacgcagaattaaagtacagactatagggaagctaatcccgaaggattcggtctccccataaatctgggcgcatcggttcggggggactg

SEQ ID NO: 41809 - DNA, 1290 bp, Heterodera glycines
gtcgtcaattaacttgtttatttatttcagacatttctgccaatttgaatttaaaaaatgtttgtcttcctaaaattacctagaaattttcgaaattgtttttaagaaaaatactttaatgctatgctattttttcacttaaatcttatatttatcaccaattggtcaaggttgaatacacgggtgccgtcgacgacattttctatgctggcacggggctgttgctgttgaagaacgcggactctgtgcaaatgtacgacttgcagcagaagcgtgtgctggccagtgtcaaggcaacaaaggtgttgaacacaaaactgggtgttcaaaattactgaaaatttgaaaaaaagtgtttgaaattgaagttttatccaacgataaacctaaatcgtcactctgtttccgcaatgtttttgctttcaggtaaagtacgtcatctggtccaagaacatggaatgcgccgctttgctcagcaaacacaccgttaccctcgtcaccaagagattggaggtggcgttgtactctttggtctcgtcttacaatcttttttctccaggtgctcggcactgtgcaggagtcgactcgggtgaaaagcggcgcttgggacgcgggcaatgaggcctttctgtacaccacctccaaccacatcaagtacgcgttgaccaccggaggtgaccatggcatcatccgcaccatggatattccgctgtacattttggcggtgcgcggcagccgactgtactgcttgagcaggttggagttgtaaattccttttttaagacatttcggaatgatctttttgcatttattagaaatttttaacttaactttttacctggctcaattttttcatcctttttatgtgatttgttacacagagaggcgtcgcccgtggaattgtccatcgatctgaccgaattccgcttcaagctggcgttgacccatcgtcgttatgatgaggtgttgaacatggtccgcaatgccaatctgctcggccagtccatcatcgcatttctgcaaaagaagggctacccggaggtggcactgcactttgtgaaggacgagaagacgcggttcggactggcgctggagtgtggcaatttgcaagtcggtttacgagtagaaaactcaactttagatgggttttgacataaactgatttcaaccaattatttttaatgacaagtttcaaactccaaggacttgaaattcttcattgaaaagcactctcattttttattttttggtatgtgatggaatgaaatgcattaattttgacaaaatctc

SEQ ID NO: 41810 - DNA, 1087 bp, Heterodera glycines
  misc_feature (1069)..(1069): n is a, c, g, or t
gaatcaactcatttacgtgcctcattccgggtttttaatctggagattttttaagctttttttatttttagacttttctgaaatcaacacttacctatgtcgataaatggttccgcgttgagcgctttccaacggatttggcatgggtttctctcaaagaaaaaaaagtttctcgcgccgaagtgatgagtttggctgaacagattgctccggaagtgaacgacaatgagctttttgacgaaattacggcgctgaatgaaatacttgaaaggatttctgacgagaaatttggtgaaatgaacgcagaacagaagtggatgaaggttttcgaggcggaattacccaatcttgtgttgctcgtcagcaaaattctttcaattcccgtgtccaatgcatgcgtggagcgcgtcttctctctttgttcagctcagtggactgatgtgcgcaatttattgaaagttgaaaccatgaaaagtctggcccaaatcaaattgaattacgatctcacttgccccgaaatgtatgatttgctcatttcctcaccaaaattgttaaaactgatcatgggaggtgaaaaatataatatttaatacatttttgatcgaataaattgtaaaaataacgatttgaagcaattttgcaaaatgttctgattttcgaccccaaaatctgattttttggacccgatgttctgattttgaaaatttttcgatccgaaccctgttttaatgtagtctctgactcattgtctgctgtttcttcatgtctatgttttttaattttcgcttcaaactcttttttttttgttagttaggcaatttttgtcaaattgttgatatatgcccaattcaaattgctcttaattttaggccattgtcgcccccagcggacgaaagaaaaagaagcgtgtcaaagcaacattgaaatgttctcgacgactcccgggccaagtggattagcggaatgagtgattattttgaaaatgtcgtctaattgcgtggaaattaattaattatatttgagaaaatgatcggtctcactgtgagagaatttgatttgattctctcantttattctctccgaaatg

SEQ ID NO: 41811 - DNA, 950 bp, Heterodera glycines
agagaaagcacagtgatgcagcacatttattgatcaatcggatgggagaaaggacagaattaagaccaaagaagagattcggacgaagggcaaaagtgaaaagcatcgaagggaaaaaaagggtgaggaaaagcataaaaaggggagagggaaaagcatgtaattaattaattacctgcacacaaaatggagtccgcccttggcccggtgatcgcttgctctctaatggccaatccgtcaggcgacaaatcgtacagccgattcattgcgccgacgtaaagccgacccgtggaacggtccatcaccttggcaggggaaaagcagggggtttagtttcggcatttggacaattgttggctttcataaaatgatttgtgaaatgcttttctcccattgctgaggctgaccattcgctgcagctgaaccgtctcccgtccttcttcttgcgtgtcgcgaaagacggccaaaatggccgggtgctgctgctgattgggcggaggatgttctcgatggaataataatgccgaagttgaggaaaatgatggcacaatgaacaaaataagagaagtgatgaaaaagaggagaagcggtgacgaaattggcgaatgttggggtggatgccattgttttgcggttgcttcggcttttgcttctgttggcatttctctccccgtcctccgccatttccatttttgccgttccctcgtcgaaatttcgcccattttccgccgtttgtccgctttttctcttctcgcggatggcctccgccgttggctcaaccgatgtgacgaagaagcgaagaaattggtgaaagtaaaggaaaagtcgaaaatgttcgaatcggaaggcgaagacaattcggaaacggaagaatcatccaaaaagcgactgcagcaggggcagtcggacggaggggggagaagcatttcaggggaggggaaaggcagcag

SEQ ID NO: 41812 - DNA, 262 bp, Heterodera glycines
tataataacgctgcggacatctacatttttgaattgacattaattggtaattactctttctttttctccatattgaccatcatactcatactcctccttcatttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 41813 - DNA, 1359 bp, Heterodera glycines
tcttcattgccgcgtcagtatttttggcaattgagtctgtcgggtctggcaggccaaaatgcacacagcttaagttaaagctgctgtgcagccgccaatcaaggtcggctagggcttcaagctctgctgctttatgctgtgccggagtaataatgccttgcggattgtacatttggtctttgtacttgttccacaattctatggcattactcggctggccatagaccatgatgctcacaaaaagccatctcatctgatctggccagcgcgacagagctgcctccgccagagttttgtcccaaattttgccgtcttcaagaagaccatgcattattgcagcctcagtgaatgaggtacaaagcaacccattaaccatcttaagatgatctggatctccaggaaagtgacgcataagtgaatagagcgcgaacctttccgggtccgatgggggtacaggaacaattcggccgataggtggcctttttatttgctgccttttgtacaggacccatttgtcctttgcccatcggaactgctctgggactttttcaaaaagaatgtccttaaactttgggtcattcttccactcattttgccattgtttccaatatgctgaacaatgcgtttctggcagttcgccttgctggatttgttgagctttgctcaccagctggaatgccctatatacaatgggctgttggtttggcaaatgaattgccaatttgacaacatgatgtgaaagacgggcaaatggcattgaatgaacaatggcatatgcttccgttgcaccacggaagttcatcttggcatattgagccggctcatcaattccgattttattgccggactcttctttgcactcgacataacaatgtcctggccctttaaacgggtacttgagtgcgtacttaatattcgctttgttaccatatgcaaacagtacattatggtgtactcggtaacgcagcagaacataaggattatacggcacgacatgtgagttgtcgtatattaggccgtttacctctaattgggcaccaccatcagatggtgaaggccggaaatacatcgcgggcctatccgggcgtaaaacagtacattttgagtaaggggctgggaaccccttcttgcaccgcccgtaaattgggtcgctaggaccacaccaactgtcactgcatctgtgcagttgcatatgcattgtttcgcggatttcgcgatgcattttcgcaatgggcgtgtcgtcatctttatcgggcaaagatggaatgtgcgcccatatgtattcctgaatgacatgtggtactgcgtccaggtcagtatgggcaacaatgtgagcgtgtgggcctcctcgaccttgga

SEQ ID NO: 41814 - DNA, 769 bp, Heterodera glycines
agaaatggagcgatggtcggcggaggaatgctttttctttttttttacgggcggtgccattaaaacaaataataatttagcctaaaataaggaattttttgaaaaaaattagcacagaaaactaagcgtgcagttgtgtttcatccaaatgtatgaactcatcaaagtcaatgttcttggaaggggtcgagtagcggacccgccgattgggccccgccgattgggccccagtacgattgggccccgccgattgggccccatggggcagccacttttttttcgtttcacatgttttaaaaaaattaaattattcataaatttattaagtatgaaattctatccattcttacaaaggcaataactcgtacaatagcagttcgtacaatacatttttttacaaaattaagcttatagcttgggacaaatctaacaagggaaccgtcagaactgtgtcagaaaatgcatgtatcataactatttgatagtgcagggcggctactctgaatttttaatgttagcggtgtgttgaagccaaatagaaaagttattggacctcaaaaatcaaaattttgactgtgttttccccttcagggaaggtggtgaagtggggaaaattaaaaaaaaacggtggatcagtgggttaaattcctattttttcggaggtccaggttcgaaaccaacatggaaaaaatacattttaattaatgggcagcaaggctaacgattaaaaaaaccatttatttaaaaaaatacataggtaataattttt

SEQ ID NO: 41815 - DNA, 1524 bp, Heterodera glycines
  misc_feature (1441)..(1441): n is a, c, g, or t
tcggctgacccacattcaactgctgttcacgtggttattattctccacttcagtcttcaaggatctcacttgaatattttttactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctcgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgngctgcgatcccaaacacccgactccagacacgtaaagatgggtaggcaccgccagttggacaggtcttgcaccttctctggag

SEQ ID NO: 41816 - DNA, 588 bp, Heterodera glycines
tccattagcacatccaatccatccacccatcctccactctttagcataattttcttcacttcattaaccccccccccccctcccgaaattatgtccattataattatcattgttttacaatattattagtgttgttctgtatgctgctgatcagctaattatccaattatcccctcattatcctcccaccttttttccatctctccctcttcttctttttttatttatactcccaatgtgtgcgaatgtttgaaagtgtcgtcgtcgtcgtccaatattcttttcttttatttccatttccatcctcttaaattccccccccccccattcccatcatctcatcattcattgttccccctttccccgttcatcctccatttcctctgtgccgttgtctgagtgagtgccaatgccaatgccatggaaatgcgttcccatcacagcgcagtccaattttttttaccccacattgagttgtccatgatcttcatgtccaaccatatgtaaatatttacttttttctcaaataaatcaaattatactactgctggtgcggtatttataattttccccgattcattgggatgg

SEQ ID NO: 41817 - DNA, 1270 bp, Heterodera glycines
  misc_feature (62)..(63): n is a, c, g, or t
  misc_feature (68)..(68): n is a, c, g, or t
  misc_feature (71)..(71): n is a, c, g, or t
  misc_feature (76)..(76): n is a, c, g, or t
  misc_feature (78)..(79): n is a, c, g, or t
  misc_feature (86)..(87): n is a, c, g, or t
  misc_feature (89)..(89): n is a, c, g, or t
  misc_feature (102)..(102): n is a, c, g, or t
  misc_feature (106)..(106): n is a, c, g, or t
  misc_feature (120)..(120): n is a, c, g, or t
  misc_feature (130)..(131): n is a, c, g, or t
  misc_feature (145)..(145): n is a, c, g, or t
  misc_feature (148)..(148): n is a, c, g, or t
  misc_feature (160)..(160): n is a, c, g, or t
  misc_feature (179)..(179): n is a, c, g, or t
  misc_feature (192)..(192): n is a, c, g, or t
  misc_feature (218)..(218): n is a, c, g, or t
  misc_feature (220)..(220): n is a, c, g, or t
  misc_feature (229)..(231): n is a, c, g, or t
  misc_feature (303)..(303): n is a, c, g, or t
  misc_feature (342)..(342): n is a, c, g, or t
  misc_feature (392)..(394): n is a, c, g, or t
  misc_feature (398)..(398): n is a, c, g, or t
  misc_feature (402)..(402): n is a, c, g, or t
  misc_feature (404)..(406): n is a, c, g, or t
  misc_feature (412)..(412): n is a, c, g, or t
  misc_feature (415)..(415): n is a, c, g, or t
  misc_feature (422)..(422): n is a, c, g, or t
  misc_feature (431)..(431): n is a, c, g, or t
  misc_feature (443)..(443): n is a, c, g, or t
  misc_feature (448)..(449): n is a, c, g, or t
  misc_feature (479)..(479): n is a, c, g, or t
  misc_feature (488)..(488): n is a, c, g, or t
  misc_feature (496)..(497): n is a, c, g, or t
  misc_feature (499)..(499): n is a, c, g, or t
  misc_feature (517)..(518): n is a, c, g, or t
  misc_feature (522)..(522): n is a, c, g, or t
  misc_feature (527)..(529): n is a, c, g, or t
  misc_feature (533)..(533): n is a, c, g, or t
  misc_feature (540)..(540): n is a, c, g, or t
  misc_feature (549)..(550): n is a, c, g, or t
  misc_feature (566)..(566): n is a, c, g, or t
  misc_feature (574)..(574): n is a, c, g, or t
  misc_feature (587)..(587): n is a, c, g, or t
  misc_feature (590)..(590): n is a, c, g, or t
  misc_feature (611)..(611): n is a, c, g, or t
  misc_feature (617)..(618): n is a, c, g, or t
  misc_feature (620)..(620): n is a, c, g, or t
  misc_feature (631)..(631): n is a, c, g, or t
  misc_feature (654)..(654): n is a, c, g, or t
  misc_feature (664)..(664): n is a, c, g, or t
  misc_feature (683)..(683): n is a, c, g, or t
  misc_feature (685)..(685): n is a, c, g, or t
  misc_feature (689)..(689): n is a, c, g, or t
  misc_feature (693)..(693): n is a, c, g, or t
  misc_feature (695)..(695): n is a, c, g, or t
  misc_feature (698)..(698): n is a, c, g, or t
  misc_feature (701)..(702): n is a, c, g, or t
  misc_feature (711)..(711): n is a, c, g, or t
  misc_feature (714)..(714): n is a, c, g, or t
  misc_feature (718)..(719): n is a, c, g, or t
  misc_feature (751)..(752): n is a, c, g, or t
  misc_feature (766)..(766): n is a, c, g, or t
  misc_feature (779)..(779): n is a, c, g, or t
  misc_feature (781)..(781): n is a, c, g, or t
  misc_feature (787)..(787): n is a, c, g, or t
gcctgcaggtcctcgaacttgacaaaattttttgaaattttgcagcatcctataaagacgcnnagggntancgaangnnagcaaanngnaccttttagaagngggngagcaaagggatgncaaaaaaganngacaggagaagganggngacgaagggacnggcgaagtcaaaccaggcncggcacccgacgncgaagcccaacacgaagacgcccaangnacgcgaagnnncaagcaggaagaccaaaagccaaaacgaaaaaaaagagcccaagaagaacagacaccaccagggacgggagnaccgccaaacaaccggccgaaagccacgccacaacccgncacaacaacgcaccacagggcaccaacaaggcacacaaaccaacaccaannnaacnaacnannncgagancgncgacacnaaaaggcgngaccccaggcanaacannagacaagaagaaagcagggggggggggaanagccgaccnaggcaaannancccacaccgacccccgcnnaaanccaannngagnagccaangcccaaaanncagcgcagaaaaacgncggggcanccaaaaagacagnccngggcccgccaaacaccaaaangccgcnncnaacgcggaggncgaaggcaccccgccaacgcaancggccgaggngagccgaagcgacaaaaanangggngggngnaanaannacaaccaanaancacnncaaccccaaccgcaaaagaacataccacaacnnagcccaaactcagncaaagaaggaaancnagcacnaagcgacagctccaagtatcctctactaattatgtaatttttataaacgtagcaaaaatttataaaaaagttctaaccaaaaaagctcgaaaaatttatgctcaacaattttgaccctaacttttttgcaattcgataaaatttttttgaaatttaacttaataatagagaaatctttgggctatcttttcgtatcaagcacggagtgaattaatttaagtttgaacaattttcatgcatttaaacgaccttacgtttttttggatgaccataaaaatatgaccctattaattctttcataacttttttctaaaacaatcaatttaaatgttgtttatataattagatagcccaaagattactctattattaagttaaatttcataaaattttattgaatctcaagaaagttagggtcaaaattgttgagtctaaatttttcgagcttttttttggtaacaactttttgtaaatttttactag

SEQ ID NO: 41818 - DNA, 1332 bp, Heterodera glycines
aagaggaacagaagcggttacagaaagtggaagaggaacagaaagtggaagagaaagtggaagaggaacagaaagtggaagaggaacagttagagaaagcggaagaggaacagaaagaggaagaggaatagaaagtggaagagaaacagaaagtggaagagaaagtggaacagaaaatggaagagaaagtggaacagaaaatggaagaggaacagaaagtggaagaagaagtggaagagcaacagacgtggaagagaaagtggaagaagaacagaaagtggaagagaaagtggaagaggaacagaaagtggaagaggaagtggaagacgaacagaaagtggaagaggaagtggaagaggaacagaaagtagaagaggaacagaaagtggaagagaaagtggaagagaaacagaaagtggaagagaaagtggaagaagaacagaaagtggaagaggaacagaaaaagcaacaaagggaaagaggaaggaacaaaaaaagaagagagcaagagaaagcgagagtgatgaagtgaaatgggaaggtagaaaggagggagaaaggggatgagaaagaggaaaagtaagagattttaagcgatcatattaaaatttgagttttaagaaaacgttaattgaattcccggccattaaaaaaatcagttgccttcttacatataaaagttttttggcgcgtagcgccctctagagactgttaaatagcgaagctatttcaattttaaaaaaataaatttaaatcaatttaaataaaaatgtcgcatttaaattaaatttaaaacaatatcgtttttaaattaattatttgttcatttccaaattctcatattcctaaactatgaggatcgcttagcagccaatagatgctttttacacgccccaaattatatctcccactagagccagcgttgaaagcgcccccggcgctttcacagggcccgcagggccctggttaaaaatataaaaatatataagttgttaatatttttgggttaaatatttgctacatataataataataataataaaaactaaagattaattgtctcaagtagttattttttagcaaaatacttaatttatgtgttttccattgaatgaaacattaatttacaaatgaattaatgcatttaaaacaaaacgaattctccaaagctgaatgaaccggaaatgatagaaaatttcatgagataattctgagagctataattaaaaaaagaaaaaatataaaatgagccaaatcgacttaatctattcatatactattcattatctgaaaaatttagattatcagtaattctgggtttttcctgacatt

SEQ ID NO: 41819 - DNA, 921 bp, Heterodera glycines
  misc_feature (71)..(71): n is a, c, g, or t
tccctgcgctacactaacatttgcctccacgatgtcaaaatggtatcaatttaatgatatgtctgctctcnttaatttttctttggaagacttttgtccttatttttcttttgatgacttcgaagttaggaaagtcggaaatttactcctgaaaatttccctgcgctacattaacatttgcctccacgatgtcaaaatggtatcaatttaatgatatgtctgctctccttatttttctttggatgacttttgtccttatttttcttttgatgacttcgaagttaggaaagtcggaaatttactcctgaaaattttccctgcgctacattaacatttgcctccacgatgtcaaaatggtatcaatttaatgatatgtctgctctccttatttttctttggatgacttttgtccttatttttcttttgatgacttcgaagttaggaaagtcggaaatttactcctgaaaattttccctgcgctacattaacatttgcctccacgatgtcaaaatggtatcaatttaatcatatgtctgctctccttatttttctttggatgacttttgtccttatttttcttttgatgacttcgaagttaggaaagtcggaaatttactcctgaaaattttccctgcgctacattaacatttgcctccacgatgtcaaaatggtatcaatttaatcatatgtctgctctccttatttttctttggatgacttttgtccttatttttcttttgatgacttcgaagttaggaaagtcggaaatttactcctgaaaattttccctgcgctacactaacatttgcctccacgatgtcaaaatggtatcaatttattgatatgtctgctctccttatttttctttggatgacttttgtccttatttttcttttgatgacttcgaagttaggaaagtcg

SEQ ID NO: 41820 - DNA, 946 bp, Heterodera glycines
ccggcaggcaatagatggctttcaatctgcaagaaattacgattggcaatatgtggttgtaaaaaacttttgggtatggaattattttttgaagtgagtcaaacaccctattagtgctttgctgtgccgagaaccggcaggcaatggatagctttaaatctgcaagaaattagattggcaatatgtggttgtaaaaaacttttgggtatggaattattttttgaagtgaatcaaacaccctattagtgctttgctgtgccgagaaccggcaggcaatggatagctttaaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgaatcaaacaccgtattagtgctttgctgtgccgagaccggcaggcaatggatggctttaaatctgcaagaaattagattggcaataagtggtttaaaaaacttttgtgtaaggaattattttttgaagtgagtcatacaccctattagtgctttgctgtcccgagaaccggcaggcaatagatggctttaaatctgcaagaaattagattggcaataagtggttgtaaaaaacttttgggtaatgaattattttttgaagtgagtcaaacaccgtattagtgctttgctgtgccgagaaccggcaggcaatggatagctttaaatctgcaagaaattagattggcaataagtggttgtaaaaaacttttgggtaatgaattattttttgaagtgagtcaacaccctattagtgatttgctgtgccgagaaccggcagggcatggatgggcttca

SEQ ID NO: 41821 - DNA, 852 bp, Heterodera glycines
catctgggcaaccctgggtttaaattaataaataagaaactcagtaataataattcagaaaaattgaattcaccaatttacattattctaaattacgactgatcaacagtcatttaaagaaatcaaaaaaataagaacccgactgaaaaatttatattatacaaaaacaattaataaaacataaaagcaaaaacacaaaaaaaattaaggtttaagtaaaataaattggagcaataaaataaaatataaaataaactaaaattactttttatgcttttttaattttaaagcgaccaaaatgggattgagaagattaatggaagatatgacaatgcaagagaaatgagcatttatctatgcagcaaaagtaaataaaataattaattgccataataaatctaaaaattgaatgaacttatttttgcaaaaaataaacagaataaatatttgaatgaataaattatcaaaatacttaaattaataataaaaaagatttccgaaaactgaaactctcatcgaacgaatataagcgaaatattgaatattaggaaaacaaaaagaaaattcaaatattaatttctttagagggattgaaccatgggaaagaagtagaaaatcaagaagattagccacggggcaatttgcataatttgcagttagactttttaagaatatattaattttttttaaatgttttccttttactccaatttttatgactaatgttttagccagactcccaatcttactagagcttgtttttcccggttcacgtttgccctaccgggaccgggaccttggaggaccgggaatttcagtctcggtcccggtcccgtgacactctacataaaa

SEQ ID NO: 41822 - DNA, 767 bp, Heterodera glycines
gcgcgtttgttaaaactgccagcgcgtttgttaaaactgccagcgcgtttgttaaaactgccagcgcgtttgttaaaactgccacccatgcgcgtttgttaaaactgccagcgcgtttgttaaaactgccaaccatacgcgtttgttaaaactgccagcgcgtttgttaaaactgccaccaatgcgcgtttgttaaaactgtcagcgcgtttgttaaaactgccagcgcgtttgttaaaactgccacccatgcgcgtttgttaaaactgccacccatgcgcgtttgttaaaactgccagcgcgtttgttaaaactgccagcgcgtttgttaaaactgccagcgcgtttgttaaaactgccagcgcgtttgttaaaactgccagcgcgtttgttaaaactgccacccatgcgcgtttgttaaaactgccagcgcgtttgttaaaactgccagcgcgtttgttaaaactgccagcgcgtttgttaaaactgccacccatgcgtttgttaaaactgccagcgcgtttgttaaaactgccacccatgcgcgtttgttaaaactgccagcgcgtttgttaaaactgccaaccatacgcgtttgttaaaactgccagcgcgtttgttaaaactgccagcgcgtttgttaaaactgccacccatgcgcgtttgttaaaactgccacccatgcgcgtttgttaaaactgccagcgcgtttgttaaaactgccagcgcgtttgttaaaactgccagcgcgtttgttaaaactgcca

SEQ ID NO: 41823 - DNA, 832 bp, Heterodera glycines
attttaatgcgtgcaaaatgatacaatataaaaataaattagcttttataaaatttgtctcaaacagtgaagattcgtcaatgaatctgaattcctgaaaatcaaacgctagaatgctgatttgaaaaatgtttcaaaaacgaattgatgaatactccacgggtggcgtaccacgcggctgacgccaaccgtgcggtcgacgatcccaagaagtttgcgcggaagcggccagcgatggttgctgctttttggaattggtgatcggtgcctcggccgtaggctttacatgaaatttattgattagcctgtgtgtacgcatgcgcatatgtaaaaattcttccaacttagtaagtttcaagcgtagtgtaactatttgttacacatagggcaaaatcaattcacatgtaaggaatccttacataataggaaaacttgcggcatatcaataaacactaatttagagcttgtaaagttgcttatataccttgtttgatgtaaggattgtcgaaggcttttgcaggaggccatttcaccatttcaaggcttttcaacttgaacgcgatgtccttcttttgcgcattccttttgaggcgtccacaagcttttaccagtgcagctacttctccttccagctgctgacgcctttgctcaacctcaagacgttgatcttgctttcccttgcaccaaatggccacatgtttgatgattgtgttgcgatttaagtaaaaatcatagttattttttaaaaaccttttgctaaaaacatgtaacctaatttacaggtaaatttattgctgacacaataaaaaaaaataaatgatgaagtgggggg

SEQ ID NO: 41824 - DNA, 1193 bp, Heterodera glycines
tcggttcgcgttgatcagcgtgattgaacacacagcaaatgccccagattgattgaggcgatcagcggctgagcagcagcagtcccccgccccattccgccattaacactaattagttggagacaaattgccccccgaggcagccacaaaaaattaggggtacaacaaattaactaattagcgcgctatcacagcgcccacctcgtcgctgtcgctgccgtggtcgtcgtcatttgtgattagtgccgctcgatgtggtgggaatgtggcgctttttgtgtgtgtgggttggttcgcttagttgaaataatcgcgcagcaccactaatttgttaattgaagcgatcactcttcccctccccctcccccctctccttctctgatcatttgccgccctgcccctctcccactctcaaactctctcgagaccatttctgatcaccagaataattggtgactgttggcggtgtgatcaccctccttctcctcccactctctgatcactcaaactctctctagaccttttctgatcactacactaattggtgatttggcggtggtgatcacctccccccccctctctgatcatttgccccgccgtccctctcccactcttaaactctctcgaagactttttctgatcaccacactaattggtgattttgcgatgatgatcacgctcccccatccaaccaattatttttttgactcacaacttttaatgggcacatatttcgaaatgtggcccttctacgagactctcgagcatcattactctcatcgttaccatatttggcatttctctaaaattccgatcgcttcgagaccgcgctcactaattaacccccgtgactcctcgtttgttaataatttcattaaactccaattgcatctaattttggactggcatgagatttatctgcctgaaataataattaattgaaaaaatccatttttggcactcaagactcttgagcgtcagccgccggcacctctttcttatgcccatcattaacagcctttgcctttttcaatccatcttgtgccatttccatgccgttgggctccctccatccatatgcttttcctttttcttcgtttgggccccttcccctaatcgctatttccggcacctgttttgccctgtcacccttccctttaatgcatttaaggggctgtgcgcggggggggggg

SEQ ID NO: 41825 - DNA, 1012 bp, Heterodera glycines
gctgcttttcatcgtgccacacttttgtcactcttctggcgccattgtccaccaccgccgcttgaggaaagtgccgtttctgtcgcggcggtgtggcaccgccaatgccatcgaattgctgcgtttgcttttccttttccgatgaacatgaagcagttcggttgcgctggcatcgctttcgtttgcttcttcttcctccccctttaatcgttccttttctccctttttcttcctttgcttcttcaaagttcgtcttcttcatcttctcctgctgcctttcttcgtgcacaatttctccggctgttggcatcagattcttattgttttgattattaattttggtcgcacaaaaagaaacacaaggggaaaatattcaaaggaacgcaaaacaaatctatttagttttttatctgtataattaattaattactaccgtatttacactcgattataaccctctttccgaggggaattgaacaatagagcccccgggggctagtaaatacggtaattactttttgattgaaaacgataaaaaaaaataaatttcgataaatttgaactataactttcaatcattcctatacattggcctcttcaatcaactcgatcgtttaatatgttgcaccaattaaagttaattagccataaaagaaccaaagaatgaggtacatacagtaagcctattgagagagaccaccaatgaccctttcagggctcattgagagaaagaggtcgcagagtgtgtaaagaaaaatgagagaagaaagggctgtacggagagagtggaggaaagagagagaagcgaaaccacgatgagagtggaagagagaagtgacaagagagtggatgaatgaaagaagtaagacaaagaagagggaatggatgaatgaaagaagcgagacaaagaagagtgagtggatgaatgaaggaagcgagagccgtgtcgagagagtgggataatgagaagcgagatcagtgccgagagagtgtgggataagagagaagcaag

SEQ ID NO: 41826 - DNA, 1200 bp, Heterodera glycines
cagattagtgctgagccaatggcggttcggatgcagtcattttggattggatttctattggatttatgaaaaatttatcattattatatccatttatataaaaaaagggaacaaatgaaatgaaatgaaatgctcagaaaatgcttgctttttgcaaagattgtgactttggaaggctaaaaccagtcttttattaacacattttacgttttataatttgtagtttataaaaaaagggaatatttttagaaaaaaaatattctttttatgtgatcgttgtgatctaaaatttcattaattcataataatttgtagtttattactggttattgtaaaaaaaaataaataattttaaaatgaatgattttttaaataaataaatcgtaaaattggtgaatgaaaatgaaatttttgctttttaaagacgaattccaaacttttcggagagtattccaactttttattgctaaattgaccttttgttaactaaacacgcattgttccctttttgcaattattaggtcattatttgggccatggaaattaacttttttaaggggccaatggcaactcgtataaaagtcaacacagattttacaaaataaagcctaagcttaagtctatgcctaggcctagccttagcaattgtacgaggtgtcattaatacttttttaataccgtaaaaactttcgcattatgtgaaaattattattattattattcgtaagagattaaaatcaattcatatttttgttgttttattttgtggtcacccattttttttgtcacttactctacaatattcacaatgatcatctgaaaaacgtatttattaatcattttcattcaccaattttatgatttataaaatgagcacaataatcaagttataaactatgaatttaaattcacaatttttcaaaaaccaaccattgctaaaaatgctagtgccgaacaactctaattaaaataataataataaatgttgatgattgtgcatgttttgccaacgtgctaataggaggcgaattcgtttgatctcccccccccccaaaaaaaatgtctgtgttttatttttgttgttgttgttttagtgtcctttgtttatctctgtctctctgctgttcaatgtattgcattcatttttttatattagcgtacccatgggtgatcattgatcagagtgaccctgaccagacc

SEQ ID NO: 41827 - DNA, 850 bp, Heterodera glycines
tttttaaattcgaattatttaaattcaaatattttagctacttttttatttgggagaacaatttgttaacaaatattgtccacaaaattttccaactcatcaatgctgcacaaaaaatgccaggattaagtcgaattaaatccaagttgatcagaaaaagaacatttttatgaacacatcaaaattcatcatttaaaattccttaagtgctaatgaatgaatgcatgaatgaatgattggcgcaagcatctcttacatcatcatcttcctattatggcggcgctgtgatcccccccccaactaattttatcgatgcttttcctctgtcagtgctcagtgatggcttcaccatgcttcgcccttttttgacgggaaaatcggcgatttttggagggtttttgtgttcattcacagccaaatgtttactctctctcttctcctcgctcaattcacttttcacttttgcaaaattttttgttgcaaaagtaaattttaaaaattgcggccaaaaaaatgttcaattttttcctttttcttttggtactgaagtgcccattttcactgggaagtcctttacgtctctctcttactattttaaacttgtaagacgtcttcttactttttaaggggggctgtattagggggggggggctgtattagagagacgagagagtgtattaaagagagagacagttagagatttttagatattgtatatttaatggaaaaaataataatattttttgccaaattttttaactttaaaaaaaaaaaggttttcaatataaataccaagtttacagcaaaaaatgattatatctattaattataagccatcttagaaccatta

SEQ ID NO: 41828 - DNA, 921 bp, Heterodera glycines
aacagtgcgactgggccccctgggcactgcgactgccaacctaaaaacgggggaacatttattcgcttccacgggtttttctactccaccactccccttttattgtccaagcccaaatcccttctgaacatgtccccgaatacgggtgcatttcatttcgctcacattgtttcacccggttttttttaaaattaaattttaaacaaaaatttttagtgaaaaaaaaattctgtttaaatgtaagttttcagggaggaaatgatccgggagggagaaattatcgagggggggggggaggggaggggacgaccggattcagtatttttgagacaattactgatttcgcacatttgggtccgcgtcaagagcgtcggtgtcctccaaactttcgacaagtcctttgatggcggtgtacgtggagaccaaattgtccagccgagcgccggaaatgaattcttcattcagtccggacagagtctaaatttaaaaaataattggggtggtcaaaccgatgctttttcttcgcttaattgcttacagctggttgtgtgtcgtagaggaacatgtccatgtccaaaatctgatccgttttgcagcctgcaaaatccatatggctgtcaaaacctcaaaaaaaatttgtcaaaattttttaaacttcaattttctagttaatttgatgatatttggtaaacacttgttatgtatcaaatatatagtaattaataaaaattattgtggacaagcctttttcccagggcccgagtttttgagctataattttttgcattatcaaccaaatctaacaattttggtatcattcaaaagccttacacatgttctattcgtcttacaaaaattcggggttcgttcagaattgagcaaaaaggtcaaattcgcgttcagcgtaccaaataccataaa

SEQ ID NO: 41829 - DNA, 693 bp, Heterodera glycines
tggctaatttagcaattagcattttaaaagaaagcacattattaaatgaaaagaaatgaatgactaatggaaaaggggcaattaaaacgaaaccaaatttgggactgacaatgagacaaaaagggcaaaacggaggagaagcaaagtgaatgaaaatgggaggtgagaggagagggggggggggcaaaatgggagggaaaaagggggaaggggggggggattcaagccaagccaaatgcattttccattccaatcacaacaaacaaagtccccccccccccacttttgtgcaaaaaatatcgttatattcatttctattcttcagcaatctaatttcaaataatgcataaaattattttttgattttctgatattaaatatatatttaaataatttaaaataaaggaatttttaaatcataagaagcaatgccttttattaataggataaatatttgtcgagctttcagaatttttgataataaatttccaaaaaataatgaaattttttgaaactttatgggttaatagagaaattttaacacaaaaaattcgcaaaattgaaaaaattaaaatttggggagacaaaaatggtgcaccaaaacgaatccaacctcaaataaataataatttgtatttaattcaaattctaaaggatcatttcgccacatcatttaaatattctcttctgctg

SEQ ID NO: 41830 - DNA, 1004 bp, Heterodera glycines
aaatatactttgtttttcaatttgagtctgttggcgttttgttttacgccaatcattttttggcaatttttttccttttttcccctccatgggccccatcgacaaaattacaaattataaaagccaaaagttttttgaattgaaacatttaattacccattcgaataccttatgcaatgcataaattttgtgtcggcttttactttatgaatatacattttaactcatccgcatatttatgaaattgacataaacaatttgtcttctcctccccattatttttattgtagatagagaaccaaatcccactcactgtaaacggttaataatgtcaaaagaaagggccactgctattgttgtgttttgttggtcagtgttttgtgcttttctttctttcccattgtttttctcttacttccatttttcttcagtcttcttctcatcgctgctgctattggacttgttttgcttacgctgtatcttttacagaggcgccaaagaaaggctttagctgcgaaactgaacgctctacagcaacatgcatttgacccagtaaacgcagagtcgtcaatgtcgcttaatgctgaacacggagtggaagtgccggattccttacgctcgggagattccgatgaagacgacgacgaggactacgacgctccacctgtaatttcgtctcgtgcaaaggcagcgccgccacccgttaatgaaaaggcaaagaaaggatagtttttaatttacatatgctcatctaattcatgtacatatgtatgtatgcatacgttttttaacaaagttgcgatacgaattaactgtttttttcattcgattatcggcggataatctcgaaatgatgccacttttagggtgcgagtgagatgacctgaataagggagttccaaatttaacagggattcaatttttaattttgaagggtgtgcctttaaagcgtagccaaaggaagttgggtaacatccattcattttttgtcaattcgtttttat

SEQ ID NO: 41831 - DNA, 942 bp, Heterodera glycines
  misc_feature (852)..(852): n is a, c, g, or t
  misc_feature (876)..(876): n is a, c, g, or t
  misc_feature (887)..(887): n is a, c, g, or t
  misc_feature (893)..(893): n is a, c, g, or t
aaaaaaaaaaaaggggggggggggggggggggagaaaaaaaaaaaaaaaaaaaaaaaaagagggggggggggggggggtggtttttttttttttttttttttttgggggggggggggggagaaaccaaaaaacaaaaaaaatatttttttttttttttccctttttaaaaaaaaaaaaaacacccgcccccccccaccaccacaaagggggggggggggttttttttttctctgccggatggctgttggggttgggggggccccccccctctttttttttttttttttttttcccctccccccgcgagaagaaaaagaaagcccccccacaaaaaaaaaaaaccatccgcccggacccaaataaaaaaaaaaaaaaatttttttttttaaaaaaaaagaagggaagggagaaaaaaattttctttcattttttttttaggggggaaaagggggctttttaaaaaaaaaaaaaaaagatttttttttttaggggaccaaaaacaccccttttttaagggccgaaaaaaaaaaaaaaggggggaaaaaaaaaccccgatatttggaaattaaaaagaaaattcttttaattagggagaatagaatatgtcccaaagatccctggaataaatcccttaccccacccattaaaatccccattccaacggatcaaatccaacaaactttaagaaaggttcaaaccatcaagccatttcactagagcccttggagattgaagcctaaactacatataatgctcgagatcgggcttattgttgttagacaattaagccgctcgataaaattccatcgaaaatgaaaagtctttttctctccagtctctctatttattcnttcatctttaggtttttccctcgntggaaaaccantcgggnctctctgggaagataaaaatggggatgttcaatgtttctttacatttct

SEQ ID NO: 41832 - DNA, 1664 bp, Heterodera glycines
  misc_feature (1543)..(1543): n is a, c, g, or t
  misc_feature (1602)..(1602): n is a, c, g, or t
  misc_feature (1631)..(1632): n is a, c, g, or t
atagcgataaccatcacaaaattttcctttggcacttttttttgatactagttgagacattctctaatatgccccattaaatgcacgccactatatatttttagatgaaatttcacctattttcacctgttttcacctgtttccttttcacctattttcacctgtttcccttttcacctgtttttggtttatgtcccacaacctttgattctcatgcagtttcattttctcgaatttttatttttttcttaaattttataagcaataaattcatccctaaattcttcctgaggtctttgcctttcaaaccgtatttggttttcgcgcattgtttcttttagtttatttgccaaatctccaatacctaaatctggctgcgagtaagcggtccgataaatatgcccaatttcttgccgataattgttggctatttcgattgattgtttggcctcttctgctaattcttgacacatagttaaatcttttctgtctagacatttttccataccttttttaatatttttcatatttttttcttcttttttattttgtcaaatagggcatgaatttttaaaactccatctaataatttgctatgccaaaaatttacaccaggtttatcagggtttttattttttatattttgggcttcaaccatggtattatgtgcagaaaaagaaaattcttttgcttcgttatctaacctaattatgtctctaaatacgccttctacagttcttcgggcactggtaaattgctctttttcttcttttgaaaggcaacaactttccgttccgaccaacaagaaccaaactagaaataattttaagtaaaacatttttatttgaaaaaattaacaagtttatttatagatttaaaggctgacaatatcaatcaaagagtaatagatccccttcttccctccgaattctttcaccctcgcgccgattttcatggtgcacacggccccagacaatcctctcaactcctcctgaatttaaattagaatggtattttttctttaaaacattaccattccgtttttcttcccacgtacatcaaaaaatgccacattttccaaaatcccagtatcatctgccacagacaccttcaaataaggtgtcagtgccttctcaacgccacatgaacacacccccttacggcataaaacgcaagccttaaaaaactgatatatttttttcatttttaatacaaaccctgtactctacatgtactacgttctcaattctcactctcacaataaaaactcttccgccttcaataatctcgaaatttttaatttcagcgattctttgcattttctggaattctaccaaaaataataaattaaaattgattaaatatttgggtcaaaaccttcactttaaaaacaacatgaacatttaatatttattataaaaaagcatgcgaaaaaatgatggtaattttaaaaattcttccagtttattctccgcaaccacccggcgtgaagtgtcaaaaagtgagggtgggagtctatagaacaatgaccacgatccgaccnaatctctaaaatatttttttaaattgttttttctatgttccaacctatctatacgtggntagaacatatcaattaaacttcacaggtnntcaaagtagtctctgccccagctttgcccatt

SEQ ID NO: 41833 - DNA, 1087 bp, Heterodera glycines
  misc_feature (972)..(972): n is a, c, g, or t
  misc_feature (1026)..(1026): n is a, c, g, or t
cccaagagaaaaaagaggatagccattttttcgggccagaatttttttcggtaacatttcaattatggtgggagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcanatatcgtgtgagtgtttggtagagccagactagagaaggcaaatgttggtaccnagtttgcggtcaaatccccaggagaaaaagagatagccattttttgggcaagaattttttt

SEQ ID NO: 41834 - DNA, 1003 bp, Heterodera glycines
cgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaacaattcgtattggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaagcttttcacatacaaacgcgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaacaattcgtataggcgtgattaatctgagaatgcggttggaattccttgcactgttgagcagaaaaagagatagccatttttccaatcttttcacatacaaacgcgccgagaaaaaaattccagaaacaatcgtataggcgtgataatctgagaatggcggtggaattcttgcactggtgagcagaaaagagatagccatttttccatcttttcacatacaaacgcgccgag

SEQ ID NO: 41835 - DNA, 1222 bp, Heterodera glycines
ttttgatcatgtcaatgctttcgttttcatgacatcaattatgttcatgattccgagacaaatgaaacatccagttgtcccacttaaagttccaacgttcgttgaattcttcgagattttgtatacaaaccaacagttccaatttataaaacattttttactggattcacaaatatttgattggactcataaactctgatcggactcaaaaaagtcgattggactcataaagtgcactagagcccccccatttttctacgttcgaccttttgcatattttgtccattgaagacttttttatgctattcagactttaccaaaaaatgttagatttaaggaaatttgtctcttttgcgtacgacaaatccccctcagggttagtcgaacgtaatgcacggccctttccttaatctctacgttccctcttctcgctttttaataaaattctcccatttatttgtaagtgatgaaaagccaccgccaaagaagtatctgaagactgagaaggcacccgtggccaaaaaggagagaaatgcaaagaccgcaaaaccagcgaagaacagaatcgaatcagactctgaagaggaggaagtgtcgttgagttcggaaagtgatgcctccgtttctattgatgatggcgacgacgatgattatgattgataacaactgtttaactcttccctcccccatattgcttgtgtattttcgattaaatcttcgatctcttttggccagctgacttatttcgattaaatttcttttttttcacgtcgaacctggttctatacttccttagtttatcgataattggtctatatgttttggtgtggcacacttaattttatgggcccatctctgctggttacgtcttcgagtgatcgattcatatttccttccccccatttattcgtcactcaaaacgactaaaaatgtaaaaatggggagaggagaataaataataaattttaatggaccgaagtttgacctgctctgcgtttgattggatcaatttggcctttcatcgggcgtcgtcccattcattgatttgggtccaattcccaaattggcatttctatttcaaatcggaattccattgggaaatttcccccaaattggcatttcctttgggaatttccccgccgttcgtcaattttccttctgttgcacattcaatcattatttcatttgctcattccttcgcttcgaatagtttaaatttccc

SEQ ID NO: 41836 - DNA, 253 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagggttggagagggaaagggtggggggagtatgagtatgatggtcgatatggagaaaaagaaagagtaattaccaattttttttcaattcaaaaatgtaaatgtccgcattgttattata

SEQ ID NO: 41837 - DNA, 1419 bp, Heterodera glycines
acttgcatggtcgtaagtctcttccacctgctccgcttggcccatttcttgctgctccatctcggcttctccttcctcgtcgtcaatttgttgctattggactgctgaaattagtttgaaatattttaggacctaaaaatccgttgaaaaacatacttttcttagccagataggcttgtctcgccttctccgtctgagcttttctttcctctcgccttttcagttgttcagcacctcttctgccttgaagcttaagcaattatttttttagccataataaaaaatttaaaaaatttcagataaatgcgaattgaataactttctaggccaaaatttttactcaaaacactgaaagtttgcacattttccttttctctatcgatatgtaaaatttggtgtggatttaacaagcagaaaaaaagttaaacaagatgaagtacctaaatgttgttcattacattattaaaaacgaagagatagtacataaaattgagagaaataaagataaaaagtaaatatgacagaaggccaatttttttctataattatccataaaaaatattttttgccaatttttttttcttttttaccatccatggaacgaggcaggggcgttttttgttgcttttcacttacttttatgcggcgcatttttcaagaaaaaaatttggggaacagggggtccgcggtttttgaaaattctggtccgttttttatttttttttgcccctatttccttcccagttgacttttgttcattttctagcgaatcggatttgcacttttaaaaaatgttcagggctcggcgaaagaatttgttacgccaaccatatttttccacacagtgcagcagaaaggtgggcaaatggacaagctttaaatgcttcagcaattgtaatccgttggaatggagcccagaaaacacatgaaaagaaaattgttttagagtttttcgaaaataaggttgactcttttttatagatgaaattattgaaaattcaaactattatatttaaatatgggtttgggacgatatctcccgacccatgggtgcgaaaaacaaaaaaaaatttcgaaaacgaaacgaaaatatttatttttcacgaaaacgaaacatgaaacgaaaattaaaaaactcgaaaacgaaacgaatttttttcttggacgaaaacgaaacacgaaaacgaaactcaaaaagtgatcaaaaaagggacgacgatgaaaacgacacggaatttcgcacacccctgctccggatgatgaaaatttaaaagatatttcgacgttttggttgtggttaccttattttgggctttcttctcgatgtgtttttttaatccacaactttcaattgaattttcccattttaattattatttttgctttctctcaaggaaatgaagtgttgtcactttggcc

SEQ ID NO: 41838 - DNA, 1432 bp, Heterodera glycines
acttcgccggttttccaaatgtcacaaaagaacccaacggtttctgttgatttgtaacagttgcagaaatggggcggcggtggtcggtggaggaaagttttttcctttttttgacgggtgccattccgaaaataataataatttagcctaaaaaaagggaaaatttttgaaaaaacgagcataaaattaagcgtgatttgtgtttcatcctcatttacctatatattcatgtgaggtcaaaatttcagcacgcgcgcttaaatgatggaaaatttgaatggttttcgacctcccccctcccacttctatatttgttcgacctctctctatgtatatgcctagagcccggtaaaaaaaaaatttccgggagcgggagttcaaaattttccgggacgggagtcccgaacgggaatcccgtaaaaatcccgctcccgttaaaaatcccgttcaccgaaaaaagcgggagtcgggagcgggactcccgtaaaatcccgcgggagtcccgatcccgccgggctctagtatatgcctacctaagttcctgttttttggctataaaatggcattcttccttatcctccctttcattaattcgtttataattttcccacgggaattttgttgcataatgtcttagagaattccgtacggtttccttttatatcatatcgcattttgacgagtgccatttagaaaataataatagtttagcctaaaataaggaaaatttataaaaaattagcacaaaaattaggcgtaacaataaaccatggctcggattcgtacttggatgccaagtacatacttgggtttcggcttttgtgcttggaaaattttaactgtacttatttccaagattgtacttggaaattgggattttttctaatgaaggtaaaaaaatttacacttaatgaaaaaaatatgaaatttttggcattttgtcaatactcattatttctgcggaatttaacttaaagatagaaattttctgtgaaaaaatttgtttaaaagggtcaaaatttcggcaattgtgaagattattggtcccgaaattttttaattaatttttttttctgaaaattttttaagcacttataggtgtgttttgaggcgctgagcacgaatccggactccatttcgaccaattccgaatccctaatccgaactcgaacatttttcgagaactaaattttaaatttctcttaaaacattgtttttagcgttttcggggttgttaactttagacaaaaaccgtttaaaaacaaaaatggtcattctgtaaagatacgaacaaaaaataaattttgataattttttttgttcgagttcggatcaggtattcgaaatcgctgcccgtcaaaatgtccctgcgtcataatgtcccagcgtcgaaattaaggagcgtcataatgtcccagcgtcataatgtccc

SEQ ID NO: 41839 - DNA, 747 bp, Heterodera glycines
  misc_feature (21)..(21): n is a, c, g, or t
tttacagtaggaaattgtaantttgggggttattgggcgatttcaaaccgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcct

SEQ ID NO: 41840 - DNA, 1481 bp, Heterodera glycines
aattccgggctttactaactgtgtgtgtaatagttaaccgatctcatataaataataattaggtgcattataaagaaatcgcttggatggccctttgggtggacaaatacagaccacgagacttttctaagctcactttccaccaagagcaagcagaacaacttgtcagtttggttagcaccagtgattttccacatttactcttctgcggaccaagcggagctggaaaacggacgcgaattcattgtttactgaagaaattatacgggaaaggcgtggaaaatgtgcgagtggaggaaattcccttttcggtaagaaaatttgaaaaagttttgatttttcaaaaattttgttccctaatttttattcgttctttcaggtgcccagcggtaagaagcttcaaattcactcggtcaacagtaactaccacatagagctgaccccgaggttgtccccaccaattaatttgctaatttttacattttctgtcaatttataatatttagacttggctttattatgactgttttccctcatccgtgacccatttcagtgacgttggcatttacgaccgagtgattgtgcaagaagtggtcaaaacaatggcacaagttgagcagctgaacaggtccacgcaaaaggctttcaaagtggtcgttctgatggaagcggagaatctgagcagagaggcgcagcattcgttgcgtcggaccatggaaaaatacgcggggacgtgcaaaatcattttgtgttgcgagtcggcgagtcgcatcatcgacccgttgcgcagtcgatgcatgttgatcagagtggcggcaccaaacgacgcgcaggtgggacgagcccaacgcagcgcgaaaaacttgcttgggggttttctgggagtggggataatcgaaaatacaagtgtgaaatcccttataaaggccctgaagcggcacttatggccaaaagatactcataattttccttgtaatttggggccgggactgaacaccaaaaagacccgtcagaataatgaacattataaaaaatatattcatcaaaaccctttgtcttatttgtgtaaatctcaggtgttacacttttccgagtttctcaaattttcaatttgaaattcattgcgattctcgacaaaacatttcttcagatgcgcgaatgcattgagtcggtctgcgcaaaggaacgcgtgaatttgtcggaattttggatgaaaatgttaatcgaaaaagcgggcggaaatgtccgacgtgcgatttgtttgttggaagaggagtgtagcacaaaagtgaaggaaataatgagccaatttaatgggaatatgtgatttagtggtaaaagtttggacaagcaaaacatcatggagcccgagtgggagacgtatctgaaacaaaccgcggaattgataatgcaaaagaaaaatgcgaatgggtgagtcactgtcattctgagagaccatttgacacggaaagacaagcgaa

SEQ ID NO: 41841 - DNA, 759 bp, Heterodera glycines
ttgttttcggggcagtccccccgaaccgatgcgcccagatttatgggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttaacgttcgattgctctagtcaattttttcaaaattttgttgaaatatttgccgtgctct

SEQ ID NO: 41842 - DNA, 1011 bp, Heterodera glycines
attatttatttatttattcaaaaataaaaatacaaaaagaagacaatgtgccacttacacttttggcggaaatgaggtgaaatggaaagccgtgataaaagaattgaaattttgaatggagaagcagaaattagaaaagtcagacttccaacaaagggaaaagtggttgtttttttttagggttgtaggagaaaaaaaaaataaaaaaaattttttttttttgaggaaaaattttggtgagaaaagtgaagtactggaataaatgtattttttttgaggaaatgtttggaggtctgacagaattatttattgaaaagacgagggtattgtttttcgagtgattgaatttggtgaacaattttgtcgtttggtggtaatgattttaatgcttcataacatacgaggattgtttggtcaaaaacttccagcggtttgtaaatgtcgtcgctggcctccttctggtttggtgcattttctttgacgggagtcggaacatttgtctggcgaggttgcattgctggtgccacgggagcagggttttgttgacgttttcggaagcgcgcttcatattcttccttgagttgttctttggtcagcgctgggcggacgaacaggcggttcaggttttgtagagaacggagtcgagcacgctcgcgcttccatcctccgagtgccatgtgttggtgtgtggttgttggcatgaccaccttgagcgggcgtggtgttgttcgctgcgggtcgtaacgtccgagtcgaaagacggcggttggttgggcctcaacttcaagatggtccaggatttttgtggcggcttccctgtcttcctgaacacgttccgatgggcgaatggcattgctttccgggaggccaatgaagaccagggtgcgttgtcgttcttgctccgcgagtgcgacagcgtttgggtccaggtcctgtgcaggtgccattgaacgttttgcgcgaggcggagtgatgtttgatgcgttggttcgcttcatgtcggataattag

SEQ ID NO: 41843 - DNA, 1389 bp, Heterodera glycines
  misc_feature (58)..(58): n is a, c, g, or t
tggtggacagtttgtgcacgcatcaaggcgtgcgggcgacgtgtctgccctgctacancttcagctagcagagacgagcgcacggtcattgcaagcgcagcacatcatttgggtagacaatcgaccggttggcgcgccgcctcattaccgtgcgggtgctgcacgcgaggagtatgcactccttgaagaacaactgcgtcccgctcggcgtcgcttgtccacagacagcacttcagttgtcattgacattgcacgcgtcggtgttgcaccgcacccactgcaccagcaccaagccaagcacatgcacgagcacatcaacgtgcaatggcaccgcactcaaccaatggaggaattttcagcaactcttcctgacgtccgatttggtggccaccatgtcaaagcgctactcgcttccggcgacgagcatgttgccttgcaccgcgagttggtcaacccgcgggcaaagttggcacaattgggagtggaaacggtgcgcaacataccacgaaaggcagacacaacaccagcgctgcacagtgcgtgcagtgcggacgaaactgcgtccaccgttgcgcatttacaacgtgccgaagcgcgctcgagcgcaacaccataccgactgatggcacccaacaactacgcgggtgctgcacccagcgtcaaagtgaccgaggcacgagaagtggaactgctgaacaacgtgcagctacgaaggccggaatcttggagcatggcgcaggactacgcgtgtgcagaggcacgcttcgggggagcactgcagtaccggatgcgggcctcggagttcgaaagttggcaagtgccaaccgttgaactagaacgtgtcgagtcatcaatgcacgctcctgagttgcgcattaacatcgggcgacgaggcgaagtgccgactcccctgtggtgctgcagttctggcgaagagacggtcgtgcttgacctgcactataatcgccctaagccggaataccctgttgctcaacaatgcgtgcgggtgtcaaaccaaggccaatcggcgcagttcaactcgcgcgaggcaggctacgtgcaaatcacgacgaatgttgggctggcctggtaaaaattggcgataaaaattgctaaactgataaaaatgcatttattagggagggcgcgcgtcgtaatgaagccgagctggacgtcgtgcgcacgtatgcgcgctttggcggacaatttacaatgaattgcgctgcatccgggcaaatggacaccggcgagatgattgtcagactaagacggtccgaaacggatgagcaggccccgccgcacttgattcacgtacttcttcgccaatacgctagagcgcaactgcatgcgacacatgctcaacaagttcacctgcaccatgacttgcag

SEQ ID NO: 41844 - DNA, 949 bp, Heterodera glycines
  misc_feature (72)..(72): n is a, c, g, or t
gctcgagagcattgtacgtatgaaatttctcaaaataagagatagtcatttttcttggatataagataaatntaaaaattctctgtgaaattaaatggcgattgcgcaccgcacttcctcatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagagcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctatcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctatcatgctcgagcgcttttgtaacgtataaaatttctcaaaataagagatagtcatttttcttggatataaga

SEQ ID NO: 41845 - DNA, 904 bp, Heterodera glycines
gtagaaaattagcttggcctccacctacctcctcttccttctaacgccgagcagttttgcgccttcgcttccaccgccaccttccgctccgtctgtcacgtcgctgtgctcactggagcgctgctccacccctttaacagtgtcggaggagtcatccacaacggttgccgtcgtagccgagggggagtctgtggcgacgggggtgtcttcaatgtcctcatcctcctcctcctcctcctccccatcatcggattcgatgaacagcagtgtgccgtggccgccgctgccctcttcatcaccgtccttctcggaggagggggcttctttttccagtctaaactcggcggtggtaggtgtggtgacagtagctgtgacactgtggaccaactttcctgtcccgttttcctcctcttcgtactccattgagcccacagcagtgcctgtcgtctgagccgttggtcgcagaatccaggcgacagttccgaatgaatccattttgggggtgggggtttagtagaatggaggaagaaattttttatctacatatttatatctatatatgtgtgtgtgcaaatacagagggacgcaaaaaaccgaagaagggaaaatgttcaagcacccgttcaccatgtgcgtcgccggatgcaccggtagcgggaaatcgcagtgggtggaccgccttctttctcacattgatctgatggtcagtgaaggccctatcactggcgtgctctactgttatggggaagtgaacgacaatgtgctccggctacaacgtatggagaacaccgccaccacttcaagtgacaacaacatcacggagggaaaacattcgatcagaatgtgccatggagcgcccgaaaagagggatgtggagcgggaagcacgcgctacgggcggacgg

SEQ ID NO: 41846 - DNA, 1173 bp, Heterodera glycines
  misc_feature (10)..(10): n is a, c, g, or t
  misc_feature (977)..(977): n is a, c, g, or t
  misc_feature (1139)..(1139): n is a, c, g, or t
tatataaatnttgtaaataaattgccaaatatgtataaaaaatcttaaaatgtataccaaatatgtaaaataaaatttttactatggctatttttgggaaaaaaattttggtaaagtgctaaataggcataaaattccaaaattaacctaaataggcttagacatctactgttttaaaaattcagttttgatgtctcctttggcatttaataaaacggcgcgttcagtgacgacgacagttgcaagatgaaagagcagtaactcagcacgtaccattttgtgctttcgctggctccgagttcggcaagtagcaaaggcactgacaaattggacacccaaccgaaagattcgacccaaaaaaatgatcattagaaaacggagcaatttgcgggtgtttgtctcatttgattgtatatttcttaaaagttgctgtttaaaaaaaataaaattttcgaattccgaatgcttccggataaagcagcacaagtggacatctgcttcaggcgaagccaaagtgccaagcaaagaatgaacgaacaaatattcagcagccaactgcaacccgcaaaacagtcggggccggttcgatggtcatacaaagaaccaaactgaagctaaacgaaaaatttaaacaaaattcgtatttcagtatgtaacagggatgtcacggagttccgaacattttggtgcctcggaatgccatccctggtgtgtaacattagaataagaacggcccattcttcgtgagttttcccatttcctgtcaatgtcaacctattgagctgaaattttaatcatacgtagcaattctgaaaatattagaaaagtgagccaaatctcaacaactatcaaaaagaaactgatgaaacaagctaaataacaaaaacaaaaatttgtcatatttctctctgtctcttaggcagagctttgttgagttttccaagttctccggagaaattaagggccatgaggcttanatcaactcaaatttgtgaccaattgaatcaagctggtcagcagcaacaaactctagatcacgtacagatagataccctacataagctcaaaaagttagagcgtactgaaaaattgtccccattttaaaaattttataatattttttcagtcaccatttaccnttcttgctttgctgaaatcttatttttcaaaaag

SEQ ID NO: 41847 - DNA, 245 bp, Heterodera glycines
gggggggggggggggggggggggggggaaatttttttttttttttttttttttttttgccggcccccccccgcccccccccccccccccaaaaaaaaaaaaaaaaaaaaaaaaaaaaaagaggggggggggggggggggggggggggggggcgccgccccccccccccccaacccaaccacaaaataataataatttttttttttttttttggtggggggggggggggggggggggggggggggg

SEQ ID NO: 41848 - DNA, 598 bp, Heterodera glycines
gcatctcaaaacagtacaataacaaagaattcttctttgacaaaattcaacacttgtgtcgtctctaaaacattagagacacactaatgtgcatctcaaaacagtacaacaacagagaattctttttgacaaaattcaacacttgtgtcgtctctaaaacattagagacacactaatgtgcatctcaaaacagtacaacaacagagaattctttttgacaaaattcaacacttgtgtcgtctctaaaacattagagacacagtaatgtgcactcaaaacactactatttaaaactgacaaattacatttttgtgtctcatggattaaagatggggtgaaaataaggaagggatgggatacgaatttcccattgtctctccttttcttttcttttactcttttttcttttccattgcaatttactctctcttttttcccactccctccctctcccacacacacacacacgcgtccaacagactgctgctgcacagccgcacgcgtctatccactgtctgcccctcccacccgccgctgtctcgcgtggacagacaggcagacagtgaactatttcttcccttccttccctctaaccact

SEQ ID NO: 41849 - DNA, 1052 bp, Heterodera glycines
aaaaattccgactttttatgaaaaaattccgaagtcggaattccgaggccccaaaatttttcggaagtcggaattccgaccccaaaaatgtcggaactcgaattaatcgtacaaatgtaaaaaaataattcccgggagagggttcagacccaagcacactctcaaccagagaaaactaccacttaaccaactacataattgtaagacaaaaaaaatggatccaaaaaccgaaacctacggtctatcagtcttgtttgatcaagattatcccacccgtttgatggtttcaaattccgtataatcacgagtttatcaatcaattcagtatgattactgttttatcaatcccattcgtattaagagagtgtccaagaaacacttggtaagaagaaactcatggtgtgaacaaagtgtattagaaccggaaaatgataacagtgtgtgtgttgtgattgttgtggaagagatccggaggaggacaaaaagcatcagcagcaattgaaaagtgaaaaaatttaaatttcgtaaaaaaaattgcataaaatttgtcgacgaggcgaaaagtggaggggggggggcacttaaaatttagtaaatcaaagaagtgaaaaagcacagaaaaacaatgaattatttggggtaacaaaagaagcaatacaaagcacaaacaatgaattgtgatgatatgaataattcataaaattatttaaaaattaaataaaaatttgtgaattttaagcagattttaagaaaaatgtaaatgcaacgattggatggggaggagggattctggtactgtctctttgggtcagatggagtaaaaaattttaaggtccagaaattttgtttatttttgaccctcacgaaagtgaggcctttaaaaaacccatgaaattcggtggctctgccaatttttttaatgggttacaatttaaaatccaggtaaggtaaatagacttttttgggaacaagcggggcggaaggccggcggtgccgaaaggcgccgccgggaaaatttttgaaaatttgagtataatttgttagcagatttt

SEQ ID NO: 41850 - DNA, 1021 bp, Heterodera glycines
  misc_feature (520)..(520): n is a, c, g, or t
ttttttttgcttggctttgttcccatgtttttgtttttttccatattatttgttcatatttgatatttttattaatgaaaatcggttacttattacttaaattgatgatttgttaaacatgaagccaaatctttcaagaatgatagccaataaccaggggtgccagatccgaggatttatcctcattttgtggctttttgataggtcaatgaggatttttttttggaaaatgaggatttttgtggcttttggggacggtaggggtcaactccgtctggccaactccgtctcagacaaaaaaaaatatttaaaaatttttttcgacgaatttttcaaaaaatatacccctaagaaattaaaaattttctcaaaaattcatctgcaaatctatttaggtatttattttcatgttctgatttttaaaattattcttaatgccggtggtgattttttgtgcgacgacatttgccgcgctgtggttgcacgtgtgtatacccgtgctgagacgatcctaaatagntatcaatgtgggcgatcctaaaatagtattaatgataataattaattaaaataattattattcaattaaaattattaaatttaaattatttttaaataatgtcaaattacagtgaataattttaacattttgttaaattttttgcataaattttggcttccattagaaatacgtcattgtttgagttccgtaataagatacgaaaaaatgcggcgaaaaaaaaaatgctaaaaatgggtgggaaaacaaacattaaatttttaaaaagcatatggccatggaatttggaaagaaaaagaggctgaagaccgacaagaaattcaatacaaaatatttaaagccgcagaggaacgggctgggaacacaaaaagccagaaatggatgaaatttcagaaatttaatgaaaaaattgatgaaaaaattttcgtttaaatacccgaaaaaaagctttggaattcccccaccaaattccaaaaccaccaaaatgttttccctttaaaa

SEQ ID NO: 41851 - DNA, 1011 bp, Heterodera glycines
agtttttccttcacattagaagactctttctgtttcctctccgtctgatgttgtgacatgcatttttccctttttgtcgggcggctgtctggcgagcggactatggggaggaaaagacagacaaattggaaagggacagccgggcgacggaatgggcgaattaaggagggattggacataaaattttaaattataaaataaagaaaatttatgtaagtgaaggtgccaataaaattcctaatggaaataattgcagtaatacagatctgatttagcaattttcattttcattttacaccagggatggcacgaattccgattttctacatttttggggtcggaattctgattttcgaaaaaattttgatcgtcggaattccgacttccgaaattttttgataaaaagtcggaaattttcggaatttttttttaattttttcaaaaaattactaagctagactttcgttcaagggtaaattaaaaacacttaatggttctgaaatggcgtgtatttaataggcataattgttttttggcgcaactgaatttcttggcgaaatcaaaatttaaaaataaatttttagtttttcacaaatttttattgtaataatggtgaactacttggaggagatgtgaaaaaggatccattcattctttttgagttcccggcgccactgatactccaccagcgtttctgcaaatcggaacccagggatgcgtctctcgcgaaaccagtccttcgcgggcctccaactcgcctagatgcgttgggtatgtgtgccatcctcagctacaatttacacaaaataaatacctcatttaacatttcagggcaatccacaaggcgaaaatcctctaatccgtcttcgatcattccttaacacgaaaaccattattttagttttagaattaatggtaaccttatttttaacttcgcaaaagggagcatgcgaagacggagcaagtagtgggacgagacggagggcgggggaagcagtctgacgagtgcca

SEQ ID NO: 41852 - DNA, 117 bp, Heterodera glycines
tgcggacatctacatttttgaattgaaaaaaaattggtctttttctttctttttctccatattgaccatcatactcatactctccccacccttttcttcttccgccacccacctccc

SEQ ID NO: 41853 - DNA, 999 bp, Heterodera glycines
aaaaaaaagggaaaaaagagaaaaccatttttggcaagaatttttttgtttggggttccaaatatcttaagattgttgatagggccagccagagaaaggcaacggtggttcccaattttgcggtaaaaaaatggaaaaaaagagatagacatttttggtcaagaattttttttgtttggtttcaaatattgtaagattgttgatagggccagacaagagaagacaactgttggtaacatttttgcggtaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagatagacattttttggtcaagaattttttttgtttgcgtttcaaatttggtcaagaattttttttgtttgcgtttcaaatatcgtaagattgtttgatagggccagacaagagaaggcaactgttggtaccaattttgcggtaaaaaaatgagaaaaaagagatagccatttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaatagatagccattttttggtcaagaattttttttgtttgcgtttcaaatatcgtaagattgtttgatagggccagacaaaagaaggcaactgttggtaccaagtttgcggtaaaaaaatgagaaaaaagagataaccattttttggtcaagaattattttgtttgcgtttcaaatatcgtaagattgtttgataggg

SEQ ID NO: 41854 - DNA, 1171 bp, Heterodera glycines
agcaaaaatccaacgcagaattaaagtacaggctatagggaagctattcccgaaggattcggtctccccataaatatgagcgcatcggtaggggggacggcccgagaagccaaaaaaaaattttttttggataaaaattatttaaatgaactgactagataatatttaaaataggttatttctcttcctttcagtatccctgcaaagtttggtgcgcttctgatcagtttctgaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctgaaaaaaatatttatgaattaattatgcaaaaaataaataaataatgaactctcctccttaataaaaaatccaaatatttaaaaatctataaaaaatttaaaaatgagaattcatgcgagattttctggaaataagcttatttgggcctagttaagctgtaaaaaaaatttggggcgatttgaaagagaatagaaagagccaggttcgatgatgttttggtaagccaaaaaaaatccaaacatttaaaaatctataaaaaatttaaaaatgagaattcatgcgagattttctggaaataagcttatttgggcctagttaagctgtaaaaaaaatttggggcgatttgaatgagaatagaaagagccaggttcaatgaagttttggtaagccaaaaaaatatccaaatatttaaaaatctataaaaaatttaaaaatgagaattcatgcgagattttctggaaataagcttatttgggcctagttaagctgtaaaaaaaatttggggcgatttgaatgagaatagaaagagccaggttcgatgatgttttggtaagccaaaaaaaaaatccaaacatttaaaaatctataaaaaatttaaaaatgagaattcatgcgagattttctggaaataagcttaatagggcctagttaagctgtaaaaaaaatttggagcgatttgaatgagaatagaaagagccaggttcgatgaagttttggtaagccaaaaaaaaatccaaacatttaaaaatctatataaaatttaaaaatgagaattcatgcgagatttt

SEQ ID NO: 41855 - DNA, 871 bp, Heterodera glycines
  misc_feature (812)..(812): n is a, c, g, or t
gaggacaaaagggacagaggaaactttttcaagaaggaaaggaggaagccaaatccgatgatgaccttaaaaggaaaggaaaagcctttgaaggggagggggtgggagggaagcagggcttacgcaaagattgctgaaattgcaggattttcaggattttttttgggggggggggggggtcaattgcggattgctgaatctttccagtctcctaaattttgacttttgagcagccccatcctggccaacatcacccgaaattctcttcaaaatttccaaatccgattgcgtgcagccccgccgccggagggagagaccattgtgtggatgtcctggaacattgggtagttggcatggacacggttgtgcttgtcctcctcgtggttgtggaactcgccaaaagaggcgaacagaacaacgaacagcgactgaaacacacacgccaaaactgagaattggcgacgctgaacgaggaaaagaaaggtaaatggatgaacaggaagaggaaaaggagaaggggaaggagagtaagaagaaagggagaaaggaaaggaagagggagacaaaggaggaaggaaaagaaagtagaaaaagaagagagagtaagagggagacggagtagcaagatgaaaagaagagagagggtaggaaggaagaggaaaaatagtaggcgaaggagagaaagagagtaagagggagacggaggaggaaggaagagaaagacgaacaggaaaagggagaggaagaagaaaaagatgaaagggaacgggagagggaggagaaggaggaggatgaaacaagagagaaatcanaaggaagatatagaagagaggaggaaggaaagaagagaaagatgaaggggaaagggaga

SEQ ID NO: 41856 - DNA, 888 bp, Heterodera glycines
ctctaattcgggggggggggactataattcaataaataccgtaattgtattttacgtataaatatgtattattcatttttcgccacgcacccgctccacgttcatagtcttgcatgcgttcttggaatgcacggatttgactgtcattcagatgatcagcgctgatcgttatcagctgttccgcgaacgggtcacgctggagcagtgcatgcaacggcacgtgcggtggcacaaagtgcagcatgcacaaaatgaacagcacgcatttccagggcgagacaagctgaaacaaggcactttccttttgtgccgttcttcgatttaaagtttcttaccacataggtttttgaatgacactcgcgcagtcgtgcaccgacaactgatagcagccgaattggtgccaaaaatgagcgaggatgcacaaagttttgccaccacgctgatgaaacgcacaccgcacagacaaacgcaaggcccggcatactgtagacggcactgtgcctggcgtactgtataaacacagcaaattagagctactcattgacatgttgtatttccgaatttttgcctaatcagaaaaacatataccgtagattttgatgctgtactctcaaaagcacaataattctcacagaaaatagtaatctaatatactttaatacaacacctagtgtattttcttatactttacactctcggaaaatacagtaaccaaagaatactgtattatttatatatgcctgttcatgttgctttgctgccggttgagccaataaaacggtgaactgggccagcaatgcgctgatgtcgagcagtagcagaagcggtagccaacgccccgggggacggctaagggcctagaaaaaatttaaaaatttttttgaattt

SEQ ID NO: 41857 - DNA, 1155 bp, Heterodera glycines
tgccgtgccaagagccactgaacggctgtcctccggctcgacgatcaacggacgtttgccatttttgttcctaaacatttacgggtaaatggaactgtatatgtaggtatatgtttgtaaaatgggaatgcaattcacctttttgacacccaataattgtatatttgtccaacaatttgtgccgatacgcccaaatgtgctgcaacaatcttcacatcgacgtactgctcaaagtgctgttgcatttcagagaggcgattcttctgaaaacaaaatgcattaaataattcaaagacaaaaaaggggttgacattttgtcggggctcgagtccgagttttcgaacacggtcggccaaatctgtttgccatgtgttaaacaaaagccttattccatcgaatccatctcccatagtttgacgaaacaaacattgaatcggaaatttctgctccgttggtgctgtgatcggcttgaatgtttgccacaaaggctgacgtatttgactccgttcagctcgcggtcatcgttttcaatgtccagcacaaaattagcaaattgggcgcatgaaacatggaaagtctcgtcacatttgggatgagtgcatttgatgcaggcacccgaacgagtgtcgcaaacgcaacacctgaaaatgaagggggaaatggcaaaaaaaattattggaattatttttcaaataattggcacgaattctctgctgtacaaaattccacttgcctcgctcgccatttctctgccggcacttcgttgacgtgagtaatcggctcgcgctgctccgcatcgccaaagcgaacctcgatgatgaacagtgcacaaacgacgtgcgcccaactcttaaaatggactttttatttgggaagatttcggatcctgtcgcgggattgggattcaaaatgttgctgactcccccctcctaaaaattcttttataaaattttcaacttaaattttttttaaaacttttcagtgttttaaggggggggggcgacctgctccacaccagggatggcattccgaggccccaaaaattttcggaagttggaaaccgaaattccgggggtcaaaaattttccggaagtcggaattccgaggcccaaaaaattttcggaagtcggaaatcggaattccgtgccatccctg

SEQ ID NO: 41858 - DNA, 1273 bp, Heterodera glycines
  misc_feature (1241)..(1242): n is a, c, g, or t
  misc_feature (1252)..(1252): n is a, c, g, or t
  misc_feature (1258)..(1258): n is a, c, g, or t
cgatgacaaaatctttgtttatgtgttgatgatggatgttacaaatagggttcgagcctggcccccgtcacccccgcctccccgggcgcgggacatggtttttggcctcaccccgcccccgtgactcagacccccgtcttcaaatgctgtattagcctgcaaaattccaaaaaatttcgtaaattttgaacaaatttatggccaaaaaggttggagaatttggttttttgaatttttctggccataacgactaagaaaaaagttatagccaaaaacccgcttgggcccaaacgtgccggggcccaactgacgggttccgtaagaatggcatattcgtgagataaaagacaaaaaacttattcaattttgaattttttaaccaccttgaaccagaaatccaagcccaggcatgaaaaaatgtatttttttaaatcaatttttcatctttttatggtgaaaaactgataaatttttatatggaaatcggatattccgacagtaatgagcaaaattaaaaaacaagcagcttttttgaacatggatgacattctcgtaattaaaattgcaggccctaattttaactttaacgattggattgtgcaaatcgaatggcccacattttgataacaaatggatgcgttggcgtttcaacgttggcagacgctgattggctgaagtgaaattgcagttcggggagacgcgtgcgcttgcgaggaaggccagacagcgaagaaaagagacagttggatggttatggttagacagcgaagagaagcgagagcgaggattttgtggagcagacagtgcacgcggtctgcctctctaaccaagccaataaaattgcagtgatcaaattaaaggcaattaattaattgtttggaatatgctattttacacccaaagtatttaaacattttcaattttttttttgccaatgggacttactcgcttcttccttttaccttttttaggtttttgatttttataatttttggcaatgggcaaggattagaaaaaatgataattaatcatttaattcagcatcaaaaaatcctaaattaagcattccgccactcatgcgcgtttttaaatccgccaatataaatcaacatgcattatttaatgattggcttttggtaaaattaaatttataaaattttattaacttttactttttgctttgaaattgtcattattagggtttccttttttggcacaaaaaatatcgaaatagcacctannaaggcataanaatcgncaaatacctaggcat

SEQ ID NO: 41859 - DNA, 988 bp, Heterodera glycines
gagattttctgggctgtaatgttgtccgtagaagggcgctcgagcggccgggtaaggatagcgagggaagaacgaagcaatttcagtcggtgcaaacccgttgaaatcgttttcacgctccaaatcaatcgcgaatttccacggattgtcccataaacggcaaatcacaatctaatgttccatctgaatagtaataaaatgatcatcacttactctatcgactcttgcatagtaatttctagtcgcacttctattatccaataattgttccagaaatcggcaatatccgcaaactgtacttgaaacagagacatcagctcgtctcaatcctcttcattgaaatcaagcagttcgaaaatgaattagtctttctagaagaatacattgcaggcagaacatcaaaaaatactctcccatcactatcggtgtatccttacaacattctagcaggtctggcgtgcgtggagtctttgacttcatgtccctctcgttagcatacttcgcaaaaaagatcgtaatagtcaaatacatcgcatggacgccaaaaaagagacttttctctatggtaagtgacgcaccgccaaaatagtgatatttaactattatagagacgaacctccaaaatactgattcccagtcacgaacaatgccctccaaaggaaacacttttcatccgaaatgcgttttctgagctcctttcttcaaatcaatcgagcaaaaaaaaaagtttttccactagaaatcggccctagaaataaccaaaaaattctttgaacgaactttgcgtaacaaacgaattgatttgatttacacagcggcccaattttgggctccaagtacaattatgctggatttttggtcttagtggtctgtgagttagtcaccaaaaagtgggtctcaggttcaaatcctacctatgttgtgtgttaatttcaatttcttcttttaaagaagaaggcagaattattttttcattaataaaagtttt

SEQ ID NO: 41860 - DNA, 937 bp, Heterodera glycines
  misc_feature (48)..(48): n is a, c, g, or t
  misc_feature (59)..(59): n is a, c, g, or t
  misc_feature (63)..(63): n is a, c, g, or t
  misc_feature (70)..(70): n is a, c, g, or t
  misc_feature (74)..(74): n is a, c, g, or t
attactataaaaattaggtttttgaataattaatgccttttaggggcnactctcatggngganactggcnatgnagtctttgtgtggttaccgtgtattatttatccgttcgagtactatgaaaaagaattaatttgcgtaatttatttatatttaacacttcatatgtttacagttacaagaaatcaataatgagccatttataaatttaatttgtgcctttttaatatagtagttaattgtcatattatattcaataagaataaataataataataatatatttttatataataatttgtaacaaataaaataattaatgactaaattaaattgtatatttagtgaaggtttacatattaaattttttagctttttatcgttttcattgacactctttattaagcctcaattatatattttttaatttatagaaagatttaattaatttttagagtgaccgagcttcccccgtccatgctcaggatcgatcccgactctttgcgaaataaactttatttattactattagtttgtttattgatttgtaaattatattatttgctaaaatggtattttattaaagaattactaaatcgatgttttaaaatttatgataaactaattgttgtatcaatttggtaagtttcattcgagttggaatgtttatatgaaacattgatctattaattatttatgttttggtagattaaagcattttgtatttaatatattttttcaaaaaaatatttttattttaattttaatttaatataatttaacttattttaatgttgtttaaatttttcctttatatttgttaggggtgtatttttggttttttgaaaactccaattagggggtgtatttttacaaaacttttcgccaaaaaatattatttttttccttttggcctccatttttcaaaatggtaaaa

SEQ ID NO: 41861 - DNA, 447 bp, Heterodera glycines
  misc_feature (6)..(6): n is a, c, g, or t
  misc_feature (9)..(10): n is a, c, g, or t
  misc_feature (12)..(14): n is a, c, g, or t
  misc_feature (18)..(18): n is a, c, g, or t
  misc_feature (35)..(35): n is a, c, g, or t
  misc_feature (43)..(43): n is a, c, g, or t
  misc_feature (47)..(52): n is a, c, g, or t
  misc_feature (55)..(57): n is a, c, g, or t
  misc_feature (440)..(440): n is a, c, g, or t
ccccanaanngnnngagnaccccaaacggacacangaaaaaancgannnnnnggnnngcggggcagaccccccgaaccgaggcgcccagacacagggggagaccgaagccgcccggaaaagcacccccacagccaggacagaaacccggcgcaggagagaagccccccaaaagaggcggagaaccccaaacggacacaagaaaaaagcgaagacaaacgagacggggcagaccccccgaaccgacgcgcccagaagcaaggggagaccgaagccaacgggagaagcaccccaagagcccggacaacaaggcagcgacggaaacacgcgccccacaacggcacgagaaccccaaacggacacaagaaaaaaacgaggaggaggaaggcggggcagcccccccgaaccgacgcgcccagacgcaaggggagaccgaagccancgggaaa

SEQ ID NO: 41862 - DNA, 843 bp, Heterodera glycines
tgatccaatcgaaattccgttcagcgttctgcaaattttttcgtcactttgtcagacaaaaaattgcgcatcccttgcaacaactcgagcacccatttgcttgtactctgaatttaattaaaccaattaaaaatacaaaaaaggataaaaattccaaaaacccaaattttcaccctttccttttgttcgtccgtctcctccgttggccatccgttgtttaaggcatgccaattgtcccatttgtcagctttaaatttgtataaaaatatctcagaaatgcccttaaatgacttacccccttccaaattgctgggtggctcatagccaagccaagagatccagcagatttcggcttaaatttaatatgtatttaatttactgttcttttcaaatttttttttggtaattaatttgattgtcattttctattttaattatattaatttataatgtatttaaaataccgtcatcgaaattggcagatggaacaactgtttgttgcttcagcttttccatattcggatgatcaacttaaaagaataatctattaaaaatgaattgattttattattaaattaaatttattaaatacatatttaaacaataaattctcccccttccaattcctctgactatgatgccacattttcctcccatatctgctgatcatctgtgatctgcttctgctgtcactcctctttctcaataaccattttatgccaaaagatttcaccaaaatatgccctgcaaatgatcgtatttacacaattttcattttttaaatggttaaaaatgtgtctttttgtcaagagaataatacactgattaaaataatccagaaaa

SEQ ID NO: 41863 - DNA, 935 bp, Heterodera glycines
  misc_feature (58)..(58): n is a, c, g, or t
aaaccgggacttaggtactcagttgtacgtgttcttttaagccaggtcccggtcccgnacaactctattcttcaccttttaagtttccgatgttaaattatttctttaggagtctcatattttctttgctttttccactttttaggcaaatcctaaaacaattaaattttctgaacgaaaaatgagaccattttaatttacgaataaaattaaatatacacaaaataaaaatgtacatttgttacctcaattattaattgtgtgaaaatattttaaaacttattcccattaacaatttaaatacctcaaaattgataccaactgttgccttctcttgtctggtgctatcaaacgaacttactgtatttgaaacccaaaaaaaaaaacttcttgaccaggaatggctatctcgtttttctcatttttttaccgtaaaattggtcgcaaaagttgaattctcttgtccggccctatcaaaggatcttacgatctttgaaacgcagaaaaaaaaaattcttgaccaaaaaatggctatctcttttttctcatttttttaccgcaaactgggaaccaacagttgccttctcttgtccggccctatcaaacaatcttacgatatttgaaacgcaaacaaaaacaattcttgaccaaaaagggttatctctttattctcatttttttaccgcaaaattggtaccaacagttgccttctcttgtctggccctatcaaacactcctcctatacttgaaacccaaacaaaaaatttcttgaacaaaaaatggttatctcctttttcgcatttttttaccgcaaagttggaaccaacagttgccttcgcttgtctggccctatcagacaatcgtacgatatttgaaacgcgaacaaaaaaaattttttgactcaaaattgtctatcttttttttctcattttttt

SEQ ID NO: 41864 - DNA, 1285 bp, Heterodera glycines
ttttcgaattttgccgattcctgggcagtgaatgatcgttctttcttgcgcgatccgtgaccgcgggaatttctaaaccatggctacacccctggcctcgcacccatggctttgccattggattaaggtcttagcaaggttctatcggtatattcgttcccttttagaatgtcaaaatgggattgtggtaaatcattttgaaaagcaaggagcaaaaatgatcatttagtgggcctgctgatcaatccaatcaatgatttttataatttttaaattatttccactttctgaccgtgatgatgcgagatggaaccgccgcatgtgattatctcattccgagcagcggtctgcaaaaatttgtgttaatgttcgggctgattaaagcggcgatgagattgggagtcgaagattttcaagtttatactttagactttagcatgggaaccgggtcgtacaattcaatgagtttttgaatgatctcgagacttggaaacgggccaatgactcaaaaatctaataaatttccctaaaagtccagagaagctaatgatggcaagagtcgcgagcagcgaatatgatgaatggcacagtacctcaatttgctcatacacatgcaatgggtccttttcaaggcctcggcaattgaagccaaagtaaaaataaatgcaggcgccggcatcgtacacttgggtgacactgaaagagaagaagcgaaagaaagggcgcaatttcagtaatggcgggactaattaataactgtttgctaatacaccctcttttgaatggaatcattggaaatcgagtataaaaatttatggaaaattcggcattacatccgaaaatttaatcagccatcaaataaattaatgttaactgctgaccggcacgtggccaacaccgggtatttaatgccgtgccgtcgtgcctcatgcaccagcaaagtgcgcacatttcggcacacgtccaacacgcgtgaccttattgataaaacagtgaatttaatccgcaaattataaccgttttttttaccaaggcactgatgtttcaaaggattcaccttaattatggtggtggttaagccataaacataactttgtgatcaaaaatatttgcgggacttaaacttggccacaaaatcccattcacaaatcctaccgatgactgcgtaatccatggccatgtcctaaatttattttttcttcctagccgacaatgtcaatgagatgtaagatgatggaacttacccggagatatgcgatgacaaaagtgagtcgatatccctaaa

SEQ ID NO: 41865 - DNA, 928 bp, Heterodera glycines
ttaattttaagttaatttttttactttatttataattcgaataattcttttacaaattttgctaaaattatagaatcagttttaaacaaacaaaaattccattgtgtagggggaagaggagattttatgaattcttcccgtcataattatcatcataaaatcttattttttcatttgctattttttaaaattttgatacatttcttggcatttttgtgactaaaactgtcggcacaaacaatcaaatcaattcaaatgcatgtgaatggcgctggcggaatggaaaatgaatgaatggacagatgttgattggcttttctttgtttacaatatatgtattcttttttgtttacattttgagaaggaattcctctgctgtttgccgaatttagttgatcaatttcacaataaatatttgcatatttccagaaatgaaagcattattttttagttgaatttaaaaatgcaaaatgcgtaaatgtgtattatataattgtctcatactatatcaaataggttttctcgatcacttgcaatcattgggattataatggcttgtgtttttggtcaacattttttacaaattgctttatctaaaaaaaaaaaaaaaattccagcggcaatttttagcacctccggttccttcccgtaaaaaataattaaaatgaagggcaaaaaattgatggcgaaaaaggcgaattcttccatccaaatctcaaaatcattgtcaaataagtttttcctggtcaaaatttaaaaatgttgaatctaacaaaaaatatgattaaagcactcatggataatgaaaatggtcatttctgctcactttttttacaatatgattaaagttttatgaaaagtgcccattttgatcagccaagggctgattttgaaaattacatatgggaacactggcaaaaatctcaag

SEQ ID NO: 41866 - DNA, 743 bp, Heterodera glycines
cgccctttcggtgtttgccgttgtctctccacgtcccccctaacggagaaagtggtcactctctctctctctgtgcttcattgagagtgcttcttcgatcagtgcgctgtaggtgagcgtctccagcacttcaaatacccactgatcagcccccccccctcccctcagaggtcaatgtttaccctctgccctctcgaattttcatcccctcctctcttccctacccctgccggctaaccccaaagtccactcccaccaaagcggatcggcccgaccagtgctaatttgggatgctaaagcgccctgatgagctgggccggaccattattctccctccgccgattgtttgtgaatgatgaagctctctctctcacaccgcaagggtcccttcccccccccctcccctccccccgttccaggctgatagtctgcccaaccaaataacctctcaaatttcccattaaatttaaaaaacgcgctgaaattaataacaaaatgaaaattttaaaaagaatttttaaagaatgaatgaaaggcaataaaaaaacaactgcacattatgagacatcgaaaaatgaccacaatttccttacaattagcaaagagaaaaggacacagcccaattgagaagatgggtcaaccacaagcacataatcccacaagatcatcccttgcacagcggaaaaagtcaatagcaattggatgatcgaatgagacgaccaaacaatgggaaaaaggggggg

SEQ ID NO: 41867 - DNA, 1087 bp, Heterodera glycines
  misc_feature (77)..(78): n is a, c, g, or t
aaatgattttcgggccgtttgagtatatgtgaggtatggacggtccaaaaaaatggctatcttcttttttggcatcnntggtaatagaaatctctttggaacaatgacagtggctgtcatcagttgttatgctctaaaaatgattttcgggcggtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtggggtatggacggtccaaaaaaatggctatctctttttttggcaatctggtaatagaaatctctttggaaacaatgacagtggctgtcatcagttgt

SEQ ID NO: 41868 - DNA, 1601 bp, Heterodera glycines
ccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagtctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagtgggactgccccgaaaacccaaaaaaaaattttttggataaaaattatttaaatgaactgaccagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaaatttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagggtaagttagtcctttacccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatattgaaaaagcaattaaaaaattttaaaatttaataagtttcctgcaccgaaggtactcactcggcctcttcgcggcctcgtggtgggccttcgcccccccccccctcccacgcccttcagagcacgacaaatatttcaacaaaaattatgaaatcatgtttcccactcccttctcccaggggtatagaaggtaaagtctttttttcccccaataaacttgtcaaacccc

SEQ ID NO: 41869 - DNA, 1245 bp, Heterodera glycines
aaacaatataaccaaaattttaggaaaaatttcttaaaaaattttttttccattttcctttttgatactaaagcttcagagtgtaaattaaagtgtaaataaaatttgggtgcgctttagagcactttctgaaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggtgcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggagactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcaattttttcaagtgtccgtttggggtactcaaacaattatggggagcaaaaatccaacgcagaattaaagtacaggctataggaaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtcgccccataaatctgggcgcatgcttaacttgccagatcggacgggtgcgcatgattccactgttccaagcaccccaccaaaagcaaaacgatataaccaaaatataaggaaaaatttttaaaaaattttttctccattttcctttttgatactaaagcatcagagtgctaaaattaacttgtaaataaagttttgtgtgtttcagagcactttctgaaaaaatatttatgaaattaaaaaatcgatttattcaagtgtccgtttggggtactcaaacaattatggggagcaaaaatccaacgcagaattaaagtaca

SEQ ID NO: 41870 - DNA, 631 bp, Heterodera glycines
ccccccccccccctccccaacttttccctttcctccgtctcttttttgtgcccagcggcatctattctaattaggcaccggagcgacgaagcaatgtcagacgccgaaacgttgtcttgccgaggggatgagaaaagggaaaaatgggaggaaaaaaaagaggggtggagagaaaagagaagggaagaggaaaaggaagagagagggagggggagggggagagaagagagaagaagggggagagaaaagagagagaaagtggaagaggaagagagaaggagggggagagaagagagaagaagggggagagaaaagagagagaaagtggaagaggaagagagaaggagggggagagaagagagaagaagggggagagaaaagagagagaaagtgaaagaggaagagagaaggagggggagagaaaagagaaaaacgagtgagatggaagggggaggggaggcggacgaaggaatgaatagggaagagtcgcgcaggaataatacataacaataaatgccaaaactaataataaataaaattcacgagaatgaaacgggaggaattccttttcagataatatagtgccagtgtgattattttgcgggaggattgcccggggccaatggaccgc

SEQ ID NO: 41871 - DNA, 943 bp, Heterodera glycines
ttaaaatataaccatgttcaatatgccaatgaagaacatcaatttgtagcaggcattgtccattatcgtgtaaattgataccatacacggaatgtacagtagcttaattttcgttaattttattttaaattttcgagaatttcttgcattttttggttcacggtctcgagcataggaaattttcactctagagcagccctaactcctcccaaaaaaagtgacctcaaaaatgaaaaaaagtgtgattaaaatgcatccgttcacaatgtttgttctttcttcaagtgggattttgtccgcattaaatccgtcacatccatacaatttgtcaaattcgtcatgacgaaacagcaacaattccattggatgactttttttaaaattaaaaataaaattaaattaaaactatcaacaaaaatgtgagtgcaaattggtaaagcatgtacaaagcattatttgtgggatataaagcaacaattgttagttaaatcttgtcaaatggaagtccgcttgagaatatgagttgtgtgaatttgcgtgccttttgtaaactttaagtgcgcgacactaaaacgtgaaagtacatgaaaaatgatatccatcacattttgtagtaacagaaacatcatagcaattgtcgtgagaaaaatgtgtgttatatatccaacggattcgctcagttgggcccgtcaggtttgggccggcacggttgggccgacacgtttgggccgaaaatttattaagaaaaaacttaaaaattcgactttttttagcaattttcgtgcctacctttttggtaattgtctaatcgcgaagcaatagcttagaaatagcttctaaacatgttaagctttcgaatgatataaaattgttggatttggttggcaaagaaaaaagttgtagccaaaaacgtgctaaagaccaaacgtgacggcccaactga

SEQ ID NO: 41872 - DNA, 1079 bp, Heterodera glycines
tttcctttctacacaaactgatcatttcacaaattgaggccatccgtccgtgctcggacgagttttaaaaacatttcagatcagccgaaggaaagtgtttgtctctgtgcttttaagagtgatcagactttctcttttcccttccgctttgatcgatttgtcggtggcttaaacgccgcccgtccaaaaggtaattaattaattagtgaaattagccaccgaagaaaaccgccgatgtttggccaatctcggtctaatgaatgaacgaataatttattctctcttctcactattggctataaataatatttttttaaattgccaaatattataaattaaaaagagaaaacagaaattttagatagaattcaacaaaattcgaaagctaataaattaaatcaaaacaaatttaaattttttgcgaattccttaaaaatcactcaaacaaattgaataaattaaaggaagttggggaaaagaaagaaagtgcttttcagggaaataaattaagagaaagagaggaaaggagaagagcatttaaatttaaattgaaaagacattaacacataaaatttaacgatgaaatttttaaaattaagccaaaaagtgaaaaaaaatgaaaaagaaattatcaatcaaaattatgagaggtaattaattaataggtgcaaattatgtatacaggaaaatgatcaaaattgaccaaattataagtgattgatcaaaatgaaaaattaatgcaataaaaaaatgcgtgctcattcttcgcatgtttttgatcaaaaggcagctgctgatcaaatgcaaaagtgaaactttgaccattagcagctgatcaaattgagagagcagaaactcaaatttaaaagtgatttttacaaaaatattacaaataaaatctaaattttcgttttttggattttgggtggtccttccgtccgtccgttcgcttttcaaatgggcgccaaatttgcggtgttaaattgttgggaccaaagtgttattatttttcgtccgtttgtgtgccgccctctctttttgcctatcttcggcttaacaaggccaatttgccaaaggcg

SEQ ID NO: 41873 - DNA, 924 bp, Heterodera glycines
atggtaaatcaatgactaacaaatttaaatgatctgaccaattaaaaggctactagaattgctttgatatcaaatccgaatgattaattaactaaattgattgatgcaatgatgacaaaacatttgtgcgcagtgtcaatgcctgcggcgattatcatgatgccattgcgcacccaatggcattttggcgagagcatcagcaaatccaatgatgagcgcatggagtggatggaaatttgctgatagaaactctccgtttttggcattccgagcgctcgcagccgtttgagtccaatgtggcaacagaccttttctaggaatgttgtcctgttttccaactaacttgtaacctctagagtctctgtttagagtcttgacttgataaaattatgacttatgggtctcgagtttcgggaaatttgcggtctcgcaaatcgctggagagtgccataacggggccagcagcaggtgctttggtttgtgaactttcaactttttatactaattattttatatcgattttgtccagcataaatctaaaattgtcagaagcgcaatagattttacaggtgtaattgtgaaaaaatgaggacctcattttaattgtatatgtaaatttttgtttttatacattttcgacattttttttatcattttctgtgtatatttttccgaaaaatccaaacccagcagaagggactcacttgtccccgctctcagctgaacaccaccaccaccaacaacacataggtggtgtacatactctgctggaagttcacatgcaaatccaacaattgaattgcactgggttttaagaatgggtgtctctcccgtgcccccccccgcccctccacgtcctccgtcggttttgctttacctcataaaatcaattttcatcccctcatccccgaacgcactcttttt

SEQ ID NO: 41874 - DNA, 1337 bp, Heterodera glycines
tgcaaatcaatttcatttttatttgttatattgattttgcatatttgtatattaataacattttattgacagaatatttattttttaaatgttgcactttggttgctctattagctcataaaactttcagaagatttattgagtttaaaaaagttgtaacaaaaaaaaattgccataatttatagaaaactataaaaaaaatttctattttattttttgatggaataaaatattctttttagtatttctttaaaataacttttatatttctaatttcttatcctcgttcgcgtcccacggtctaatcccaatttaagaatatagcaatttattatgtgtactaattatattgaatgcaatttaaatttactataaaaataaatagctggaagagggaaatatttaaaatcaaacatcagtttttgactcaaattattgtatatatttttgctattctattctattcgctttgtaaggtgaaatactaagtttatcatctttgtttattatttagagttagttattcagcgctctaccacaaaaaccaaaaatttagcatatttagtcgagatcctagtatgaatatcttttttatatggaaatctgcaaaatttaattttaaatagcaattaaaatatatattaatcagttatcagcaataaataatttaataaaaataataccaaaataatttatttttcaaaaaataaaattcaaatttgtccaaaattttgtagcaatattaatttaaattatttaataaaataaaaacataaaaatataaaaaataatgctttaaatgcataaatagctggtttcaaaaaaatttattaaaatttaaaaacgatttaaataaaacaattataagaaatagaatccaaggttaaacgaaaaatgcaatgcgatttcggagagcatgaaaatgtcaggcatgaagaaccaaaagccataaaaaatttaaagtcaaattactattgaaatgaaagcaataatattacctaaataataaatatcattgataatagttgaaaagagaaatttaaggccaagaatagaaattagccaaaaattttaaatttatttatacaaaaatataaactcaataaaaaaatattttataaaatttttaaagcctacttttctgaggcgtaaattccgaatataggtagattttttggacacctctacgacaaatttaaggggcggtatgagcgctccccccaaatatttgaacaaaattttgttctattttagcttatgacataaaatatataaattgggcatttatatcatataaaagcaatttttattaaactttttatcagttcacgcgaaat

SEQ ID NO: 41875 - DNA, 869 bp, Heterodera glycines
  misc_feature (768)..(768): n is a, c, g, or t
  misc_feature (810)..(810): n is a, c, g, or t
  misc_feature (835)..(835): n is a, c, g, or t
acaattattaaacgactcagggattctaaagaaaaggctatatatatgttttaaagttttcgttacactggtactatttaacacggcgagtaaattttgggctctcagtccttatataaaaagatgaatgtgtgtacactatgggtacgccccagtgtccgacaaaattgctcataacgccaaatagcgcatttggcgtaaatttttgcgcgttaattcaaaatttacactggaaaatgccttttttgtattttttattttgatctgccataactcgcttcattcccaactaaactgaacaaaattggtatctaaaaaaagattttgaaaaggagaatttttttctaagcgaatgttaagtaatttgtcatctcagaaaaaagttgtgggaatttcaaacttttatcatgttataactcaagtcctaaactgctgttttcaccaaaaatgctaaaactattaatttctctattgattctaaatgttcaaagtgattttgtatccttataaccaaaattgttagcatttacgaatttgatgttttttcatgtgttagagacatgaaaatagtacgccaacacgagaggaaaaagaaatacgtttttattataaatttataacttttgatttggactatagacaaaaatgaattcactatagaaagatgcagaattcttttctctatcgctatgcaaaatttggtgtggatttaacaagtaggaaaaaagttaaacaggatgaaatgaatgttgctttttacataattanaatgaagagatagtacgccaaagtgagagaaattacaagaanaagagaaacgacgagatagtactangcttttctctgcacagtggggcgtacccatagtg

SEQ ID NO: 41876 - DNA, 1192 bp, Heterodera glycines
attactatgacaagattaaaaaattaactttacactttctatgaaactgttaaataaataagtagacaaaaaaattattacaataataataatgaagtttttttgcttacaacttaaagttaaaaaaattgtaatttaccatttcttcaaaaacctttttttaaatatcataaaaatgaaaattaaaatttaacaatattttgtatattttaaaagcaaaaataccaaatttgtaacgccaaatgtaaattcatatatttagagcactcacaaatcattccttaatcattcattatgctattatcattaggttaccctatcaatgaatttttttctatatttgcgtatttccatgttttgacgtaaaaatgtgatcttagtttatgtgttttatgtgtgcttatccattataagaattagattataaaatttttcgtgtttttatcaaaattccaaaaatttagaaaaaagcccggtcccggcgggtacccgataaaaattttgaacagggcccgggacgcccggtaaaacgagcttttttgaacgggcggccatgtcccggtaaaaaaaaattcagaaaaaagaaaaaattaataataaaaaggaaagaaaaataaaaaaactttttccgggcccggttccggccggtactttcaaaattccggtctctaattctttagaaaaaaatatacataattataatttaggaagtaaattaatgcagcaaaaaatctttcaagaaaaacattattatatcgagctaatattaattcaataatcagattttaaaattaaaaaattcagcaaaataaaaggaattaaatagaatatttcataatgcacattaaatttatgaaaataatgaatatttatgaatttattagaaaataaaaggtacaagagtaaaataaaaaatatattaaaatttataaaaatcagtgactaatgaataattttaatcacataatttaaacattctttctgcagaaactatccattctgcaaataaaatgtaatataatataatttggtagaaattccatatcaaaataaaaaattggaatatatttaatttaaaaattagttaatatttataacaaatataatatctggcgagagtaggcaccaagcagatgagagtggctgtacttaagaacaagagagacacgctgtgaaagtggcgaggtctaat

SEQ ID NO: 41877 - DNA, 1084 bp, Heterodera glycines
  misc_feature (168)..(168): n is a, c, g, or t
  misc_feature (1049)..(1049): n is a, c, g, or t
  misc_feature (1073)..(1074): n is a, c, g, or t
aagatgcgcataaaggccttaattaaacacaagaacatattcatatattttgtgtaattctatctcggactcacttatgctcaaaataatgagtttaatgcaaaaaagatttgagtagcggatactacgaagatattttaaaattttcatctcttaattattttaatntaaaagtagttatactttttctgtctgcagctgtttgactttgaatactgcggagtaaaaataggaattttttcttttcactaatagaggacaatttttggcctttcttgattagctatcaactcgcttctattattaaagggttaaaagatgcgcataaaggccttaattaaacacaagaacatattcacatattttgtgtaattctatctcggactccctcctgctcaaaataatgagtttaatgtaaaatagatttgagtagtggatactacgaagatattttaaaattttcatctcttaattattttaatttaaaagtagttatactttttctgtctgcagctgtttgactttgaatactgcggagtaaaaataggaattttttcttttcactaattgaggacaatttttgttctttcttgattagctaataattttgaaaattactcaccaattaaaatatacttgcatttttcaaaagaggtattcataattttaaaataagcacatatttatagtgagactgttttcaactcgcttatattattaaagggttaaaagatgcgcataaaggccttaattaaacacttgaacatattcacatattttgtgtaattctatctcggactcacttatgctcaaaataatgagtttaatgcaaaatagatttgactagcggatactacgaagttattttaaaattttcatctcttaaaattattttcatttaaaagtagttatattttttctgtctgcagctgtttgactttgaatactgcggagtaaaaataggaattttttcttttcactaattgaggacaatttttgttctttcttgattagctaataattttgaaaattactcacccaattacaantatacttgcatttttcaaaagacnngtattcataa

SEQ ID NO: 41878 - DNA, 957 bp, Heterodera glycines
  misc_feature (27)..(28): n is a, c, g, or t
  misc_feature (37)..(37): n is a, c, g, or t
  misc_feature (943)..(943): n is a, c, g, or t
agtaattatcaaaatgacatgatatanncaaatattnaattaaaataaaaattaaaataagaaaataatatgaaaggagatttagattaaacaatttttttattaaatattagattgaactttagaaaatggatgatcaaagcacttaaaaattgataaaggaaatgcaaaagaaatagaaaagtaaaaaattccatgagcaaaaaatattttaatttgaaatcattaatactaattttaaaactacaataaatattatatcatcaattttataaaaagaattaccttttattaaaaaacggtctaatataaaatattacttaaataaatactattaactatttaattgaaaaccgttttcaagaaatggacgaattgtcattcaagtgcaataaacaaagggaatgcgcgtgaaatttagccacatgaaaaattaaattaataggacttaaaaacatataataaaaattgatgaagaaaataaagtacaacagtgattaaggagctagaagcaatgaaaacataataaatcataaactggtctatgttttaactttttcaaaggctataatttcccaaatttgtacactttcgtgatttaaaccggttcaaaaacaggtttaaacgctttatattttcatagggaacatgtttcgcgcatttggggcatagccagaaattatcacaaaatgatgtaccgaaatgcaaaagactgtgctttttacacctcttacaaatctcgtaatgacaggggcagtaatgacaacacttaattttatgtggacagttcattttttcaatttaattttatttttggttgctatttatagaaggggtatataaagggagtgaaaggaccatttgattggtacattgtatcaaaaattcaaaaaccgataatcgtaaatataattgctctcactaatctcggtaccggaattanactaaactctctga

SEQ ID NO: 41879 - DNA, 1011 bp, Heterodera glycines
  misc_feature (947)..(947): n is a, c, g, or t
  misc_feature (987)..(988): n is a, c, g, or t
tattttgattatttttcttaattgcgagactgaaaagtgaaaaagcttcttactggcaagcaactgtctgatgcttgacggcgtctccggtccatcatcggcagaagaagtagcttctaattagacaattatggttatttattctactttaattagtttttttttttttaaatataattagggagctaggtttttcccattttacaagcctaataagaacatgaataataagaaattgatcaaaactcttgattttccttcttttttataggatcttacttttttaagttctaaacccattaaaatttttaaagatatttaggttttttagttcttgtatcccacccatttggcagtttttggtgccaaaaaattcgttcctcaaattttacaccgttttttttaaactgcaaaatcatagtttatgttcagtccgaaatatttttttatattcaattatttcaacttactggaagaatttttcgtcaattcttttgatctaaaacttgttgatgatgtatcatattcagaagcactattatccacttcatcatctacaaataaatatattattaaattatgttttttaatttgattatttttaattttacaaaaattgaattaattatttattactgttaagcatatcaataataggcgtggtgttgttcatgattttctgttccgttacattttctgtttcttgaccatttattttgacagatttgttttcaaagtcaatcttaaacattttaaaatttatatattatatttttattgaaacattattatttttaccaaaaatttattttcgtcgctttcattggcaaagaaaattttgtgtttactttcaaataaaacatcaaatttttttctgatttgctcattggtgaatgtttcctcaccaaatttgagttgtgttggagaatgaatttttacgaaaattntttcctttatttcattttctgcattttgcttaatttctcnngcacctaaaatatttataaattt

SEQ ID NO: 41880 - DNA, 559 bp, Heterodera glycines
  misc_feature (504)..(504): n is a, c, g, or t
aaaacctcacaaatcgagcgtttaggataaaattatcataaaaagaaaccgctgggccatgcagaccaaccgctcaaaatttccgatggcaacccattgaaattggtgccctctccacaatgtttgcttttttccctggatacgaccccctaaaaactagcggatggtgtcaatcacagtcattattaataattattattagtatccaatttgttgcgctccgccgtcccctaggccgcccacgtcggcatcgtcgtcgccgtcgtagtccaacaggtcggcatcatcgtcaaagtcgtcgacggcattgttgttattgttggcaccgccgcccatgccaatgccgtccattggcgacgggcccaagcccagcaaaaatgggtccgccgatatggaccaccggcgcacaaattggacacaatggaagaggaagaaggcgctgaagaacaggacgaagcaggcgcagaacatcagggcgtaagacagcacggggtactcgctgancaacgcgctcacaatggtcagatgggtgcgcacgcgcaaagtggcggaggaaagc

SEQ ID NO: 41881 - DNA, 706 bp, Heterodera glycines
atttcaaaattttcaaatttttttattttattttcttcaaaacggttcagaattcaataaaaaaatcactctcggggtgaaaaaaggggttttagaaatttttaggggaaaaaaaacttttccaaattaatcccctgggagaagggagtgggaaacatgatttcaaaattttcaattttttctagtctaatctactcaaaccggttcagaattcaataaaaataacattcacggtgcgaaaaatggggtatgaaacgtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgaaaagtttattggggaaaaaagactttacaaaataatacccctgggagaagggagtgggaaacatgatttcaaaattttcaattttttatagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttatagtctaatctactcaaaacggttcagaattcaataaaaataacat

SEQ ID NO: 41882 - DNA, 934 bp, Heterodera glycines
cttatgaattattttgcaaaaataaatattaatgaaaagtcagatttcgaaaaattttaaaacaacaagcgttggcattttttcaggttaagttagtcctttacaatggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagatttttattcatctccctttttgatagtgaaagcaagggagtgcctaaactaacctgtaaataaagttttgtgtgt

SEQ ID NO: 41883 - DNA, 1438 bp, Heterodera glycines
cgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaattttaaaaaacttattttcacctattttggcattttgcccaaaatttgttaacaaaaatgcaataaaaaggaaaaacagacccctaagaatcgaccgaaaatttttttcaaaaaatatacccctaagaatcgactcgaaaattttcaaaaatatacctatgaaaaaagaaaaatttctcaaaaatcatctccaaaatttatttgtttattttcttggcgagaattttttattttgaaaattatctatctcattaatgatttggcataatatttttgctttttgaagaaaattttcgattttacaccccaaattcggaactttttggcacctattttcccatttttagcacctattttgggggttttttagaacctaaaacctacttattttggcagtttttagcacctaaaaatcgaagccctacctataacccttttgaatttaaattaacttaaaggcaaattgtatgaaaattaaacagattatgtaaaaaaagaagagcgtcggggtcggggttaaccccgaaaaatggccaaaaaagtcgggggtcggggcggggtcggggacgcaaccctaatttaaaagaccaaatcccgtaaaaaatttttttgttccaatcccaacttattctcaaattaaaatttccatgctctaatatatatatgcacataaactaaaaattgcttttaaacatgcaaattttttcagctaaaacattttacaaccaaaaaaaaaatggttcgtcttattcaaaaccaattttggcggggaacgttgacgcagccgtggggtgtcaagatgttcaagtacatttggcgcaagcacagtcgttttttggtgaaaactgttatggtcagttttcgtttttatgacccatttaatttttcaaaatttcttttttcatcccattttaaggtccaagacaatgacatcgacagctcgtttcatctactgaacaggttatacacacattgagtaaatttagctcattctctaaaaaatattgaatttttttttttgccgaaaagtttaaaaaaattagacagactcatattctcaaaatttcgggggtttttatggctaaaaccaaaaggatggatgggaaccgcccatttttttctgaaagggtctcagattcgtgaattaaccaaaaggtttccctcttcgtgttatgacttttacggtccgacattttcgcctttgtccaaaattggcttcaaaattaagttttcaatccctaaagaaagaataagatttattaattttatgctgtttaagctat

SEQ ID NO: 41884 - DNA, 896 bp, Heterodera glycines
aaaaagggggtggggggaaggcccaccacgaggccgcgaagcggccgagtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggtttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaaggatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaattttttaattcctt

SEQ ID NO: 41885 - DNA, 1142 bp, Heterodera glycines
gagaatgcggttggaattcctagtactgttgagcagaaaaagagatagccaatgatccaaatttttcccaaacaaacgccccgagaaacaaattccagaacaattagtatcggcgtaattattctgagaatgcggttggaattcctattactgttgagcagaaaaagagatagccaattttccaaatttttcccaaacaaacgcgccgagaaacaaattccttagtatcggcgtaattattctgagaatgcggttggaattcctattactgttgagcagaaaaagagatagccaattttccaaatttttcccaaacaaacgcgccgagaaacaaattccagaaattagtatcggcgtaattattctgagaatgcggttggaattcctattactgttgagcagaaaaagagatagccaattttccaaatttatcccaaacaaacgcgccgagaaacaaattccagaacaattagtatcggcgtaattattctgagaatgcggttgtaatccctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaataattagtatcggcgtaattattctgagaatgcggttgtaatccctattactgttgagcagaaaaagagatagccaattttccaaatttttcccaaacaaacgcgccgagaaacaaattccagaacaattagtatcggcgtaattattctgagaatgcggttggacttcctattactgttgagcagagaaagagatagccaattttccaaatttttcgcaaacaaacgcgacgagcaacaacattcagaacgattagtatcggcgtagttattctgagaatgcggttgtaatgcctattac

SEQ ID NO: 41886 - DNA, 1001 bp, Heterodera glycines
aagtcaagtccagaaaggaatattttaaaacgatttctgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagagaagcaaggggctgtggctgggggcctaaaatttgggccacattggagaattaattctgatttctgaaaaagtcccagaaataactattttttctttccataccttcttgtagagctcgagctgctctttccagtggtcttatcccggtctcgatccgtgccgaactcacaaagttatggagtgaatgtgaaatattgttttcacccacaggcattttttctgaaaacggattcaaa

SEQ ID NO: 41887 - DNA, 718 bp, Heterodera glycines
ctgctgtcggttggtgccttatgtgctgctgccattggctgctgatgcttaaatgaacccaatccgatgcttactttccccctccgtcaatcgctccccccccccccccctcaatgcttaaatgacttttgtccgccgtccttcgccttaaccatccctctccctccaccccaccaaatgctcgaaatcccatttctttaggttgagacgggggaggaggaaaactgagaatggcaaaataagtctcagtaagccgctcagaggtgctcaaagaagcagcactacttggccaaaaatgtaaaaaagcaacttctctatttttatataaaaattgtaaattaattcaattaaggaataattttaggaatcattaagcatgaaaaaaacatgtaagccccaacatttttttctatccgaaatatgtcctccaccatcccagaacataactctttttgccaatgtgagcaaagcgcccgaggggatgcaattgtgtggtgccggtgccgttgtgagtgccgcccgccgaaaagactgatgggaagggtcggtcggtcgaccgacggacagataatcaatccctcctccccttggccctgctcctcttcttgccctgggatggatctgctgctccccgtcccatcccatcagcccaaacgatgggctgtaactctcccaaaacttttttttttgtctgtgtcggtaagaacgacagcgaaga

SEQ ID NO: 41888 - DNA, 876 bp, Heterodera glycines
  misc_feature (66)..(66): n is a, c, g, or t
  misc_feature (76)..(76): n is a, c, g, or t
  misc_feature (92)..(92): n is a, c, g, or t
  misc_feature (99)..(99): n is a, c, g, or t
  misc_feature (101)..(101): n is a, c, g, or t
ttccagaatttctggaaattttcgatttttcagaaactctttaaaggtgccttctgaaaagctatncgggaaaagnaaaacataaaaaaaanccgcaangnttttctctataatataaattttattttacatttttatcacatttaaaaaaaagatacaaaaataaaagtgattttggggttcgggaccaaagggggtggacagaaaaaacaaaaaaaatatttaaattaaaaaaattagaaaaaaaaactttttttttaataataaaaagaggcatggcaagttcgaatccgggcggtgtatattatttactatgtatttttggattatgtttaatgtttaaagagtgtttgttttcttaataaaaaaataaaaatttttaatttaaattaaattgttttttttagtgaaaaatttaattaaaattaattattatttttttaattaaataatttcatattttttttgggggggggcaagttcaaatccacacggtgtacattatttttctgtgtttttgggttaaatttcattgctttttattaatttaaacgctttattttattaataacaaaaaaaaattaaatttaaatttattatttttggtgaatgttttatttaaaattaattatttattaaaattaaaaaaatttcatgttttaatttaatttaaatttcatttcaatttcaaatattctataattctatatgctttatagtttatttttaataaagaaatggagaattattttgttatattaaaaatattattaatattcaatttctcttttttttaataaaaccatttccttatttatttaattttgaactatacttcttttaaccataattgtactcttccaatcactgttttac

SEQ ID NO: 41889 - DNA, 911 bp, Heterodera glycines
tttgcagcaaaaattattcgaatttctccaattttgtttccataatttccgaaagttattcggtatcataatgcccttacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaattgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctc

SEQ ID NO: 41890 - DNA, 718 bp, Heterodera glycines
  misc_feature (354)..(354): n is a, c, g, or t
  misc_feature (692)..(692): n is a, c, g, or t
tattaattaatttaaaattaactaatttattaaaaaaaaacagttttttttttaagattagagtcataaaaaaccaaaaaaacctaaaaattatattttttattttttggatctaattaattttttttcctaagttatctcttttggaaaaaaagtaaaaaagattaattagatcccttttcattttaatgtaataattatatttttgtaaaaaaaggttttatttaatttttataatatcttaatgttaataagaagtttttaatctttttattttttgttttagttttttggtttatctctccgttttctttctgtttcccttctttttttcgttggttgcttcgtttcttntttgtggtctttgtcccgttcccgccgcctcggctctgcgttttttccttttttcctttgggtttttgggtttttttccttttttctcggttttttgtcttttgtttgggctttgtttttttttgcgtcccctggccctccgtttcttttttcttctcctgggtttggctcctgttgttttttcttttttcgttcttgcgtggttttttttttttttttggccggcttgcgttggcgtttctcttttttttttggcgtttgttcctttgtcggggcggcctccgtttttgctttttttttttttttctgtctgtttctcttttttttttctttccccncccctcttttttttttcctttttttg

SEQ ID NO: 41891 - DNA, 751 bp, Heterodera glycines
  misc_feature (706)..(706): n is a, c, g, or t
gatgataaatcatgtatgactcatccttcgtcatcagcatcatcatcaattagtagttccccaattcctccccctcccccggctgattattatatattattattactattttctttgtcgtcatcgccggccggccgccgacgcccgggggggggggcgtctccctccgcagccgccccctcaaaaagcggcggtgagtgcgtctgatgccccaaatcagcagcagcaccacacagaaaattataatcctctccaatcgctgtgtttttcctcaaaaaatcagcacagcccctcccccccccccctctcctcaatgaattgtttatttatcttccctaagtattagggggggggggagttccatatttggccatataggcctgagattttgcgggtttccacactgttcgaaagtctcggttttggttctataggtgtgaaatctctctggctttttggtctcttaaaattaaattttgatttcaagttttttgggatgggtcaaatcagttttttgcgacgactaaaaaaatttttttttgaataagcaccgtcgggggaaaaattgagaattttgactatttattggactctcgagtaggcccatcttaccccctgttaccgaccacaattaggcgcctattttttctagaaatttctgcaaactgccaaaatcattaattaagtttttttatatttaaaaaantaataaatttttcaaccatttttcgttttttcatcgcttttagcc

SEQ ID NO: 41892 - DNA, 987 bp, Heterodera glycines
cctaaataatgggggaaaaatggaaaatatttgcccaatctattaaaaaggaaaggacagtttggaaattgtgtgcacaaaccttctgtaatgagcacgatgtatctgcaaattgcatttttgaatcgacggccccaaacaaaataaaatgggaagccaaccaactttcttttcccgtccgtccgttcccaatagtcgtaaaatttgacaatgttcggatgttggaggcccttcagcatttcggcttcctcccgaaaccgctggcgctccgctttgttcaacttttgttcctgcaattcacaccaagcgacagcaacacctgcagaaacgaatgaattgtggagtgatgtgatgccaatgtgaacaattgcatttgcctgtttcagtgtcaagaccccggtaaacagttttgaacgaaccgcgacccaattcctcatcaaatttcaaaaatcggttatctaaaggatcgatttgtggttgacctttgagccattccctcccgctaattaccaggcgatttgtcaatgggcttttcctcgtcatagtcctcgtcgtaatcctcagcggattctcgtcgtgattccgcctctttcttgacctcgtctagctctagcgatgtctgtggcttcaaagctgtcgatggtattggcacttcttcctccacttttgcatgtgcgctcgcaacaggcaaaaaaggaggcgttggttctggtgacatttcagcaacggggacggcattttcgatggactcggtcggcacaactttggcaggcaacgcagagccagcaaaggtggcaagtggcaacggcgacttggcagcttcgacagtgaatttggaacggacggagggaggagcagtgtccagcgagggatcaacgacgggggcaggaaaatgcaactgaaaaagaacaaagggagtgagacgagaacctcgataaataggcaagacaaaatgatactttttggcgagattggttttgcctgttc

SEQ ID NO: 41893 - DNA, 844 bp, Heterodera glycines
ggcgagcacatacataaaggcgagtgaacaacggcaaatggccgggggatgggctaagggaaggtaatcacccgagggaaagtcgaacaaaagcacatcgcaatgtcaaatggtcacactaattcaggaaatgaaaaggatccaacccgagggtccttaccgactgatcggctattcctacggcgcttgcgttggctttgagatggccactcaactccaacgcagcgatgggaacgaaagtgtggagaagctgattctgttggacggttcccacctttacatgcagacgtacagaaacgtgagtgaacgaagggagaagcagtttctcgtggctttgctcagaagctcaacaaatgaattcttaggtttaccgcgttgcgtttggagtcaccggcgacactttggtcaacaatccgttgttcgagtccgaaattatgtgtgccatgactttacgcttcgccaacgtcgattacaagcgtttccgcgtggaaatgctgcagttgcccagtttcaaagagcggctccagcgcgtggtggacacggtgatgggcactgggctcttccagcggtcggacacaatcgcattcgcagtggacgcaatgcgacacaaatttgtgatggcggacaagtgagtattgctgcttgttggccattcccggcattcgcgacaatttataatcacttctcaggtacaaaccgaaggagactttcaagggccacataacactcgtacgcgcggaacaaggcgcggcacgggaagaggacgtcggcaaggactacggcatcggacaagtccgtttagcgcattattccgttattattaaaaactaggggttgctccccg

SEQ ID NO: 41894 - DNA, 1126 bp, Heterodera glycines
  misc_feature (44)..(45): n is a, c, g, or t
  misc_feature (99)..(99): n is a, c, g, or t
  misc_feature (111)..(111): n is a, c, g, or t
  misc_feature (124)..(124): n is a, c, g, or t
  misc_feature (1078)..(1078): n is a, c, g, or t
aataaaaaagtagctgtattaaaatttttttgataaaataatgnnttgtataattatctttatttaactgtttgttctcttttgttgaaggaataactntaattttggctntcagaaattactntagttggtttctaaaaatgacgcttatacagttttgaatctgttaaatgaattagtatcaaaaattatttcatttaaaaccgataattcataatgagaatgatagcacccgagtttctagagagaagcattagagttttctagaaatatgctggcacccaaccacaggcactaaaggaatatttttacgacggcatttcttttttcccatgaagaattggcactaataaggaatattgaatgttttttaacaccactaagcaaataataaaaaagtagctgtattaaaattattttgataaaataaattgttgtataattatctttatttaactgtttgttctcttttgtttgaaggaataactttaattttggctttcagaaattactttagttggtttctaaaaatgacgcttatacagttttgaatctgttaaatgaattagtatcaaaaattatttcatttaaaaccgataattcataatgagaatgatagcacccgagtttctagagagaagcattagagttttctagaaatatgctggcacccaaccacaggcactaaaggaatatttttacgacggcatttcttttttcccatgaagaattgacactaataaggaatattgaatgttttttaacaccactaggcaaataataaaaaagtagctgtattaaaatttttttgataaaataaattgttgtataattatctttatttaactgtttgttctcttttgtttgaaggaataactttaattttggctttcagaaattactttagttggtttctaaaaatgacgcttatacagttttgaatctgttaaatgaattagtatcaaaaattatttcatttaaaaccgataattcataatgagaatgatagcacccgagtttctagagagaagcattagagttttctagaaatatgctggcacccaaccacaggcactanaggaatatttttacgacggcatttcttttttcccatgaagaattggca

SEQ ID NO: 41895 - DNA, 1020 bp, Heterodera glycines
agtttacaatataaagataatattaaaggagcaattagtgaaaatgcatataattagaaatgatctgctggcgattgatagattgtacaaaagcgaactttgagactgaaaataagtcaaataattacatattaaggagctttagagaaaatctgccactcattcactaaaaacacataaatgagaaaatgtaatgaatacaacacgtcaattcaattaaaaatgtaaaaagattccaattgattaagcttgagtgtggcttaagcttggatgtgccccccacgttttttgtttattttttgctttgactctcctccatttgacatcaattagcacatgccaatgccaactccgtcaaatttgggtctgagcaacaacattgtgctgcttctgctggtgcagttgtgctgccgctgctccgccgtccttctccaagtcgccgctgctttcacccgtgtcgaaagtgacgctaccttcgacaacgctcggcgtcgtccctccgtcccggtcgccctcctcgctcaattggcccaattttcccgcctttaagccgcgaatgcgtcggcgtcggttggccaccaatttggcggacaacacaaaaccgatggacaacaatagcaaatactccaagacgaacgcgaacagaaacaaacgttcaatcagagcggaatacaattcggcggaacaggcgaaaagtggcgagagctgaaagggaagcgaaatgccaatgaatggggaagcaaaacgaacggcgaaaagctaagaaagccaattgaacggctgtgcatttaagtaaagccgcaaaaaatgccaaataccgacctccttatcaaacgtcgtatcccaaactcagatgcccttctgtggtacttacccgggccagctattttacaaaaaagcatcgggattggaagtcatcaaaaggaggttcttaagccagatgattccatcctctgtttttgctttttcattccagaacaaaattcccgactcaaaacttagtttcacgccagtgctggg

SEQ ID NO: 41896 - DNA, 801 bp, Heterodera glycines
ccccccaccccacccctcccacgtcaccggaggggattgatcgtttccccacacccaccgatgaattaaaaaaaggaaattttaaataatttcaactataaagccaaacaaagtctttaaaatgatcgcgctccctggaggcgtctaatttgtacaaaaatagggaacccacatagtatttgtgtcaatttccattaaaaaataattaattaaatggggtaacctgacggtttttgccaatgatcgccttcaaaaatcttggaaattaaaacattacaaaaatgttttaataaagtctgagggtccttttgataatttcgaggatggctggcgcctatttggcgtcgcccatttgattggcgcccaattttttaagtgcccatttgattgacacccaattttttaagtgccaatttgattgacacccaattttttaagtgcccatttgattggcacccaattgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttcttattcaattttaagtgcccatttgattggcacccaattttaaggcccatttgattggcacccaattttttaagtgcccatttgattggcacccaattttttaagtgcccatttgattggcacccaattttaagtgcccatttgattggcttttaagtgcccatttgattggc

SEQ ID NO: 41897 - DNA, 1015 bp, Heterodera glycines
  misc_feature (880)..(880): n is a, c, g, or t
  misc_feature (905)..(905): n is a, c, g, or t
  misc_feature (956)..(957): n is a, c, g, or t
  misc_feature (970)..(970): n is a, c, g, or t
agttcagctggatcgaatggggacctacaactcagcgcatggatcgaaatcgagacaaacaacggccaaatcgagactcaacggcttacccttcacccgggagtgccggaaaagtggggaaacatcgaccatcgcggtcatacccacctcactcccgccaacgccaatcctctcggcatacttcatctcggacggacgagccatcggcgatgggaaaccccatttcttcggatttgcactcgctcggacgaagaagcagcgcgaggcttcgacaaatgccaattggcgatcgggtcatgccaaaaatgcgcgccgaatcacgagaacggaactgttcactgccattgccgcaacctcgagattgagcgggtgctgaacaacccggaacaccgcctccctctcgacgttggacggctgcacgttcacaacaaagggccaacagttcaagcggagttccaatacaccccagtgcaggttcaaatccaactcaacgagctggagctggtcagcgaatacagcaacacgaagtgctgggtcggctcgccccagctcagcggatgttaccggtgcatttccggtgcaactttcgaagcaatgtgccggacggattacggcactgcgctcgccaaaatcaaatgcgcagatggcacaatgtttggcttacactgcggggggaatggcactacgacgactgagtccatccccttcgatcgatcggaaattttcactgagtgccaagtgaaatgcccggcggggacaacaaaatttaaacttaaaggggggcttgctttcatccccaaacagcagcaattcggctttagccagcgagatccagcgagcggtcacatcgagccgggcagcacgttcaccctgacatggncaaatttgggggatttgaccccttntcactttcttcgattgctctcgacgggacaatggtggcttatcgccgtggnnctcggaatcatcngcttgggcggcgcttttcgtcttcatcaaatttcacccccacttt

SEQ ID NO: 41898 - DNA, 937 bp, Heterodera glycines
gtgggttttccccaaaaacgcaattctattcgcggttgagcccttcaaaaggtcggtttgaaaaattctttctcagaagaatagatttttcagaaaatggctatccctttttctacacccgttgtacatgtggggtttccccaaaaacctttaactatctgcggttgagccctacaaaaggtcggtttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcagaaaatggctatctctttttttctacaccgttgtacatgtggggtttccccaaaaacgcattactatctgcggttgagccctacaaaatgtcgggttgaaaattgctttctcagaagaatagatattctcagaaaaatggctatctctttttttctacaccgttgtacatgtggggtttccccaaaaacgcattactatctgcggttgagccctacaaaaggtcggtttgaaaattgctgtctcagaagaatagatattctcaaaaaatgggtatctctttttttctaccccgttggacatggggggtgtcccccaaaaa

SEQ ID NO: 41899 - DNA, 1348 bp, Heterodera glycines
atatatatatatatatatatatatatatatatatatatatatatatatatatatatatatattgtacattttttctgaaattagccttttattttttctttatattcaaaatttctttactcttttctaatacaattttttatacattaatgcactttctttgtgtttgtaagtaagtaaaaatatttgtcggaaataaacaattttgtcaaaacacaaaatgtggcaaattacggaaatttttttgttgttacgaaataaaacaaaagttttccatcagttcaaaatttcaaatttttttaaaaattagacttatttatctgatttttgaatttcaataaaacattaagattaaaaaatgtattatttcagccaattaacaaaagaaacagtcatttaaaatgaaaacaatgactaatattgtaaaacattataagaaattgaaaccaaaatatttttaatgaaaaacaaaatgccggaatatgctaaatgattaatgatcatcagccgcctattcacattcacaggtgagttgcaccgaatgttgtgaccatgacaagtgcaacaacaatcacacgcttgattattattatgcggtgatggcacaacaatttacatcgtaaaaatttaaaaaatataaaattagaaaataaaaattatttttaagttggacaaaaccggtgaagaatgaagctaactacaataaaaagaacaatttgaaatttccttattaatttttagaatttttcatatgctttttgaaaagtattatgtattatcattagtcgctaaatcaataagctcttttgctgctattttggttgaatttcatatatatttttaaattttatcaccaaattataatttagaaaaattcacaggcaacattcattagtattaaaaaaactgattttctggcagacataagatttttaaagttaacaaatttttggaatttacatgcttctttgagtgaacattaatcatttttagttaaatttttaaattaatttaaaaatgcaaggaaattttcaaataatttaaaaacattaagcaatgggctgatggggaaggggtttatgtaattgaaatttcctgttttctaaatgagtgatcaaaaatgcttttacccgctgcagtgatcagttgtgatcaggttttatgggagaacacacacgtcaattgaccggccaaacaacagcagacaacagagtggaaaacctgtgataattgcgcaatgtcaacattgagttaatgaagctaaaacaatttatgtaattttgatttttatttatttattttcaaaaatatatattaccaaaaatatagctaacaaataaaacatttt

SEQ ID NO: 41900 - DNA, 918 bp, Heterodera glycines
aagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgataaaactttttaaaatataagcctaaactttttggcctgtttaaaaaggaattaaaaatttttaaaaattttattcatctcccttttgatagaaaaagcatcagagagccttatttaacttttaattaacattttgggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaattcgggtgcgtttcagagcagtttctgaaaaaaatatttatgaattaattatgcaaaaaacaaataaataatgaactctcttccttaataattttcctgcaccgaaggtactcactcggccgcttcgcggcctcgtggtgggccttcccccc

SEQ ID NO: 41901 - DNA, 1011 bp, Heterodera glycines
  misc_feature (983)..(983): n is a, c, g, or t
ttatttttctttaagaactttaaattatttttttcattgaattgcctgcgatatcatttcatccttttgcacaaatatttcaactaataacaacaaaaatatataaataaataaatttttatgtttctaaaagtttttctatgcttttattaattaattacattatttatgtattttttatttattttttgctcataattattttggttttgtataataaacgtgaattttgtgaaaaatgaatttttgacttttcgttagaaatcgggtccaagatttgtattgttcataatggatgtcaaaattagttttcccgacccttaaaacccaaaaaacaaatttatctatcaagactaattttatttatttttttgttaaaagaaagctttggacagtgtcaacaaaatttaaaaatagcctgaaagtaaaattaaagaaaatcaaatacttaatacagccattaaaaaattaattataattatagaaatttaatattttcataaataaaaataaataaaacatgaaaaatgagatattattaccgtgatgagacatttgcgccgcgccatttgcgccgcacagcaaaagtggacacttgcgccgctcagcaaagtcgacacttgcgccgcgccatttgcgccgctccatttgcgccgcgacatttacgccgcccagcaaaaatggacttttgcgccgcgctgtcaaaaatattatattcataaaaattccactattatcaataagttttactaaaactataactaattgaaaattcgaaaaaattactagtcacaaagattgacattcaattttttaaccattaaaatcttaacattgaataggttcatcaaagatatgaaaaaatgattaagaatacaaactaacaaaaaactgaaaaaaagaattttctgtagaaaccccaattatttttttgcttcgaaaaaagaatgaaattcaattcctttgggtgggattttctcaantaagttattttcatcgattttaatttaa

SEQ ID NO: 41902 - DNA, 1540 bp, Heterodera glycines
atttatatggactaaaaactttcaccaaatcaaaaaattttaacgcagaaatgctatttttaagcccctttcttcatagcatatgcgcagaaaaaatatgttaatccatataatttacaaccctattaattacggattgttggatttttaggcataaaaattgcgaaacaggcaccaaatttagattaaaaaaacccaaaaatttaaatgagaaataaaatgttgagaagcttcaaatccccaattgaaaaaaaatatttaacaagtgaaaagcgtcataaattaattgttcccagaagcaaccgaatcttgagaattccatattgtccgataaagaccaaggatctattacatattttactttcaaaattatttatttttaaagaaattatttccaactttgagtttttgataacaattttaaaaaaataaatttcctaaattttttaaacgcaagccaagtttattgtttgaatttagtcaagcaaaaacagagttaacaaatgggaataataataactagacaaaattatcgatctattttggaaatacaacaatattccatacagtataccctcgctacaaatcaaccatcactttgatcacttcctgtcaattcattcacatgaatcatttgcaatgacattgcaaatgcttcaacttgcaatgcaatttcctgcttgtccgttttgtttctgacaaggtatgcatggtaaagatcaaccatctgaatgaattggaaaattaattttaattatgtggtgattaaattaagtctaattattaactaattaaaccaattaatcaattaattacttttgctttttctggctcaagcgcaatttgagtgtcgttgtctattccatttgcttgacgagttgcaaatttgtagcgataaagcgacaaatcttcgccattatcttgacccatttgcgttaagctcggataaatcattttgtaaataggctattttgaaagaaattaatgtattggttaattaattgaatattaattgcttgtgttaataggcctattagttgtatgcactaaaatcttacacaaatcgccagtcgaatttttctaactcagtttagagttttgtccgaaggactaaggactaccgaagcctgcaaaactttaaaaattttcaaacgaataaatttttaaaaatccgcctttcctactagccagctgaacgctaactacttggtgatcaaatcttaaaaacaatttaatgcatacaaaaccaactagcttaaatcccttaaaatgtggaaatagcctaaaaatggatattattcctaattaattaataattgaattggcatcaatttcattttttaaattgtccatttacgctttctgtcgcttccaccaccaaataaattgtgcccgttttgcgttcgcttttcgtcctcagcccatgcaattttgtctttttgatttcaaagctgctcagttccgatgtttgtatctcattaaaatcgaatagaaaggcgccttcgcaaaatgccgatttttttgcttcaattgtttgcag

SEQ ID NO: 41903 - DNA, 1006 bp, Heterodera glycines
  misc_feature (52)..(52): n is a, c, g, or t
  misc_feature (952)..(952): n is a, c, g, or t
aaggaaatcgcacaataaggaaacgtataaaaccccgagatagttgaatatnagaccagtttgaaaccaatgatatctttattaaacagcattaaacctatcagaaaagtaactttttttgccaaccaaaagggttctccataaatatgaattactctcctcgttatttataaatccattttagccgttatttttattattatttcatttttaattttttatgtttttttgaaattaaattttgtgtttttattttgaaattttaaacgcagatttccaagcacaatctttgatagctatttatttgctaatttctctgtcgaaccacttatcaccggtttctacagactttgaatccaatgaagaatctgatcccttaaataagggtaattattattttttttttgctgtgatagttgtaatattaagcaattatttgacaaaagagtgattttaggttaattatagctaagaaattatgtttaataattttggcctttggtaaaacttttccatcggtgaatttgtttgttattaaggtgtaattttcgttgttgcaaatgcttttactcgccaatttctttcatcttttctttgacacttgctgccgccatttcactgtatctcttctgttttgcgtccatttaatgcacataatctccatggaaacagaatgcattatttgttgcttgcttttagtgaattccaacagaatgtgccaaattggccaggcattttggagaaatgacataattatttcaagcaattcttgctttctgaatcggagcaactgggctcaatttagccaatgtttcggaataaatgcaatttataagcgggatcgagattttttggaaaaaccgggacctgaaaacccgagaccgggactttttctttgaaaaatttttttgaaaaaattgaaattttcaaaaaaaattcataaaaataattnctagtgaaagtttccatttttcagctccttgtttttgtgtgtgctgcttccaaa

SEQ ID NO: 41904 - DNA, 1655 bp, Heterodera glycines
  misc_feature (1643)..(1643): n is a, c, g, or t
agcgatctcatcaacagatcattcattcatcagcagtgacgccgcgcaaaaatgcctatacgccttccgacctttttcaagatgttggctcagactctacaatggcccaatctacaatctcttcatccatctcacaaaattgtcgtgaccatttgcacaaatatgcatatgcgtcctcgtaagatccatgaaaaatctaagctaatcaaatatttaatggaaaaacaccgtaaaggcggcttttactttgttatatctgctatctcgcgccatcattttccaattgtttcagaagttcactggtctcttccccataaaattcctcatacaatgaaagttccaccttcgcctctaatgttttaatttgtttgaccacaatgggaaccggaagtgtcgcttcgtgaatttataaaaattagcccagtagttttctccgtaattagtcgagcctgcctaattacgaccgatacaaaggtctgatcgtaggcacagcacatcgctcacacaaccaccttccgttcttcagatcgaggcgtctctccatcagcaaaattcggtggcagaaatccgggcccatcaagaaccaaatgcgattggaacgacagatgatgcacagcactcggttcgggccgaggagggggggggggggggggggaatgggagcagaggatgggacgcggccgcgattcgcaacctcggcaatttattccgcgactactttcccgacctactttagttaagcgactcggttcagaaacaactcgcccggctgcttcagctccctcccccaattggacatgttgtcggcatggctttggacccacagaatcggcttgttttattccatcgttcgggtcgcatttgggatgagcagtgagtgggcaaaaccacaaataataatgagtgagtgctgatggtcattcccttttagttccttcgacgagaataatcggttcaaccggtcagtgacttatcagtgccaccgttaattggtaggctaattggactgacttttcctcatcagttcactcggagcaattcccaacgcgaccattgctgtcgtggacagcaaaagtgggcttctgttggagtcccatgggcagaatctcttttacatgccgcacggactgaccattgactcggagggcaatttgtggcttactgatgtgggcagtcaccaggtgcacaagttggacaagttcttccgaccgacgatgagtctcgggaagaaacttacgcccgggtgggctcattcagctgagaattcgcaatcgtcgccttttgttcagttcggatgctgaacacttctgcaaaccgactgacattgctgtgtcgaccaatggcgactttttcgttgctgatggatactgtaacagtaggataatgaaattcgaccgcaatggcaaattgataagccaatttggccaccaaaactgtgagtttgttggtcggactatgaataatcacacatttagcgggaaatcctcctaaatcgggcgaattcttcgtgccgcattccatcgcactaatcgaagacttaaaccttgtctgtgttgcggatcgtgagaatgaacgcatccaatgcttctcagttgggcttggaaggcacaactcacaaaccgaaggggcgtatgtgcccacgnggcacatttgtg

SEQ ID NO: 41905 - DNA, 1468 bp, Heterodera glycines
aggaattatttcagctttttaagagccttttgaaatagtttttaaaggtgttcaaagacttttttccgccatgattttgaccatctctcacttcgtggcccatatcacattcattctatttttgatccgggcttttttggtgttgatatgaagtcgatatatggaactaaacatatatattaataagtacataaacaattgcccataatgtttcatttatttcaatttataaaccaaatgacaaaattgcatttttgttcaaagactttttttccacccacagggggttcccttatctttttttgaggggccgaatttaaaaaatttgattccttttttgaaagattgcctttttcagtttagcatacttttgaaaatccttgaaagcattttttaattaatttttttccttctgcgtcagatccccatccagcagaaaaatgtttggggaggagcgaaaataaattttttttctctttttggctccaaaattttttggctctaatgcactttatgagtccaatcgacttttatgagtccaatcgacctttatgagtccaatcaattgacaatcccgggtttttatacaataactctttgttcatgttcgaacaaaccctattaattaatcaaatcactaatttttttagaatatccacaaaattagcaaatttttatatgtctgctaaaaaatatgcaaatttgatcatttttggacaactcgtttaacaaactgcattatgggtacgctccactgtgcagagaaaagcctagtactatctcgtcgtttctctttttctttataatttctctcactctggcgtactatctcttccttttaattatgtaaaaaacaacatttacttctctctaagaaacttttttttccgttaatagattttctttaaactttgcaaaccgatagagaaaaaaattacgaacaaaatgtaagggtttttaagagcaaaaaaaaggttaactaaaaagttatggagttattaaaatttttgcatttcttttcctctcgtgttggcgtactattttcacatctctaacacacaaaaaacatcaaattcgtaaatgctaacaattttggttataaggatacaaaatcactttggacatttagaatcaatatagaaattaatagttttagcatttttggtgaaaacagcagtttaggacttgagttataacgtgataaaaatttgaaagtatcacaacttttttctgagatgtcaaattgcttagcattcgcttataaaaagattctccttttaaaaaactttttttagataccaaatttattcagtttagttgggaatgaagcgagttatgacagatcaaaataaaaaatacaaaaaaggcattttccaatgtaaattttgaaatagcgcgcaaaaatttacgctaaatgcgctatttggcgttatgagcaattttgtctgacactcgggcgtacccatag

SEQ ID NO: 41906 - DNA, 1166 bp, Heterodera glycines
ttaccaacatcctaaacaaaagaaaaaacacattttgttcacagtgtagttatgcggaaatatgtaatttaaacctgaaccattagtcatttaaaggttggctttatttttcattatttttcgtaatacggtctatcttttctgcagtaatcaacattcgattgtttctacatgtatacaaccaccctttaaaaaggtcaagaatttaactaaacaaagtgaagatcagctcgttaaattgaatattacatactcgtatagaaagttctgaaattttcatatatgctctattttattacaaatttccttctgtctttattggatttttatcggcaaaactgatgttaaataggttttatttttattaattgcagctttttgtattagaacgcgtttaaaaatagattagaaccgggaatcttgtcaactgtaaatgccataaaatcgatttatttttcttttccacaacaaattgatcgcaattgcaacaaagttataaaatttgcaatacaagtaagaaaattttgatttttcgctaaattttactaataaatataattggcaattctcgacctatgtttagaaacatacactaattacagtgccattattttggttcccacatttaccttaattatcaacatcctcaacaaaagaaaaaacacaattttgtccacagtgtagttatgcggaaatatgtagtttaaacctgagccattagtcatttaaaggttggctttatttttcattatttttcgtaatacggtctatcttttctgcagtaatcaacattcgattgttccattttctacatgtatacaaccaccctttaaaaaggtcaagaatttaactaaacaaagtgaagatcagctcgttaaattgaatattacatactcgtatagaaagttctgaaattttcatatatgctcgattttattacaaatttccttctgtctttattggatttttatcggcaaaactgatgttaaataggttttatttttattaattgcagctttttgtattagaacgcgtttaaaaatagattagaaccgggaatcttgtcaactgtaaatgccataaaatcgatttatttttcttttccacaacaaattgatcgcaattgcaacaagttataaaatttgcaatacaagtgagaaaatttt

SEQ ID NO: 41907 - DNA, 1102 bp, Heterodera glycines
aaaataacatttaaatacgccttacactctacagcagaaccccagcaagcgtccctccccagctccccacagagcatcggtgtgaaaattcacatttaaatttatttattaaataacaacatttaaatttaaaaatatatatttaaataacaatatttaaatattaataaaaagtcttacaccctatggcccaacccccagcaagcgtccctccacccacagagtatcgacgcgaaaattcaaatttgaatttagcgccaaaaggggcgacaaaagtacaggggtcactactggtgttttctaactaaaaacactgtatatttttggaacattttttcaattaataatgtattaaatattcgcaggacaaaattgctggcgatggttattcatacacggatgacaatgtgtgcgtgttcaacaatgtggtgacaagccgtggacctggtgagagaccttgctcaacaatttgattgaatttaatttaaaaattattaatttatttgatgaatggcaaccgattttttgcagggattttttgagtttttatgtatgattaagtttttattttttttaatctaacccaagttgcataaaatttggggtccgtttagcgtatggggtagctaaagcgcgaaaattttgagtctgactatttttaatgcatttttctggaaattttccaccccttcccccaatatggctgtaaaaaagccctagaaatcatcaaattaagaatgaatttctagcatagcccccaaaaaaaaaactgacaggaacccacggattttaattgtggcgcaattgtctggcgcctaactttcaaatcagttaaaaatttaggaaaatttaatttttataatttcaattgcaggcactgcctttgaatttgcgctgcaacttgtcgaaatgttggtcagtgaggagaaagcgaaagaaataagcaattctttgcttgtccattgatcagttgctcttatcaaactagtcaagatgagatgatcaaaaagcaatggaatatattcattgaatttgtgtgatggatacaattttaccaaataaaatcccacgtttaattttatttgatgatgatttaaattaa

SEQ ID NO: 41908 - DNA, 1366 bp, Heterodera glycines
  misc_feature (1214)..(1214): n is a, c, g, or t
ttttcgaaaatctgagtctttcattatttatttatttttttacaaaattaattcataagtatttttacagaaactgctctgaaacgcaccaaattttatttacatgctagtttaggcactctgatgctttttctatcaaaaagggagatgaataaaatttttaaaaatttttaattcctttttaaacaggccaaaaagtttaggcttaacttttttttcagaaacttatcagaagcgcaccaaactttgcagggatactgaaaggaagagaaataacctattttaaatattatctagtcagttcatttaaataatttattcaataaaaaatttttttttgggttttcggggcagtccccctgaaccgatgttaggcttaactttttttcagaaactgatcagaagcgcagcaaactttgcagggatactgaaaggaagagaaataacctattttaaatattatctagtcagttcatttaaataatttttattcaaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactngaaggaaaagaattaacctgttttatcacattagcttgtcatcagtttttataaaaaattttcaaaattctgcgtctcctattattttattttttttcaattaggggggggggggggggggggggggggggggggggggcggcacaaaaaaa

SEQ ID NO: 41909 - DNA, 1096 bp, Heterodera glycines
cttctcacaggggtattattttgtaaagtatttttttccccttagacttttcataccccatttttcgcaccgtgaatgttatttttattgaattctgaaccggtttgagtagattagactacaaaaaattgaaaatttcgaaatcatgtttcccactcccttctcccaggggtattattttgtaaagtctttttttccccaataaacttttcataccccattttcgcaccgtgaatgttatttttattgaattctgaaccggtttgagtagattagactacaaaaaatttaaaatttcgaaatcatgtttcccactcccttctcccaggggtattattttgtaaagtctttttttccccaataaactttttataccccattttcgcaccttgaatgttatttttattgaattctgaaccggtttgagtagattagagtacaaaaaattgaaaattttgaaatcatgtttcccactcccttctcccaggggtattattttgtaaaaagtctttttttccccaataaacttttcataccccatttttcgcaccgtgaatgttatttttattgaattctgaaccggtttgagtagattagactacaaaaaattgaaaatttcgaaatcatgtttcccactcccttctcccaggggtattattttgtaaagtcttttttcccccaataaacttttcataccccatttttcgcaccatgaatgttatttttattgaattctgaaccggtttgagtagattagactacaaaaaattgaaaatttcgaaatcatgtttcccactcccttctcccagggggcatgtttcccactcccttctcccaggggtattattttgtaaagtcttttttttccccataaatttttttaccccattttttcgcaccgggaatgttatttttatttgaattctgtaccgggtttgaagaaattaaaatacaaaaaaaatttaaaatttccaaatcatgttttcccccccccttttccccgggggaataattttttaaaaaaacttttttttccccaaaaaaattttctttcacccctttttttccccccggggagggtgttttttttttttga

SEQ ID NO: 41910 - DNA, 991 bp, Heterodera glycines
  misc_feature (114)..(114): n is a, c, g, or t
aaaaattgttttttttttaaatttatactttaattatttttcaagtgaaaatataataatttaaacagtttaaaaaatttctctatgtagtaaatgattgagtacttttttatntaatggacaaaaataacaaaaatttaataaaattgaattttctgaatttgttgactttaaaaaagtaccaatcttttcaaaggtgttggtaaaaacttggaattttctgagagtcctaaaaatattaatttttttttgcccttttttacactttttaaaaaaaatatttaaacaattaaatgaattatcagcattaataataataataatttggctctagtccagtttatgcgtccaatcgacttttatgcgtctaatcaattttaagcatctaattaattgcattgcattgacagtaaatctgaattccgggggcaaaaaattttccggaaactggaattccgaccccaaaaaagtaggaaatttatgaaaaaatacaaaatatactaagttttttaaatattttaataggctaaattttaaaagtcttcaccaaataaaaggtgatttcaaaaatattctcgatgtatttctattatctgcttaaaaattagaacatttttgggaaagggactgacgatttacaccttttttagggcgcgcttttccaaaaaacttttgggaaaataggatggtcggcgtgccgataggcgccgccacgaaaaatttttgtaatttttaatgcgatttgttaacagattttgtccaaaaatagcccaaatttagggattttgagcaaatttttcaagaaaattaaggattttagggtccggcggtgccgaaagtcgcagtcggaaaatttttgaaaatttcagtgcatttttttaacagaaattgtacaaaaatttctacttttttgaaaaaaaattaaaaaaatttccgaaaatttccgactttttatcaaaaatttcggaaatcggaattccgaccccaaaaa

SEQ ID NO: 41911 - DNA, 1246 bp, Heterodera glycines
  misc_feature (1211)..(1211): n is a, c, g, or t
ggggatttttttttttttttttttattttgtgcccggcttgttgggagaaataagaaaaaaaaaaaaaaaaaaaaaaaaatttaaacactttttttcccccccccccctttccccggggggtattttttgaatattttttttttttccaaaaaatcttctccaacccccttttttccccccgggaaatttttttttttagaattttggaccttttgaggagaaataagattaaaaaaaataaaaaattttaaaactatttttccccccccctttccccggggggttttttttgaaaatttttttttccaaaaaactttttcaaacccctttttcccccccgggaatgttatttttattgaattctgaaccggtttgagtagattagactagaaaaaattgaaaattttgaaatcatgtttcccctcccttttcccaggggtattattttgtaaagtttttttttcccaataaacttgtcaaaccccatttttcgccccgtgaatgttatttttattgaattttgaaccgttttgagtagattagactataaaaaattgaaaattttgaaatcatgtttccccctcccttctcccaggggtattattttgtaaagttttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattatattgtaaagtctttttttccccaataaacttttcataccccatttttcgcaccgtgaatgttatttttattgaattctaaaccgttttgagtagattagactagaaaaaatgaaacattgaaagatcantgtttccccactcccttctccccaggggtattatt

SEQ ID NO: 41912 - DNA, 843 bp, Heterodera glycines
gggtgcgattttgccctggaaacccggcatttgccgggttttgggggtccttgccgggtttttgccgggtttttgaagttgccgggtttttgggtttttttccgggtttcctattttcaattcatttatttgaattttattaaacattttgccaaaattaagagccaaaatagttttcgttaattgttcagatttttctcacaaaaagcctggcggaggaatatcaaattatgattataaatattcggagaaattcaaggccgattccatccaaaaaagcaacaagggaaattcaattcaatttatacgcaaaagcgtgaaccgacattaaaacaaaataaataaaataaaattggtcactgaatgagatggggcggtttcaaaagtaaaacatcaatatcataggtgtcaagaagtttagcaaactcagtagaattaagtaacctcgcctctttaggcaaactcctatagaggcgagaggtacgaataaaaaacgaatgaaaccgaacattggttgaacaataagcggtttttataatataatcgtttttcagtcctgaatatatttttgaaaaagaatcattatgctgaatatggatctttcccaaaattatatcatggaaaagttttaaatcgatttttgttctgcgttttaaaagggattcttgtttaaagagttgaagaagttcgttatacccgggtatatcatccttattattattacgtctaaaaacaatacgtaaaaatgttttttggacattttccagagcatcgatgtcttttttcatatatggattaaaaaaccggaaaaccacaatttccaaaatcggaccggacaataaa

SEQ ID NO: 41913 - DNA, 595 bp, Heterodera glycines
  misc_feature (52)..(53): n is a, c, g, or t
  misc_feature (55)..(55): n is a, c, g, or t
  misc_feature (68)..(68): n is a, c, g, or t
  misc_feature (123)..(123): n is a, c, g, or t
  misc_feature (177)..(177): n is a, c, g, or t
  misc_feature (198)..(198): n is a, c, g, or t
  misc_feature (231)..(231): n is a, c, g, or t
aaaacaaaaaaaatcgattttttcaagtgtccgtttgggtctttgagggagnnanggggagcaaaaanccaacgcagaacaaaggacaggcaacagggaagcgaccccggaaggcaacggacnccccagaaagcggggcgcagcgggccggggggaccgccccgaaaacaaaaaaancgaaaggcgcaagggcccggncgggggacacaaacaagaaaggggagcaaaaanccaacgcagaaaaaaagaacaggcgacagggaagccaaccccgaaggaagcgggcgccccagaaaacagggcgcagcggcccggggggacagccccgaaaacaaaaaaaaccgaacaaaccaagggcccgccgggggaacccaaacaagaagggggagcaaaaacccaacgcagaaacaaagaacaggcaagagggaagcaacccccgaaggaaacgggccccccaaaaaaccagggcgcaacggcccggggggacggccccgaaaacaaaaaaaaccaagttttcaacgggtccgtttgggggactctaaaaattttggggagcaaaaaaccaacgcaaaattttagtacagggtatagggaa

SEQ ID NO: 41914 - DNA, 986 bp, Heterodera glycines
  misc_feature (676)..(676): n is a, c, g, or t
aaaaagaagagggggggggggggggagcccccccccccccaaaaaaaaaaaaaaaggggggggggggggggcccccccccccccaaaaaaaaaggggggggggggggggggccccccccccacacaaaaaataattgggggggggggggccccccccaaaaaaaaaaaaaggggggggggggagacccccccctttggaaaagtggggggggagttttttccccccctttttaaaaaaggggaaaaaaagagtctccccccggaaaaaaaatttgggggggggagaacccccgttgagaaaaattgggggggggagggccccccatattaaaaattggggggggtgtttcccccataataaaaatcgagggattgggtcccccggtttaaaatttggggggatggggtccccggaattaaattttggggggttgagtccccgggatttaaatttggggggtttagttccagggattaaaattttgggggattaggtcccagtgatttaaattctggtgatttgatttccgttgattgaattttggggggttgagtcccagtgatggaatgttggtgggttgagtcccagtgattgaatgttgggtggattgagtcccagtgattgaaatgctggttgattgagtccgtttgatggaaatgtggtggggttgagtcncagtgattgaaatgttggtgggttgagtcccagtgattgaaatgttggtggattgagtcccagtaattgaaatgcagaagaattgagtcccagtgattgaatgctggtggattgagtcccgttgattgaaatgctggtgggttgagtcccagtgattgaaatgttggtgggttgagtcccagtgattgaaatgttggtggattgagtcccagtgattgaaatgctggtggattgagtcccgttgattggaatgtcggagaattgagtccccagtaattgaaatgcagaagaattgagtcccagtgatgaa

SEQ ID NO: 41915 - DNA, 847 bp, Heterodera glycines
aaaattttgaagaggctctgcggaacggattagtccttaaggttacgagatagaaaattgtcctaaaaagagatagccctttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaattgaaaaattttgaagagtctctgtggaacggattagcatcggggttacgagatagaaaattgtcctaaaaagagatagtcatttttctgagaattaattcacaatttccgcagctcttagggtaatggaaaaaattttgaagaggctctgcggaacggattagcatcggggttacgagatagaaaattgtcctaaaaagagatagccatttttctgagaattaattcacaatttccgcagctcttgcggtaattgaaaaattttgaagagtctctgtggaacggattagcatcggggttacgagatagaaaattgtcctaaaaagagatagtcatttttctg

SEQ ID NO: 41916 - DNA, 946 bp, Heterodera glycines
tagccatttttctgagaattaattcacaatttccccttctcttgcggtaatggaaaaaattttgaagaggctctgcgtaacggattagcatcggggttacgagatagaaaattgtcctaaaaagagatagccatttttctgagaattaattcacaatttccgcagctcttgcggtaatggaaaaattttgaagagtctcagtggaacggattagcatcggggttacgagatagaaaattgtcctaaaaagagatagccatttttctgagaattaattcacaatttccgcagctcttgcgggaatggaaaaaattttgaagaggctctgtggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttcctcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacgattaacatcggggttacgagatagaaaaatggcctaaaaagaaatagccatttttctgaaaattattcccaatttcgcagctctaggggaaaggaaaaaattt

SEQ ID NO: 41917 - DNA, 89 bp, Heterodera glycines
ggtgggggagtatgagtatgatggtcaatatggagaaaaagaaagagtaaaaggcaattttttcaattcaaaaatgtagatgtccgcag

SEQ ID NO: 41918 - DNA, 665 bp, Heterodera glycines
cgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctttactttaattctgcgttggatttttgctccccataattgtttgagtaccccaaacggacacttgaaaaaatcgatttttttgttttcggggcagtccccctgaaccgatgcgcccagatttatggggagaccgaatctttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaaatctgcgttggatttttgctccccataattgtttgagtaccccaaacggacacttgaaaaaatcgatttttttgttttcggggcagtccccccgaaccgatgcgcccagatttatggggagaccgaatccttccggatagcttctctatagcctgtactttaattctgcgttggattt

SEQ ID NO: 41919 - DNA, 840 bp, Heterodera glycines
  misc_feature (11)..(11): n is a, c, g, or t
ggacgaccatnaaaataggacactctttattccttcataactttttttgaaacaactaattttaattttgtttatataattaaatatcccaaagatttctctattattcagctaaattttgaaaaattttatggaatttcaagaaagttatggccaaaaatgttgagtcaaaatttttcgtacttttttggttacaactttttgtaaatctttacaaatttttaaaattacataagtagtagaggatactttgagctgtcgctaaatactaaatttcgttaatctgtctaaatttaagctaagttatgattaattatttagcaaattaaattaaaataataattaaatttaattattacaaacattcagacttttgtcacttcggctcaccacgttgattgtactgtcttatcgctttctctgccttttattcctaatttgcgttctaagatgaagattactcacgctaaatgaccctaattagtgttctccttaatgactaatcccgaagtgacccacttctttcagagcaaattccgcctctccttaaactcattttcacctcttcctctttatttattattcattcattatttttattcttttgcatttgagcaatgtattatattccctcgggcaatacttcgtttagaaataaaaattttaatcgaaaataactgaaaaatagcaatgactcattcttttatgactttttatgcaagaatttgcatttttttaattcgtaaaaattccaaattgacgtttcttaaaccaaccttccacaatgggcgttttatcttgaagctaatgggaaataaaatggaaaagtgccaaattccg

SEQ ID NO: 41920 - DNA, 705 bp, Heterodera glycines
tggttgcttacgaaaaaagatagggcaaacaattttttgtttgggttgctaaaacaaaatgccattccataaaatttaaactaatttgtaaggaagaaggcttctcgtcaagttcccctgctttcagtgaaagaaagaaaacaaattggaaaattcataataaaaattttggtgtgctcggattttttaagcgtgactggacaatccgacagtgaacaatataaaataaaaaaaataatttttaggcatgtgaacggactttttccaaaaaataaatatattcgagtcaaaacatttaactcaaacttgttaacaaatttgaaaaatacaaatagaattttagaaactaaaaagcaagagcttataattagcaaaatttaatgaggccattaatgtattaaaggccggcatcgatcatttaatagccaattcccccaagggcgtaggcataaaaattttcagtaaatttttttttttgaaatttcaagtaattttgttaacaaaagtgcattaaaatactcaaaaattttcccggcggcgcctatcggcaccgccggacccccattttaccatattttgaaaaatggagaccaaaatggcaaaaatagtaattttttggcgaaaaacggcgaaaaattttgtaaggtacatcccataattcgggatttcaaaaaacgaaaaatacaccacctaaaaatcgactga

SEQ ID NO: 41921 - DNA, 498 bp, Heterodera glycines
  misc_feature (57)..(57): n is a, c, g, or t
  misc_feature (61)..(61): n is a, c, g, or t
  misc_feature (65)..(65): n is a, c, g, or t
  misc_feature (206)..(209): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (217)..(217): n is a, c, g, or t
  misc_feature (220)..(220): n is a, c, g, or t
  misc_feature (222)..(222): n is a, c, g, or t
  misc_feature (225)..(226): n is a, c, g, or t
  misc_feature (228)..(228): n is a, c, g, or t
  misc_feature (230)..(230): n is a, c, g, or t
  misc_feature (235)..(236): n is a, c, g, or t
  misc_feature (238)..(238): n is a, c, g, or t
  misc_feature (240)..(240): n is a, c, g, or t
  misc_feature (242)..(242): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (256)..(258): n is a, c, g, or t
  misc_feature (260)..(260): n is a, c, g, or t
  misc_feature (262)..(262): n is a, c, g, or t
  misc_feature (264)..(264): n is a, c, g, or t
  misc_feature (266)..(266): n is a, c, g, or t
  misc_feature (268)..(268): n is a, c, g, or t
  misc_feature (270)..(270): n is a, c, g, or t
  misc_feature (272)..(272): n is a, c, g, or t
  misc_feature (274)..(274): n is a, c, g, or t
  misc_feature (277)..(277): n is a, c, g, or t
  misc_feature (279)..(279): n is a, c, g, or t
  misc_feature (284)..(287): n is a, c, g, or t
  misc_feature (292)..(294): n is a, c, g, or t
  misc_feature (299)..(299): n is a, c, g, or t
  misc_feature (304)..(304): n is a, c, g, or t
  misc_feature (317)..(318): n is a, c, g, or t
  misc_feature (320)..(321): n is a, c, g, or t
  misc_feature (328)..(328): n is a, c, g, or t
  misc_feature (337)..(341): n is a, c, g, or t
  misc_feature (347)..(347): n is a, c, g, or t
  misc_feature (350)..(351): n is a, c, g, or t
  misc_feature (355)..(355): n is a, c, g, or t
  misc_feature (357)..(359): n is a, c, g, or t
  misc_feature (366)..(366): n is a, c, g, or t
  misc_feature (373)..(373): n is a, c, g, or t
  misc_feature (378)..(378): n is a, c, g, or t
  misc_feature (428)..(428): n is a, c, g, or t
  misc_feature (430)..(430): n is a, c, g, or t
  misc_feature (437)..(438): n is a, c, g, or t
tggaaaacagctgagaaagagagggaggagagagaccgttaagaaaagaaggagagngaangggnaaagaaaaggggacctttaagacagacggaagagagggagtgagtgagaaagaagaaaagtggagaggaagggggagaacggaggaaaaacggaccactaatcgatccggcgcaattttgtcccactctctgcctcctcannnncncncncnagncncanncncncacanncncncncggncncncnccgnnngngngngngngncngngcngngccannnnacacnnnaaaancccgnccgacaacgacannanngggggangcgggggcnnnnnaccacncanncccncnnnggcggcncatcggngacgncacaaaagagaggggggaaaagggagagagagagagaggcgagagagggngnaggaganngagagagacgagagagggagagagagaaagcgaggagaaggggagggggcgggggagaag

SEQ ID NO: 41922 - DNA, 988 bp, Heterodera glycines
tacaggcggacagggccctcagcccaaaccggtccatctggcagcggtgggtcaacaaagaggtgcgcctactttggcaccacagtatggaagaggtcagggaagacgtggcccggacaatcaatggatgcactacggcggaaacccgaaacgacagaagggtggcagacgctgaactcatttcacatgaagtcctgcgggtctcacttctcttcctttcaccatcgctacggtatgtctaagtagttcataattcttttaacttaattaattagttaggtaatttacattttaccctttcattaaatattttattttctttcattttttctgcactcaagttttttttttctcatgtcacccctccttaacttccggcgttcgcactgtttacgctgtgatacaatcagtagggacactttcccaccatattacggtattaatggatttccgctatttttttttctcaaaacaatttttattacactatttcccataacagaattattgtaacactggcacgccagccacgcccattgtcggggccttttaatctaagcactgcacattcattcattcattcttccattcatttgatttactgttttccactttagatactcttgcacaatcccactgctaattctcatctcacatttcctcttattatgttttctttctcaggtgggggtccacctaatcaaagcgctgcggcgtcaagcaatgcacagacagaccctgaggggctctccaatgatttgcctgagttatcagttgttgataaactgatgtttgctggaaagattctaagcacaccagcacgtttgtctgatgtggacaagctccacacggacttagttcggactgaggatggtgtcaatcgtatgacacgtcaccttaacaggaagataaatcaaaccaatagggatttgactgaacttaaggatgatactcaaactctcataaactcagtaaatactctcgcaaa

SEQ ID NO: 41923 - DNA, 947 bp, Heterodera glycines
cagattgtggatttaatttaggcataatcaaattttttctttgttgctaagggatattcaaacgaaaaatatttgacaaaaaatggaaaaatatgcaaaaaatctgaaaatatgtagtaaaattgcaaaaatgcaaaaaatctgaaaatatgtagtaaaattgcaaaaatgcaaaaaatctgaaaatatgtagtatttgcatatttttgacatccctgtcaatcagtctccatttagtgctaataaatattttttccaccgggaaattagcatctttgagttccgaggatggcaatgtagaggtagggaataggccaaaaatgtctgagatttaagacacatcccatcccttacatgaaaaattccattcaaatttttttcattaatgtttggttttctgtaagctttgtcatagtttaagatcggttttaacagctctttatccacctgaatattttaggcattcgcatttttttttgaatttttacttttccgaagatttttgcaaaaatatttaattgctaatctgatttttatgattaatgtaagtaaatcttaatgtttttcatcataaaatatggaaatgggatgctaaaaaatggacaaaaataattttgtttctttgtaataacggtaaaaaattgacaaaataaatataaaaaaaggttaatctatttcttcgaaattaatgtaagtaaatcctactgcttgtcgtcataaagcattggaaatgagctggcaaaaaaatgacaaaaataattttacgtcattgtaataaagatattgtgtatattaatatgaaatagatttttacagcctaaatccacccatcccatcattctttcattcatttattttattaaaaatgaaaatgcatttcttttttacgaatcgaattttggttttcatttattattattttattttttcaatttcaaaggaagcct

SEQ ID NO: 41924 - DNA, 1094 bp, Heterodera glycines
  misc_feature (1029)..(1029): n is a, c, g, or t
atccataaaaactcattttttcatagcccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgttaaagcaaacccgaaactgataggaaatttaaattgatcataatagaagttnaattttatttgtcccatgcattttctgggaaatcttttcgcgaaaagttgaaaattttcaaaacg

SEQ ID NO: 41925 - DNA, 1615 bp, Heterodera glycines
atatatctaaaagtattgtttaaggtgcggtatgtgcccctaaggtcactcgatggtattacgactctacacaacggtacattgttgcagaaaaagcatgaataaaattcttttacttatggatttgcaaaatgcagcttatactatcaccgtttcgagatttcgaataagtgtgtaaacttggggacccgtgcccggttttttgaattgtcgggtttttattgggtttgcctgaattattattttcacttaatagacataagtttgatataaaaatccataaaattgacaattgttggtgactcatcagaaataggaacaaaatttacaatttggttccggcatcgcctatcggcaccgccgatcctctcgtgttttttgtttgttaaaacatacagtaaaaaataaataattgtaaaaaaagtaacgtatataaatgctgaattaaaattatttctcctagaaaaggcagaataggtaaaatcacacaaattcaatcttatactataaacttttattccaatttttgagttttcacgatagaaaccctgtcttctttacaaaaaagcaaatagtgtatttttatgccaatcatttttcttttatttcttggcaaatttgcggtccaaattcattgttgaattttggccttaataattatttttcttttaaaaaaagaataaaaacgtatgctttattaagcacttgccagacattttcattcaatgggtgtgacggcaattccaacaattttgctacacaacaggactgcaaggattactgtcgagttgagaggtagattttaccatcatttaagagaagaaaatttttatcccggcgaaaaaatgtttcactgtcgagcgggataattaaattagttaacgaaaaacgaaatcaaaagtcttacttatggccaagacctcgaaaaatccactttcggaccgcaaatgtcgggacacttaattttttgatttttttttgcatttaaattaattagataatgtgttaaaaaattctttaaaaaacattatttccttttcagctgtccggacggtggcgaagttggcaaaaaaaaaattgaaaaaatacattattaaaattttaaaaaaaaccaggtttggaaagagcccaacggcgctgtgcgcccatgcacaacaaatcggcaatgcccttccacacactactgtacccctgttactgtattttcgggcaccgtataccaaacaaaatcactgtgttgtccatccaaaaattttgtttgctcacaaccaaaggttaaggaaaataactttttttactggaattcttacaaaaattttaggaccaaggtgttagatgtagcagtacccgaatcacacgacattttttcaatgctgacacaaaaacttgtcaaccatttgagtataacggatgcgagggtaaaaagcacacaattcaataattatttttaacgtgaaatttaatcgattaaaaaattaattaataattaaagaaaaaaaaggtaatcggaataattttgccacacaaaagtcgtgccaaaattactgcttgagtgaagcttgctctccgggtactgttgtggccagagactcagacaggtggattcgggaaccat

SEQ ID NO: 41926 - DNA, 976 bp, Heterodera glycines
  misc_feature (941)..(941): n is a, c, g, or t
gacaacatttgccatgcaaggcggacagccaccagcaatgaacatggaccagcattacgagcatctcggcgttccaaccggcttccaacgagcacaatccgccgatcacgtaattcagcaaatgtcagaccacgtcgacaacattgatcgatcgttgcttgccccgtggcagaaatttgacgcggtgaacactttcgtgctgccgtcgattgccttccatctcaaaaacggggaagtgcgcaaagccccactgaatgcgctggacaaaaagatcgtccgtgtggcaaagcggtggctgaatctcccacagcgtgccggaatagagccgctctacctgagcaatgccatgggaggcctcgcactgacaccactcaataccctcgccgacctcagccaacttgttcatggcctgcggctcctcacttcccgcgacttggccgcaacaacaatggacctcctgtgcaccgtcgttgccaagcgtctgcgccgggcaccacgacagcacgaattggccagatacctcaacggttcgatggacggcgacatgaacaacgagtcgacggacatctcttcgacctggacaaggctcagaatggcaacgaggcgactacgaacaaaaattggcgtcgaatggtcggtcaacgacggctcaatgcaactgctcctgaacgggtgccaaatccaaccaaaatcagccgaattctgcctgcgctcagccatccgtgacttctaccaccgccgattgctgtccaagccagaccaagggaagacacacagtgtgacaagcgttagtgctgcctcaaatcactttctagcccacggcaacttcacccggttcgccgactggcgtttcatccaccgcgcccgcctcgactgtgtcccactcaatggcacgcgacggttcggccaaccgaacaaacaacatgcagacgctgtggttntgcaacgaaacgctcccgcacgtgctctgccactg

SEQ ID NO: 41927 - DNA, 1031 bp, Heterodera glycines
cttctccaaagatcggcggataggccccgagggttcgcgctttgtctccatttgcttttcggcagaaattgtgtcaaaaactaacgacggtgtttctaaattcagcgtggaaaggcctttggcagcccgactcctggcctgaagtcattagttatcagtaattacacaaattgtgttcaaaaacctcgttaagtcgctttatattctccatgtgcaactgagtgaatgcgctcgtctcctcgggtttgagcaccgtttctcggaaacgttcgctgccacttggccctttgaccgttgtgttttggacggggaaaccgagttccttcagtcgttcctggatcttcattctggcctcgtagatcagctccttgcttttcactttttctgccagcgaatcctgagaagaacgccttggaattgacgccgacatttttcaggtggaaggaaaatgaatgtcgttttcctgatctgggaaaaaatgagttatttgttttttatggaaattccaactccgaaaccattgaccccctacaaacttggccaccattcagaatttagaccatgattaatggatgttttttgacaaacaaattaaattaaaataaaacatactcagacaagtgtcaaacgccaagtcagatttatttaattcaaaaagtcataaaactcgctttgtctctaaataaaccagggattggattgttctgatttctcagaaacgttctgatttggagggtcgaaacctgagactgattttggtgttcagattttttttaaatattcttaattttgaaacttatggcataatgtcagttgatattatctaaaaattttagtttgatgcaaaagttggttatttttcgacagaatcttacgagtatgtgtttttaaaaccaaacgggaattttgtagacacgtggacaagcagtttatttatcgagtattaatgttgttaggcacagtaatacaatatgtacaatcagagcagcaaatatccgagcatgacaagcaaatcatatatacatggcgat

SEQ ID NO: 41928 - DNA, 979 bp, Heterodera glycines
ctcgagcgtgagagggagggcggtgcgcaatcgccatttaatttctcagagaatttttaaatttatcttatatccaagaaaaatgactatctcttcttttgataaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaattgactatctcttattttgagaaattttatacgttacaaaagcgctcgagcatgagaggaggggcggtgcgcaatcgccatttaatttcacagagaatttttaaatttatcttatatccaagaaaaatgactatctcttattttgagaaattttatacgttacaaaagcgctcgagcatgagaggaagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttcttttgagaaatttatacgttacaaaagcgctcgagcgtgagagggagggcggtgcgcaatcgccatttatttctcagagaaattttaatttatcttatatccaagaaaaatgactatctcttattttg

SEQ ID NO: 41929 - DNA, 989 bp, Heterodera glycines
tatatagggttataagttgtatgcactaaaaaatgcaaaatatgcgcataaaatatgcactaaaaatcacccaaatatgccctaaaaaccccgaaaaatgcccaaatatgcactaaaatatgccttgaaaattactcaaaatggcttttaacccttaaaaaatgccaaaattgtgtaaaaatacagaatttaaaaacatcaaaagaatggctaatgagtgtttttagacaattgcaaaacattttaattttaaaactttatatagaaatttagaattttttaaaatttttattaggtatatgccaaaataatattgcattttttgtatgaacaaatttttttaaaaaattctcacaataagtttaaaaattttcggtttttaagggtgtattttttaaaaattcccaaaaagtcgatccttagggtgtatttttcgcttatttcgcatgttttttgggggtgtgtttttgaactaaattttccggcacaattattagtagggctcgaaattatatggactaaaaaacgtgaaatatggacataaaatatggactaaaaatgcccgaaatatggactaaaaagttcaaaaatagccaaatatagaccaaaatatggactaaaaactgccaaaatatatgttttaaaccctcaaaaatttcaaaaaggtttatatattcaatatttgcttaaataaatttaaaaagtacaataaacaaccaaaaaatggatttaaacttaaaaatgcatatttttattgtcgtccattgtataaaaaatatttccaagtttgccaaaatttcgaaaaaaattttaatttaaaaaaaaagaaaaggtcgcaaaaaaatggcgaaaaatatttattaaaaatggcaaaatgacctacgaaaactcaaatttttcgtttttttgggggggggaacttttaaaaattttcaaaaaactatctttagggggggattttttcgttttttgcatttttcttgtgaaaa

SEQ ID NO: 41930 - DNA, 1069 bp, Heterodera glycines
agaaagcctattcgtaaaatacaaattcaaaaatgtcagttgtaagtcacctcggcccctccgcccaattgtccgcctccactcgccccgtgcccaattcgcccctcgtccccgtcccgaaactccaaatctctccgttcaaagagtccaaaatgattaggtggtcccttccggcactgatctggtaatgaaatttttcactttttatttgttaaaaaacatcacacaaacttttcctattcgaaatggcaattcgaatcgtttcacttccttcggatttttcccgaggcgcgaatcgcaaattcttaaatatattttctttgttttgttggttaaatgtgcttttacctctccaaaacggcgcaattttcgaaattcgttgccaaaaaagcgccaaaagcagtgcaaaccaaaaaacgattggattttgtggaggaagcggcagaaaaatgctgaaactatggatacacgattaagcgaatgccaaaaactcacttcgaatttgtcaattcccttccgtcccctgagggcgtcccaatggtcaaattgatggcttagggcaacggacggaggagggaattcagaatggaccaattggacttccacaggaagccattcccggccaaggggaggaggaccatccgccgaactttgcgactcaattcggaagagagtttaaaaagggacggtcggtgagtcatctgccgaacaccccaaaaaactcatctcagtacgcaattcgaacgagtaaagtgcgtaactgcccactaagaaaaacacaaagcattcattggcagcgatgacgactctctgaaaaagcgaagggacccatagaatcggcacaagtcgccctctctcttctcactttgtcatcgccattcgtaggcaatttgaactgtgttgttttcaatgacagattgtcctcaatttgtacactttcgccgtccgcttcaacacgtacaaaaccaaaccaaacgggcacacaaatggtacaattgacagcgattttagatgggccaaccgaatccttcacatccattcccgactgacaagaaaaaactgatcgaca

SEQ ID NO: 41931 - DNA, 1400 bp, Heterodera glycines
  misc_feature (98)..(98): n is a, c, g, or t
  misc_feature (108)..(108): n is a, c, g, or t
  misc_feature (172)..(172): n is a, c, g, or t
gggtactcaaacaattattaaaaattttagatttttattcatctccctttttgatagtgaaagcatctgagtgcctaaaatactttgtaaataaaatntggtgcgttncagagcagtttgtgaaaaaatatttatgaattaattttgctaaaaaaataaaatagtgaagctntaaaaattaataaaaaattttaaattcagaattactggagttagcatcatagcagtgcttttccttgtctttttgatgctctcgcaaaatctggtccgcttctgatcagtttataaaaaaaaagttaagcctaaaatctttcgcaaatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccgaaggtactcactcggccgccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaaggatcggcctcccc

SEQ ID NO: 41932 - DNA, 870 bp, Heterodera glycines
ccttgtggtgacagcaatagttcgcttttctctccataactttgtgagtttggcgcggatcgtgaccttcattagaccattggaaagagcagctcgagctctacaagaaggtatggaaagataaaaatagttatttctgggactttttcagaaatcagaattaattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagcttgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttaaaattaataatcaaaaattctcttaaaatttttttgaactaaaggcaaaaaaggaaaaaaatttgcagtcaaaaaattat

SEQ ID NO: 41933 - DNA, 965 bp, Heterodera glycines
  misc_feature (5)..(6): n is a, c, g, or t
tctanngagtcatggaaatttacataactcctcattcacggtcttgcacattacaaaaatttaaattattgtcttcccgcacccacctttttgcatttatggcactgaagtggcggcggcggtaccaacggttgcccatcattttgcgcatttccaatcgcaactgcagcaacaagaccagaattgttgttgttgttgttggtcctgcaatttggaagtttgcaaataccataaaagccatgtcccgacacttgcggcccgaacacttttggggccccaactaaaattgggcattttgctgtccgaaaatggggtccgacttttgcggaaccacagttttggtggcttttttttgatccgttagaaatagcaaaaaataaatgaaaatgcactttgccgtcgcctctgacaaattcaaaggatgagtggcggcggtggacaacgacgacgacaaatgttgatgatgaaaagcaacggaagaaatgtttcctggtgattttgaaggtctaaaaaagtaaatttgaaaaaaaaagttccaatgaattatctgcctagcatcaccaatttgtggcaaaatttgttaaaaaatgccgaaaatttcaaaatttttttcaatttgaatcctggcggcatccccaatcaacaacaagcacaacaaatacctcttccgcttcggtgccgccacttttttgcgatgatgactgcttctgttgatattgttgacattgacgatgatggcatttgctttgtgccgatgatggtgatggttagcggcacattttgcctccggaagaaacggtgcaacggcggcggtgacagccgacgacggcgccggtgcggtggtggccatcatcattaagccatcacccccagcagcagcagggcaaccatggatgccgtcgtcaacatggctggcggtgttgatggtcagcagcaacaacattgacgatgacgcattggctgct

SEQ ID NO: 41934 - DNA, 1025 bp, Heterodera glycines
ggaatgccatcccttccatggactcaaaatgtcatgggacgcgtaaagtgttgttgggacgcgtaaaatgtgatgggacgcgtaaagggttgttgggactcgtaaaatgccatgggacgcgtaaaaccgactagaaccagtttttcttcgttttggtttcagattttgttcaaacggcgcccaacatttgtccgccaattttggcagcaaattgccgatctgtgcgctttactttgtcgcaggtgcgaacactttgctgattcagtgcaatgactcctccacaaatgctcagcattttgtacggtgtcaaatcacttctgatcagctcactgtcacccatttgaacaatgaaaggcatttgaagcggatcacttgctgtgagatggttggcctcgccgatgggcagtccgcccttctgattggtattccatggatatttaaatatttgaaaaggaaaagtgttttgaattaaggcacaataatcggcaacatttatgcacttttggtgcgcaacatggaacttactgaacatgttgtttttctcgacaccgctctcaaagagtaattaacacttaattagcatttactgcctattaattatataatttatttgcccttggatgttccaatttaagcatttccgagttcgattctcagcaaaagcaagtgaacggagtgaatgttcactcggaagaccaatcgaagctttacattctcttcaacaattcatttgttgttttttacgacattacttccgacgaggttttgcagacgttcaaatcggagacgccaattacggtaacaaacggcaatgagcacttgaagcctttaactttgttaagtttatgtcgacgatttcctcactcacaaaattgctctgttctcatgccgatggcgcttattcatttctcggtgtttcagagaaagggtttgaaattgagcgcaaaaggccattcggaacgaaaaaatgcacaaaaattaccaaaataatttcttcgaaatcaccaaagtctgctctctctttt

SEQ ID NO: 41935 - DNA, 1545 bp, Heterodera glycines
tatagccctaattattagtatagaaattaaatattaaccgttactttatccgtttagtatttattttttaaatatggctattaaattttgtattatttaattaaaaatccctctcactttgacttgctctggcgtaatgcccaccaacttggccacttctgaacgcgtagaaaagtcaatgaattttgtcttctcaaataggcgttccaaaaggtccaattgagcggccgaaaagtgttgtttttgttgttgttcgtcatcctttagcattttataaattaattaaaattattagttttaaaaaattattgttaattacgaaaattttttagaatcataaaaaataaaatttacattttaaacataaacattaaaaaaaaagaatttttaagaaacaatcatttcaaaaaatatttagaattgaaaccagctgatttttagacttacaattagctgtaaatagctttaaatgatacaaaatttgtaaggattcgattatttaaaaaaaaagaagttaaaagtgccaaatttcgtcaattttcgagtttttaaccggttcaaaaaccggttttttggcattccacaacccgagttccattctttcgtgcttaaactcatcgaaccgaatcgattaagagatatcatataacacttttcttcaatggcgttcactattgtttatcctacctcgtcttcttcttcttgttcatcagcctcagattggccaatatcgctgaattttaaagtgaaaatttttaatcttttttggatgtaatatctgatcatttaccaagagattgcttctttttcttttagtccacatttgtaacgccgattttggaaccaaatctataaaaattggggacaaatggccgtttcggcgacaaatgttttcatttttcatgtaaacaaatcatgtaaataatcttgcattcatccagagaatgcttatcaagctttatatctcgaaaagggaaaaaaattgcacagaaaaataaattagggcgaaaaaatgaactttttatggctttttaggacgaaacacgccataattcaaagtttttttcgctgaaaagactaacccattgcaattaattattaattaatgaccgcgttcttaattgcataatcaaagttttccatgttttccatattttaatagtttaaattaaataattatttgtatatttctcactcttatttgcgcctctttgaggttaatttccttggccaatttttctcgttgagaagcagccaaataattgttagcctgatattcttgatccaatcgctctatttgttcaggtagaaattgacgtcgctttttttcggggcattgtttctttacaattaatttacagttttaatgacgcaattttttattttctatttttttattggccaatttcccaaagaccaatttattattctttcgcattttggccaaataagctgacacaaaaggtttgcttactaaacattccttggcaccaaatgtcttgggaggagatcggtcgttgacatggaaaattttttttaaatcta

SEQ ID NO: 41936 - DNA, 1007 bp, Heterodera glycines
taaaaaaaaatgtgaaatggaaaaatgaatttggcataaaacgcagcaaaagtaatgcctttaaatttttaatatttttttataattaattttattaatataaaaataacgatacgattttcaaaaggttgtaactgttgagttgaggttgagaaccgaacgaaaatcactttgttaccgaagaaaaaagtcattaaacgaatattcaaaaaagtaattgttaaaaaatgatcagttttgtataccttattaagggtccacaagttttcaaattaattgcctttctaataaagctttcagcacttgaaaagtgtctgcccaatttggcattccaaaagggaacaattggcatttatgctcaatggcacaatttgtgatattcaacgcattggaaggcccactgccaaatatatccggaaaccgattaagagcgagtcgaccgtaggtttttttaaatttttcttttttttcttttttacttttttttctaatagatttttttttgatatttttttatcgttttttttcttttaattatttttttttttattaatcttttttttctatttttttgaattttctatttttttaatcattttttactttattttttttgtttttctaatttaatttttttttatttttattttaagaagaatttatttttttgttttataaggttaaaataaaaaaattagcttattttattttttttagaatttttttattgcttattaaaggatcagctagtgaaattttcaagtaaatgtttattatatttcgaattatttttattttaagtttaaaagatttttcatttattagagtttttattttattatcagaatttttgtttttcattcaaagggaaaaaatttaaatatttttttttttagttttctaaactaaattttcctattaaataaaaaagtataatgagaaaaggtaataaataaccgaagctcttcttaaaagtaaaagagaattaaaaaaaggtaaaccaaaag

SEQ ID NO: 41937 - DNA, 1057 bp, Heterodera glycines
agcaaaaatggcgtagtttgaacgacacttctctaggtctttaggtgttttgagtcagaagtttcgcttttcaaaaaaagctagttgggatcgtacgttttcggcaaaagagtgcaccatagcaaaaatggcggagtttgaacgacacttctctagggtttgaggtgttttgagtcagaagtttcgcttttcaaaaagctcgttaggatcgtacgttttcggcaaaagagcgcaccatagcaaaaatggcggagtttgaacgacacttctctagggtttgaggtgttttgagtcaaaagtttcgcttttcaaaaagctcgttgggatcgtcctttttcggcaaaatagtgcaccacagcaaaaatggcggaggttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaagctcgttgggatcgtactttttcggcaaaatagtgcaccatagcaaaaatggcggaggttgaacgacacttctctagggtttgaggtgttttgagtcagaagtttcgcttttcaaaaagctcgttaggatcgtcctttttcggcaaaatagtgcaccacagcaaaaatggcggaggttgaacgacacttctctagggtttgaggtgttttgagtcaaaagtttcgcttttcaaaagctcgttgggatcgtcctttttcggcaaaatagtg

SEQ ID NO: 41938 - DNA, 1689 bp, Heterodera glycines
tgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgtacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaacaggcgtg

SEQ ID NO: 41939 - DNA, 509 bp, Heterodera glycines
gcattaacaaagaaaaatactccaattcatcattgcctatatataaaatgtcaaccaagcaattagtaaatttaattttttttaatgaattgtaatttaatttttattaatgatttttgagactaaaaattttggagacttatcctctgtttcccggggtttgagaccaagaaaatccaagatttgttttttctgtggtccctcgcttgtgggcctttcaccaaccacattaattcattttactaagttaattactttaattttaatagcactccattttgcagaatcaacagtgttgtaccggacaactgctcggccaaatttaataagaactggaaaatgtgcgcttagggactcggtcgtttcggcgccgccgtttcggcgccagcccttgtttttggactataacttttttctttgacaaccaaatctaataatcttggtatcattctacagcccttcataagccctattacacctacgaaaaaccaaaaaaaaaatttgacctg

SEQ ID NO: 41940 - DNA, 98 bp, Heterodera glycines
gcacgtgccggcggctactcgccgccgaaaggcgtcgtgggagaaggggcggggagggccacggctcccgccgcggcctgggtcgctgaatcccggac

SEQ ID NO: 41941 - DNA, 776 bp, Heterodera glycines
  misc_feature (756)..(756): n is a, c, g, or t
  misc_feature (769)..(769): n is a, c, g, or t
taatcgagagcagggacggggcaaagctcggcttagcactcgaaggcgaagcccaacttttacttggaggcgaagctcgaagcccaaaaaaccgaaatttttgaagccgaagtttcgccggtccctgatcgagagtcgagaacgaagacagcgaaagaccccgagacgcgagatcgaaagcccaaaaaccccgggaaatttctctacttgataacagaccgcaaacagcccatacagatgattaggcgttagattggtagctatttgctgttctcattgtgggagcgcaaatgagcgaccagtgacttttaaagactttcgttgggaaaatgggtcgggtagtgaggttatctcttctcatccgttgtccatctcagaagtgattgtccgtccgttctcgaaactgtgtcaatttgtcacctgctggtgttccgaatgttcagtcatcgatcactgatcaaaccaatcgctgtgatcaatcgccagacttttctcccccccccccccgcttttgccgacccttacatttccttcaataatttttcttttttaatcccccccccctctgtctcgtctcctttttagtcagtacattcattctcgactttgtttgtttgttcagcttggtccactcacttcgctcggatggccaatgaacaaatgccaaatgaaagaacaaacaaaaacattttccttctgagggaacgatgaacggaccattcccttcttggccatcatttgctgttgtcaaaatgngttttgtttgtcnaatgatt

SEQ ID NO: 41942 - DNA, 1026 bp, Heterodera glycines
  misc_feature (946)..(946): n is a, c, g, or t
tgagctggccaatgcttgtgccaacttcccaatttccctttgccaatgtgtttttggcatttaaccacgcgcgccattttgaagaaaaggtaaaaaattattgtcatcagcagagatgagattttttggaaataaaaaattgcctaagggtagccaaatacagaggaaaaacctcatccccgatgactctttaggttagagccctaaattgtatgttttcatttttcatggtttaaaatgattttgcactgtctcaaaatttaatggtttaaatttttgagtgcttaaattcatttttaaaaaattttcatccatattttgggatttttaccatattataaaccatttttcgggtattttttatatataaacatttactctaatgaacatttacatataattaattataaatatgtgcatttccgttaattcgtaggaatttgctctccgttgcttggatcacatcgatcagaatgcgtactcattgctcaaatccgatgcttttcttaaaattggcacaaattacctctgtgaaattctggcccgtgatcagcttcaggctgaagaaatcacaatttggaatgcggtaaattaaacatttggtgattttggcactatttcgaatttttgccaaactataggctcttcgctgggcggacgaacaatgccgtcaaatgggcaaggagtgttcggcggagaatcgtcgtgccatgcttggaccggcacttttccaaattcgttttccgttgatccaattggaagaatttccaagaaacattggtaattaattaaaatttatcatcacatataaatattttcattttatattaattggaacagacaggtcggcactgcgttttattaaagaaaaattctttggcatttttcacaatgtctttttacaaacccaaaactgaccaatcctttcaaagttttccggctgcanccgttgatctcaaaaatctcataatttaaacaatttatcgcggctaatcactgatcgatatcattgtagcataaatgcca

SEQ ID NO: 41943 - DNA, 668 bp, Heterodera glycines
caaaaatccaacgcagaattaaagtacagggctatagaggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcagggggactgccccgaaaacccaaaaaaatcgattttttcaagtgtccgtttggggtactcaaacatttatggggagcaaaaatc

SEQ ID NO: 41944 - DNA, 664 bp, Heterodera glycines
agcccaaaattttttagagaaagggacgtttgtttctttttaaatatcaaaacggattcagtcggccaaaacccatcgaacaatttgaaaccgaaactcgaaattttgcttcggaatggccaatttggcacaattccttggcattcggtggctttgctcactttatgaaattgctttcgctttgcttttcctccgtttgctcttccatttggtcaatgaattggtccaaaatgtccaaaaaagtgccgtctccgctgtatccgtcggcactttttctcaattcgactcgtctctcaatttcgttatcaaagaatttgaacagttccttcagtgtccattcgttttcgttgtatttttttgaaaagtatggcaaatggcgaagcctaaactttggcacttttttgatttgattttcccccttttttgccatggccgcgcttcgatcatttggctgatcagtgagatgaaatattcttgctccacgtcaagcgcatctttcagaaaagtgaatgttttgtagcggtccttaaatgtgttcaatttccttcttttttgtctcgaaattttggtaattactccgtaaaatgagaatccgaagagcattcggttgatcaccgaccccgtcatcagatcgaccttccgatcgaccgaaaggtcactgttc

SEQ ID NO: 41945 - DNA, 480 bp, Heterodera glycines
atttctcaatttctaaagcgattgtccctccgttgcctttgggcttgttccagtcggaaatccgagtttgagtggggaatttgagcaggctgaacccgggcacacaacggatattcgggtggcaatggaattggtaaacggcgacaaattcatcgattgtcaaaatgtcagaaacaactgcaaaataaaaataacaaaaactttttaattccattttgaatttatacataattaaataaaattatttaattactttttttttggtgaatttaagcaaattagtacaaatgaggaatttttgtaaatattgtaagaaatttctgaatttctttccgccgtctctctcacattgaaaacatttttaaattattataaagccaaaatagtgacgttacttttttagttacgaaaaatccaaatgacgttaaaatgaggaatattcgggctaaaaatttattttcgtgggttttcattgaatga

SEQ ID NO: 41946 - DNA, 1012 bp, Heterodera glycines
ctaccactctgccatgagaccacttgccagaaaaaggataatactccactatatgctgcaaggagatgacgtcaccactgcgaggggtactgtagttcggtgaaaaatcgcaataaatatgaagcaggcaagcggactcgaactttcgctctgccaccaacccaacacactaccactctgccaagagaccacatgccagaaaaagaataattgtcaactatatgctgcaaagatgatgacgtcaccacagcgagggatactgtagtctgatgaaaattcgcaataaattagccgcaggcttgtggactcgaacttttggtctgccaccagcccaacacactaccactctgccataagaccacttgccagaaaaaggataatactccactatatactgcaaagatgatgacgtcatcactgcgaggagtactgtagtccagtggaaaatcgcaataaattctaccgaggcaagcggactcgaactttggtctgccagcagcccaacacactaccactctgccatgagaccacttgccagaaaaaggataattctccactatatgctgcaaggtgatgacgtcaccactgcgaggggtactgtagtctttcgataaactttgaaaatacgcaaaacaagacaaaacgccataatatatatatatatatatatatacataacgccataatttattgaaacgaaaacctttcgcgttaaattcgaatttaaaaaattggcgggaaaagtggcgtcgtttttgtttctatcctcactcctacccttttttcaaaatcattcttatcttctttcattatttataacatgaatattttctgtttctgtcttttacaatgctgtttagccaaaccaaatatgaatttcaacaatttgactacgcctattgatgaacacacaatgattgagagcctgtctttggatgaaccatcaaacgagctactatctgttgaggttaacctttattaatattataaaatagaaataatatttagaaaa

SEQ ID NO: 41947 - DNA, 691 bp, Heterodera glycines
cattgtccaattcatcaattatcgcggcccttcaaaaacgtggctgcgagggacaattgtgtcaggaaaaggtgtagtttggcgaatttagtcgccacaattgcatgccgttgtaacccgtcatgcaaaccaaatccagaaattcgatcccattccatacaaggaaaatttgggcattgacaatcaggcacaaggcgaacaacaacaaccggagacaccaaaccgatcacctcgcagagttcggttcgctgacgaacagaacgaaccgctcgaacagatacagccgattgagccgagacggtccacgcgccaaagaaaagccccacaacagttggacatggaagtgaccaaaaccaaatatgattatgtcaaacaggggaagacaaattaaagggggagatgttgggatgttgtcagccattattattttctctcgctctcttccctttagtcatttctctcttatttttccacactctctctctcttgcctgaggcgcataaatagcgaccgttcccttccctttttgtccgtctcccagtcatttccaaattcagtccgtatttgccattcatctttctctgtctattttattattatgtttattcgcttctgacttattttattgtgttcaataaatattggtgtttgtgttctcccaaccaaagaacacaacaaatgctaaaatatg

SEQ ID NO: 41948 - DNA, 699 bp, Heterodera glycines
ccggtggcgcctatccggcacacgccggacctacattttccactatttttacaagttttttgccttaaaacggccaaaatttggtcatttttagtgaaaaagtccagttgttacccagccagggaaaaaaaattattggataaatttgcaaaaaaaaaaaaaaaggtcttcggaccggacccctccctttccccccccccccgaaaatttttcctggctacgggcttgccatctgttaacagtggaaaatagaaatgagagctttatacttaaattactttaacatttgtgtttttcccattcactgagccatgcgaaatcatcaattaaaggtcaaattaattgataaattaatttttctctttttattaattttccctcaaattcattcctcctttttaacaatttttttcctcaattttttgttgtttttagctttgtgtcgaagcccaatgtcgcaatgcgtcggatgtgcttcaaatggggagcaaatgccaacccgaagactgcaacggcaaaggcatttgcaacaacatgggcaattgtcactgcgttgcgggatacggggtaaatgagaatgataatcaaccaatcatttgatttatttaatttaattgagtgcttaattgatgtctgagtgtttaattgacgttccctaaactctttagggcatcgcctgcgattttgccgggccctggc

SEQ ID NO: 41949 - DNA, 905 bp, Heterodera glycines
tcacttatttttggggtttctcctttcatttagcaataatttttcttttttttcattttttctttcattattcttttcctactcattccgaattgtttcttccattcatcaattattctgcgactaattccaatttttttgctaatttcggcataattttggtgccattcttttctcgaatattttcttcctttttgcttatactcatttttcattgctataaattgttgaacaatttcaattttttgttcatccgtttttgatttgttaaatttataaaggccgaatatttttatccatttataaatatattggcgatttgtgcccaattttttcgctatttttccctcaattttattcctttcttttgctgaatattttttctctttttgtttaattttttcttttattttgttgaatttgtgaataatttctctctttcgctgttcatttctttttttcttccaaattttcttcttctttttcttcccatttttctccaaatatttcttcaaatgttttttgttccattaaaatattttatgaaaagatctggataaagttaaattccaattctcctgatcacttaaactcagaaattgtttaattgaaatttaattagtttttttatatttgtttctgttggtatctatggatatatccggatacgggtggatattgacaaaacgagcaatcagtagagagaaattaaatattatttataatataatttaataattacatcaataatttacttaacaaatgaagaatttattataaaaaagaaaattcatttttaagaaaatttaaattatttcttttatatttaggtcagtctgaatttaattgcaattattgaatttttaaaaaatgaaaatttatggaaataaaaacaaaatttgtca

SEQ ID NO: 41950 - DNA, 974 bp, Heterodera glycines
catgaccgtgaattaacacgtgaatcccgaccgtgtattaacacgtaaatcatgcccgggaattaacatttgaatcattaccgtaaattaacacataaatgatgattttgaattaacacgtaaatcatgactgtgaattgtcacgtgaattaacccctaaattgacacgtgaataatgacttaagttaaagttacatgaccgtaaattaacacgtaaatcatgaccgtgaattggaacgtgaatcatgactgtgtattaacacgtaaatcatgcccgtgaagtaacacgtaaatcatgaccgtgtattaacacgtaaatcatacccgtgaatttacaagtaaatcatgaccctgaattgacacgtgatttaacccgtaaattgacatgcgaataatgagctgaattgacacgtgctttaagccgtaaattgacacgtgataatgactgtaaattaaacgtacatgaccgtgaattaaacgtgaatcccgaccgtgtattaacacgtaaatcatgcccgggaattaacatttgaatcattaccgtaaattaacacataaatcatgattttgaattaacacgtaaatcatgactgtgaattgtcacgtgaattaacccctaaattgacacgtgaataatgactgtaagttaaacttacatgaccgtaaattaacacgtaaatcatgaccgtgaattgacacgtgatttaacccgtaaattgtcacgtgatttaacccgtgaattgacacgtgatttaacccgtaaattgacatgtgaataatgagctgaattgacacgtgctttaagccgtaaattgacacgtgaataatgactgtaaattaaacgtacatgaccgtgaattaaacgtgaatcccgaccgtgtattaacacgtaaatcatgcccgggaattaacatttgaatcattaccgtaaattaacacataaatcatgattttgaattaacacgtaaatcatg

SEQ ID NO: 41951 - DNA, 1137 bp, Heterodera glycines
  misc_feature (50)..(50): n is a, c, g, or t
  misc_feature (155)..(155): n is a, c, g, or t
  misc_feature (165)..(165): n is a, c, g, or t
  misc_feature (167)..(168): n is a, c, g, or t
  misc_feature (172)..(174): n is a, c, g, or t
  misc_feature (176)..(176): n is a, c, g, or t
  misc_feature (182)..(182): n is a, c, g, or t
  misc_feature (186)..(188): n is a, c, g, or t
  misc_feature (190)..(190): n is a, c, g, or t
  misc_feature (196)..(196): n is a, c, g, or t
  misc_feature (198)..(200): n is a, c, g, or t
  misc_feature (212)..(212): n is a, c, g, or t
  misc_feature (220)..(220): n is a, c, g, or t
  misc_feature (222)..(222): n is a, c, g, or t
  misc_feature (229)..(230): n is a, c, g, or t
  misc_feature (233)..(233): n is a, c, g, or t
  misc_feature (237)..(237): n is a, c, g, or t
  misc_feature (240)..(240): n is a, c, g, or t
  misc_feature (246)..(247): n is a, c, g, or t
  misc_feature (261)..(262): n is a, c, g, or t
  misc_feature (265)..(267): n is a, c, g, or t
  misc_feature (279)..(279): n is a, c, g, or t
  misc_feature (284)..(284): n is a, c, g, or t
  misc_feature (296)..(297): n is a, c, g, or t
  misc_feature (300)..(300): n is a, c, g, or t
  misc_feature (307)..(307): n is a, c, g, or t
  misc_feature (330)..(331): n is a, c, g, or t
  misc_feature (362)..(364): n is a, c, g, or t
  misc_feature (375)..(375): n is a, c, g, or t
  misc_feature (401)..(401): n is a, c, g, or t
  misc_feature (407)..(407): n is a, c, g, or t
  misc_feature (410)..(410): n is a, c, g, or t
  misc_feature (421)..(421): n is a, c, g, or t
  misc_feature (424)..(424): n is a, c, g, or t
  misc_feature (427)..(427): n is a, c, g, or t
  misc_feature (438)..(439): n is a, c, g, or t
  misc_feature (443)..(443): n is a, c, g, or t
  misc_feature (452)..(452): n is a, c, g, or t
  misc_feature (454)..(454): n is a, c, g, or t
  misc_feature (457)..(457): n is a, c, g, or t
  misc_feature (489)..(490): n is a, c, g, or t
  misc_feature (493)..(493): n is a, c, g, or t
  misc_feature (505)..(505): n is a, c, g, or t
  misc_feature (513)..(514): n is a, c, g, or t
  misc_feature (521)..(521): n is a, c, g, or t
  misc_feature (527)..(527): n is a, c, g, or t
ttttataaataggtacctaaataggcataaaaaagtgatccttccaaacntttagaaaaaaattcatccaggtttcattgcctttttatcgatctaaatttatttttcgtaattttctttgtatttttcgccatgttcttccctgtgcttcgctntttgcctctntnngtcnnngntgctcncgcnnngngtcgcntnnnctctttcccccncgctttcngntggtttnnccngtcnctncctgcnntgttgtctgcttcnnccnnngttttgctcgcncttgncttgttttttcnntcncttggcncggcgcgtgggctctttctcttnnttggccttcggcccgctcggtctttcggggnnncgcgttttctngcgcgtcgtttttcccgtgcctgttncggttncgncttcctttccnccntcntgcgggggtcnncccntctcttccntngcncgttccgagtcgtcgccgtggcttttctgccnncgnccgcgctggtcntttgttcnnttctgcncggtgncgcttcttggcgattcttctgctgctgctgctgctgcacggctcatcagttgaagtagctgtctcctcctccgccgcctccagcgcccggtgccgcgttgcgcttgcccgtctcccagtcgtaggggaattcctggacgccggcgttgctgaggctgctgcgcaatgtcgcgatgatccagtcgtagtcgggcttgtcggtgtacttcatgtcgtcctgcaaaatttaatttgttagtttattaattttggaaaaaacgaacgaacgaactcacgatgtatttgaggacctggccgaactcgttcgggcatccggagagcaagtcggcgattgcctggcgtcgaacggcttccggttgtttcttctggcgtttgatcttttgcctcgccctatctgtaaaaaagaaaccatggaaatcaaaattctgattattcccctcccccccattcgctcacccgcttttcttttccccccacgattgggccccaatgggaggtgcgccttttcagagctccactcatgcagtagaacccccgatttcaatgtcgtccttgtcggttgtattcggcgtcccaaatgagcgctgatcgcagcgtaaacgggagcttcc

SEQ ID NO: 41952 - DNA, 1354 bp, Heterodera glycines
  misc_feature (126)..(126): n is a, c, g, or t
cgagttacgaaaaatttttgagcctcgtaatgacatctcttatacccaatctctctactttacttgctacttgcgagatgcgaatttggctgttgttctcccggcaaccgccctcttcgtcctttnggcaattgaggcacccttgtggacagtatttggcgtactgtttgtcgcaacagtaataacaactgcagcgtgttgaagcaatgacacaatttttgttttggtctttaacgatatcgaactcgcagaccacacagtttcggccgaaaatgttgcaatgtgggccgggaagatcgatggcacagctaaacaagatttatgctgccagtgggtcggcctttttttgcacaaaatttaattattcgacatttaggggcccgacatttcggaaactgacagtcggggctataggttctcggcatggaagtggggcagttccgtctgagccaagtttagagcatcataactgttttctttgttgaccaaatccaacaacactggtatcattcgaaagcgcctaacaaactctattggcttcccaaaaatcacaaagatataccaagtcttgggacaattacgatgttagttactcccctggataaattatttttaaaattaaaaatattacgttaagctaactatgtcatgacagcatcctggtacataacctataacattagtgcatggagaagcctgaaaaaaagaagattactatggaataattaataaataattggcttacttgtgggacaaaattggcgagaaaaataactccgatggacagaaaatttgtgaaaaatgccatcttgacaaaataattaaaatatattttaattaccagtaaatatttgaaataagaattctgtgattttataaaatttgtagttatgtgctcagtttttgcagctaaccaaattaaaaaattcaaaataaaaatgctttttttaagaattttaattaaaaaagaaaatttttagattttaataaaaaaattatggcgaacggggctaaaccaactaattgcattttgcttatttctttaccacatttatacaaatggacgtgtggatcagaataattaatttaatgctttttaaaatgaagcggaaatattaaaatatttttggtttttatttataaaaattaataatttattcaagactaagcatccgaaaaaatgttttgatgatgaagaaaaactgctattagaaagcaataaaagaacaaattaattcagagcagaaaaaagaaaaagggatatgaaataaataaagaccggacttttaggcacgaaaatttctcaaataggcacctaaaataggcacgaaaaatgtgaaaaaaatgttcaaaa

SEQ ID NO: 41953 - DNA, 1009 bp, Heterodera glycines
aaatttttccattaccgcaagagctgcggaatttgtgaataattctcagaaaaatggctatctctttttaggacattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggccatctctttttaggacaattttctatctcgtaaccccgatgctaatacgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggctatctctttttaggacaatattctatctcgtaccccgatgctatcccgttcgcagagcctctt

SEQ ID NO: 41954 - DNA, 899 bp, Heterodera glycines
agaggagaagaaggtaaattttcgaactttcacaaggtctaccagggaaaattgaaaccggaaattgttgacgctaatcaacttggtccttctgcaccactgataatgtttaatatttagactgtaatgagatgatttttaataaatccaagagaatttcggagtttcgactccttaggctacaaaaatgaaatgaatcagtgttgcagaagaactcagttgataaggtcaataatctccactttactattttcgctcgactaatttgtgaaattgttcacaatttcagctactcattctaaaaatataaatggtatcagtgttggggaaggaccgaatttataaaaagctcaacaaattcacatctacaatttctgttaatttctacaattatttttagaggagaagaaggtaaattttcgaactttcacaagggtgatcgagaaaattgaaaccggaaattgttgacgctaatcaactcggtccttctgcaccactgataatgttaaaagcaaaaaaaaataatataaaaaaaaattaaataaaaaaagaaactctttacttaaaagttttaaaccatgttcacaatttcagctcctcattctaaaaatataaatggtatcagtgttggggaaggaccgaatttataaaaagctcaacaaattcacatctacaatttctgttaatttctacaattatttttagaggagaagaaggtaaattttcgaactttcacaagggtgatcgggaaaattgaaaccgaaaattgttgacgctaatcaactcggtccttctgcgccactgataatgtttaatatttagactgtaatgagatgatttttaataagtccaagagaatttcggagtttcgactccttaggctacaaaaatgaaatgaa

SEQ ID NO: 41955 - DNA, 1428 bp, Heterodera glycines
  misc_feature (50)..(50): n is a, c, g, or t
  misc_feature (69)..(69): n is a, c, g, or t
  misc_feature (142)..(142): n is a, c, g, or t
  misc_feature (151)..(151): n is a, c, g, or t
  misc_feature (162)..(162): n is a, c, g, or t
  misc_feature (173)..(173): n is a, c, g, or t
  misc_feature (184)..(184): n is a, c, g, or t
  misc_feature (189)..(189): n is a, c, g, or t
  misc_feature (201)..(201): n is a, c, g, or t
  misc_feature (217)..(217): n is a, c, g, or t
  misc_feature (219)..(219): n is a, c, g, or t
  misc_feature (256)..(256): n is a, c, g, or t
  misc_feature (261)..(262): n is a, c, g, or t
  misc_feature (270)..(270): n is a, c, g, or t
  misc_feature (279)..(281): n is a, c, g, or t
  misc_feature (295)..(295): n is a, c, g, or t
  misc_feature (315)..(315): n is a, c, g, or t
  misc_feature (352)..(352): n is a, c, g, or t
  misc_feature (363)..(363): n is a, c, g, or t
ttataaataattttaatccaatttataattttaaaaaccttacagaattncaaattttgtaaatttaanaaatattttgcctttaattgaaaaaattaaaggtaataataaaaataaaatattttaatataaattaaaaagnaaaattaangattaagaaanaatgtagttantttatgttaanatatnaatgtggagtgntttggtagaatggtgnanatgaagatattatttatagattttaagaatatgatgnaaatnnttaattgnaaaaatagnnnaatatatgaagatnattaataagataaaaatttngttaattatattgattttattaaaaaaattgaaattnttttgtaattnaaaatgtttaataataattagtgtatttatttgtattgtttatatttaattatttaccattaccaataaataaactattgtattagaaaaattaaaaaattaatcctttaaaattatgaaaactttgttacaataaagcataaacaactgaaaattttaaataaatatcaaatattgttcgtcattctcttgtgcaatcattaaaaaaattttttactatatttactttcacttaattatctatatattagagatcggtattttccaaaacactttcttttctgcgttcaaacattaattaaaaagttttattggataaatatttaacaatttattgttttataattattggcaataaataataatttctcgatattgactaaataaaaataactaattttcttttattgattaattagcaatataacacattcgtaaaaaaaaggatttccaagaaacaaaggaattatagataatgttagaatgaaacctgtttgattgaaattagaatttaaagttcaaaaaataattattaaatattaatctttaaaaaacaatagcaagacaaaaaatatttcaaatagttttataatgttacattattgcttcaaaattattttttacaaaaagaaaaacgataaaaatcttaacaaataaacttgattaaatttggacaatattttattgttaaaaacataaaagttgtattgatttcatactttttttgagaaactatcaatgatttaaaaatgcattgatttaaatgaatgaattaattaaatttgattgaataaaatgaatatgaaaaaatagctattataatatcacctaatataatgcatattttcaagtatcgacactttcgaacatctgtgcaagttgagaaatttacaacaataatttaatcaattcaattaaatgattttagattaagtaattcaacttaaattaattataaagaaaaatttaaataaaaaatatttgcacaataatatgccagtagatactttcacttatatttaattacaaacaaattaacctttaataaaatttattattcaaaaa

SEQ ID NO: 41956 - DNA, 1082 bp, Heterodera glycines
  misc_feature (5)..(5): n is a, c, g, or t
  misc_feature (35)..(35): n is a, c, g, or t
ttttntgagttaaaaataaaaatttccaaaattanttctatcatatagaaagttacaatagcaaaatattttatgtaaaatgccagcacttttgtcattttcactgttcattttgccaattttaatatgtgaggggggggggggggaggcggttcggtgggaagacgaaaattcggatgacaatttaaacaatatcttttttggtttgactctaacttaattaataatcatcacatttgccatggcataatattggaagaacaaaacggcaccgccgaaacattgtggcgaatttgattttttaaaaaataaatcgcccgggtggtcattgacgacgaatcgagagcagagaaaacggcactttcgcaatttccaaatcaaagtgttatgttacaacttacaattagcttaattagttaatctcctgatcaaatattattattttttttatttaaataacttacacatttttgtcttccctctgatgaaagaatgttgaattttttagctttttaggttaacaactagaaaagagtttctaataataatagcttaacaaccaccaataaaatgtttttcttttttgtgaccatagggagctttggaaaaaatagggaaaacccaaaaatatcgtcactaatcataaaaaacatcatctctctccaaacaacaattatttctgcgccagcatttctttttcaatattaattcaataaaatataatgtgagtgtatttgaatggtataacaaaacaagaaaaattaaatatcctaattaggaaattaaaaataataaattaaatacgcaggcatttggaaatgataatatcaagaaagaaaccaatatgaatatgaaaaaataataattaaaatcaatatattttggttggcacttccgcttggcattcatttaaaaccaaaaaagatcggcattcgctgttttcaaataaataaattattattaatcctcaagcccgcagcatgatccgctaatttgaaatttccgggtcttattccttattatataccaggggactaggtcgttttagcttttttatcttgtcgaccaaatctaacgatctt

SEQ ID NO: 41957 - DNA, 733 bp, Heterodera glycines
ttcactggggactcagtgtgtaccacactcagattgcttctgttcggtttattactctgatttttgaccaagctcattaagttctctcgaatattaccaaatatgtctgggtttgaccctcttaaaaggttaggaggacccaattttgtccattttttcgtgatttaaaccggtttaaacgctttgccgcgccgtttttttttatggtttaggcattttcagcacctaagaaacctataaaattgtttttatgcaatttagagtctgtgacctatgatggatatttaccgaaccgctaaatgataaaaaaatgttctcgaggaggtgctagaaaaaaatttaaataaaaaaacgttttaaccatttaaataaccgagtttgacattaaaacagggcttcgatttatctgatttatcagaaatgttctgatttggagggttcaagtctgaaaatcataaaaaggttctgatttatcagaaatattctgatttagggtgctgaccaaattttgttctgatttcttaaacattcttaattttgaaattgtatgataatgtttttattttttctagaaatattaaaatttgacacaaattttggcgcacgacagactgcttcctccgccccgcgtctcgccccactaagtgctcctcctttttgcgttgttcataattttactcgttggacggttcagtcccaaaggtattaggccctttcagtccagaatcaataa

SEQ ID NO: 41958 - DNA, 928 bp, Heterodera glycines
ttatcattttttaatctcctttcttcttccttcactctctcgtgctctctcgaacaatttttaaattagggttacaaaatataaaaatttgatgagacttttttccaattggattcttttctatatctttcgttttgttttataacgaaaattcacggggcaatttacatctcagcctccgccgaaggttaattgcaaaacgggcagaattttcccccgttttttcgatttttctttttagatgaatttagataaggggcatagcctttataaaaaataaatgccgctttttaattatggcaaaacattcaattattctttttaccaaaaacaatgaatcccaaaataattccaaatgaacttttgtttgaaataatcgcctttatccgctttaaccgcaaatgggcaaagtgccgagtttgtttttcatttgatcaatttttgatccgacggcaagctgattggctgaaattaatattcacagtggtcagacacatattttctcttttccacaaataaatacatgaatttactctgtttttctccctcgtcccccaccaaaattggctcttttaaaagaggacgatccaatgcatactgtatttgatggattactgtcgcaaaaatattgtttctaattaaattatttaaaataaatactcaaaatacttttcaggttaagaactgcaaatcgttggtcagaagtttggtgaatcgcatcaaacagattccagtgaattatgaggtccacatggatggtgtgccacaaagtgcggcacgtcatcatgctgaattgacgtacattggtaagtaaattttgataattatattaaaattatatataatttttacacccaaataaaaagttcggtcactttagggctgtcacgactcatcaaccgacttccaagtttgcctgctgtgcgcg

SEQ ID NO: 41959 - DNA, 774 bp, Heterodera glycines
tttctcggttcccgattcccgagtcgagaaatttctcttgtttttggggtctcggttctcgtatcaacatatacccatctattcctcaaggtctgttattcacgaatcgaaggaatttttggataaaaaagaaattggcaaaagttatgggtcctcaaggacgcctaaagtgcaaaagagctctagttttaagcgatgctaaaaacgaaaaatccaactcgtactgcgatttgagataaatttctgtttttgcacagtacagttgggaaaactagtacgaattgggtttagtccgctaaaaacccaccaaaaataggttcaaaaaatcttagtttaaaaattattgctattaagttcaaagagtctgttagcattcccatgaaataagagagcattttccacttaaacaaaatataaatgccagggaaatatgcaagaacaacaaatccacatacatatattatacatatgaacattatcacaacattagtgggacaaatacaattatcagcacgacaaatgatgattatcaatccttttttcatttattgtccatcagttttcacttcgcatttcaaaatccaatccgtgtccaagacaaatgtgccgccggctgtcaccaaatgccaaaatgctcaaggcacacgtccaatagaccttccacctccaccacgcctgtgggaagacatttgacgaaggaatcgcctctcgcgcgcattatttgacatcacacaggagcaaatgatgaaaatcggaacacagcagatgacacaa

SEQ ID NO: 41960 - DNA, 893 bp, Heterodera glycines
ggatgagcgagtgcccaatggctggcattagtgcgcgaccgctcgcagccgcagcgccggcgcggccaacgcggcgcgccgcccgccactaattaccaactctgaaaattgaagggcatttaccgaagaattaagaaaatccattaatttgtaaaatcaaaaaatttgctaataaaattgcaattgtgaacggatcaatagaaaataatgggaatttttttgaatgtaaagtcctttttcccattctttggaagaacttttgctgtgattcattctttcattctctcccccggggggacggacaaacggcggagaatgaatggcgaaaaatgggaaatgaatgccaaatgcattttaatgggaccaatggcaaaaaaggaggacagaaagggagaggtgccatttaagccaggaaaaatgactttcaattaccaatttattcaaaattttgatatttaatttaacccttttctgacccagaaatagtgcacgaaaaagggagtagtagacgacgagagtaaatcctccatcggatatccccattaatatttggtaaatcactagccgaaattgaccaattttggattttgatgcggtttttggctcaaaaattggaagccttaaattttgatatgaatggtgtaatagaaataaatgactttttttaattgaaagccctttttccattccttggcgagtggggaggcgagcaccggaacatggagaacattggctggtatttttctgttttaggggcccgatttgaattttaaaaaaatcaacaaagggtttggtatagaattgcaaaaaatatattcatttccattgtataaattaacgatcgatggcattccaagaaatttattgttagctcaaattctggcatttatacc

SEQ ID NO: 41961 - DNA, 705 bp, Heterodera glycines
  misc_feature (554)..(554): n is a, c, g, or t
aattccttgaaaacattaaaattctttaaaatttaccataatcaaaggcacaaagaatgggaagctcgaaaagacagcagcagctctgaccaaattaaagaaagaagaaacaaaggatggaaagaaaaaaaggaatatcattaattatttgtcgattaagaatggaaaatagatgtgaattttattttataaaaatttctttagttgttaatttaaaaaaatcataatcacaaatgaaattttccaataaattgcgggatcccgccgtgcgggattgcgggattttggaaatttcgaaaaaaatttaaaactaaataaaaaatttcaaaataaatatacctaaaatggcgacacataaaattttaattaaaaactaattgaatgaataaacgatggaagcagaatttgttattttaaagatcaaaaaaaaaacatatttttgaaccttttgttcaactgttttttgcgataaatagaaattggtttaactgtaaaacacaccctttggatttcatttgtcattatggtacattagccaaccgtatacccattanaataatgtgcatgaaaaacgagacctttatcttttttagtcgcttctagcatgaaatttttgttgctttttttatgcgtgaattcattaatttttctacaaaatttcaatgaatcgcaaaggtggttctaaatggggaaaatattttttta

SEQ ID NO: 41962 - DNA, 626 bp, Heterodera glycines
accgacgggtggaaatcaccgggccaaccgaccgcaaaatggtgatcaacgcgatgaacagcggcgccagggtgttcatggccgactttgaggtggtgattggttgttgttaattgcttttgtttcgacagtatggtgggggagttggggcttactgtatcatggagggctattgagtgggtgggcgcattggctcccggacaatccgacagtggacaatcggacagaggtggacaatcggacagtgaggacaatccgacagagatggacaatcggacagtaaattacactaaaagatattaaaatgccgtcgccgaaggggaccgattgtgccgtatcaagaaaaaaggaaaataggcaaataaattgagtttttgtaataaccctaaaatcaaacgatatgaatgtgcgattaatactgtaagggtgtggaaagtcattcaacagccaatttcgttttctttgtacaccattaagcacttttgtcaaagaaatgtaagaaagtaggcattggaattttattgatcaaaatttcacctctaatttacaagacggcattcgtgtgcgaggaatggcaagaaaaagcgcttttatttcaataaagatgtagccgtaccttcaaaatg

SEQ ID NO: 41963 - DNA, 1632 bp, Heterodera glycines
aaaaattagtgaagaaaattggagtcaaagggaaaaaataaaaaataataataaatatattctttaaaagtaacactgcccaagtgtgcaaatggcctaatggttagtctccttgactttcccttcttctttcccctggttcaatccctctacagaattagattattttcattttttttttgtatactcgtgggtttcctataaagaaaatatgattcctcatagttttttttaaattgatacatattttatcattttttaaatgaaaatcctaccaattgaacttaataatcgcaaaaaccaacctttttttgttgaaaatctgttaacaaatcgcattaaaaattacaaaaattcccccccggcggcgcctatcgcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaattttttttttaatttttaaaatttttttgaatttttaaaatttcccggttggtcccggttcacggtttttcttgcggtcccggtcccggtccccaaaaaaaatcgaggtcccggtcccggcttctcaggtcccggcaagtcccggtcccggttttggcaaaaattcccggtcccgtggcactctagtgtaaaccttttgaaaaagtgtctgtctgtcggcggttcaaatttaaattaacctaattaaattcatttgcaacaatagaaattttcatttgatgaatcactctcgctaattcaaatataatattttttaattatttgaaattgatttttcatcgcaaaaaaataaaaaatttattttttgcttaattcttttctatttgatttttgcattcaaatatataattttttcagctagccgctttacaccaatcaccacacctcaatgtacacgccgactgagcacgcccactgcacatcgaagcgccactgggttccgctttgcacgtccgtgtgccggagggagcgcaacagttggatgtaggcggatgagaagcggtaacgggtcggatttggcttcgaattgttgtgcaacgacgaggatgaggatgatgaagtgctggtagtggttgtggtggttgagtgatcagcagatttttctgtacaatttaaaaattaataagtatgcagccatcccagttttcaaatagcttacgtacttgtcgaaggttctgagcacgactcgcgcaaatggagataaccgtcaggccgaagccattgaagagcattggcaacaaattgtaccgcttcctgatcagccaagtacatcaacaaccaattagtgaaaaccaaatcaacactagcaaaaaaatgaaatgagaattgaaattgaaaatcatttaatgtaaaaaatcatttaatgtaatacgtgtgtatcaatctcaaaattattattattatgtcaaaaatagatttcgagaaaaagtgatcaggtcctagtaaactagaaattaaattaaatgt

SEQ ID NO: 41964 - DNA, 1409 bp, Heterodera glycines
  misc_feature (1262)..(1262): n is a, c, g, or t
  misc_feature (1303)..(1303): n is a, c, g, or t
  misc_feature (1336)..(1336): n is a, c, g, or t
  misc_feature (1358)..(1358): n is a, c, g, or t
  misc_feature (1379)..(1379): n is a, c, g, or t
  misc_feature (1402)..(1402): n is a, c, g, or t
tttagcaaatgtcttgtaaattttaatgagagtttaaatgtatttttatttttgagttaattttatgttttattttatttaaattaatccaaaaaataataaatttatgtacaacagtgaattgttctttttaattgaataaatctttatgttttttaattacattttgaattataacttcgaataaaagtgattgttttttttaatttaattttctcatgatattgaaagtgagataatttaattaaattttttgataatgtagataattatgattgattatttataaatataaaaatcgtatatttaccattcctttaatagtgcctatcttatgactctctaaagataggataaaacgattgtgtagcattattccctaatctgttttggacattttgaataaattttggtcattttttggttgcaattgaaaaaagttacaacaaaaataagtgatgcaagacatatttgtcaccctgtaattttttatcaacaaacaaatgaaagtctgcgatcacatttttgagaaaaattttcaattctttaattttaatagcgctccattgtcaattgcaattaatttggtgatttaatttaaattctaaattattcattaatttcattttcagcaattattttatcaattgattcaatttagtgagtgttatctctactcttggttattgttttttataattttatttaaggttctcgatcatcttcgattcatttttactaattaaaaaaatattaaattttattatttataataattttatttaatattaaattgatattgatattgatttccaataaaatgaactaatatttaattttataaacggtaatatttttgaatttagcttaaacaatttgaattttaatatttattatttaaaagatgatatattaatgctgtccttttttcctcatcgcttttccagctattttttccttagttgttttattgaaatatgaattttaatattctttatgaatttttttaaataagtttcatataataattttagttaattcatttatttgttatcatttgattttaaattaatgctacaataatttctatttttaatttgaaaccgattaatttcatatatggtatgtatggcttctctttttatttcatggtctccatactcatcttcatcttcatttcagaagttagcctttgtttattcaagtttctgaaataattgggctcttatttctgccgaaagtattattattatttttgctanattaaatgagtatttaagtgaatattttttacaaattttanagtggacccgattatattttcaattattgattncagaattgaattattttagcanaattatttaatattttattanttaagcgctttaatatttttcanaaattct

SEQ ID NO: 41965 - DNA, 817 bp, Heterodera glycines
agtgttacggtagagtgggggggggggggggaagtgcgtttccaattagctaattacagtttaatttgtcccgaaagaagcatctgaaaaataataaattagagctcgacctgctggacctggatccaggcctgggtttttccttgacccaggtccagaccatttttagatggacctggattttactgaattgttgtccttaaaactaggcccaagtcaaatatgaaaaaaaatcgggtccaggttcaggttgggcacgaaaaacctgaatttccttgctaatattttagaataaaaatgataatacatagataatattttctaaatattgcgattttatgggtttatttgctcaacaattttaaattcttttgttgtattgatgaatcattaattgactttttaaaatataaatcagaattggaccaagcaaaacaaagaaaacaaagaaacgtccaattttaacaattaattttcaaaacatttaatttttggaaattattatttcttattttttatttaaggatccaagagattcgagaagagtggcactgaaggtgttctgtttttgagtcgacgaaccccccaaaaatatataaatttggcttttaagaaaatgccaaatgtcttccaaaatttggccagctgtaaaagagtgtttcgcgagttgcacatggtgtgttagcaataagttaaaatgccaaaatattttaaagtattgaaaaaagtaataaaatattttagaaaaattttaatttttatttatgaaagttaatgataaaaagaaatatttgaataaaaatgatattttttgtga

SEQ ID NO: 41966 - DNA, 1311 bp, Heterodera glycines
  misc_feature (124)..(124): n is a, c, g, or t
agcatttgccacgttcagtgatcagttactacttctaccattattcatcaccagccatccttcttcctttactatcattagtgaaacgattaaaaatggattaaaaagaaagattggcgaaatntatgaaaaattgaacatttcttgttcgcccaaacctgcttcgttcacatggatgatttaatgaaaataaatataagttgtaaaaagatggaatgcagcaccattccttacaataaagaaaatcatttatcgaaaaaataaattttcgcacatcatataactcatacaatataaaaaatttaataaatcctattcaattaaagaaattttttagtaatgtggaaataaaagaaactaaaaaacgagtgaaaatagttgcttaaaattaaaaatattgcattaaataaatttaaggaatgattattaataaaaaaaatcaaattgaataaattttctaaaaataattttttaataaaacaaccgtcatcaatttacttgcgtaatttaaccaggcagatgaaaaaaaacaaaacaaaaaaaacaaaataaaaaacggtattgaagaaattacaaatatttacctagatatattataaaatttacaaagaaagttgatcttttcggcctctgttaaattctaattaaattactaaaccaaagtaatataaacaaaaatataattaaataatatattcaaaagatattgaactaaataaataaataacaaaacattacttaacattaattattgtggcccaagcgcctgacaacaacacaattatttcccgacgaggaacaagataaaaatctattaatttttatagaaattatttacgatgacctaaaacttcataaaaaaaacaagcaagataaagaggatgattaatattaggcataaacaaacaaaacaaaaatgtcaaatatttgataaggcaaaaattgagtaaaaattttagtatgaaaaataaatttaatttaattgtatgatttttgtgaattgaatagaaaattaataaatgtaagatattttatgttacttttttggaaaatgaacaatataaagaaattattctttaaagtaagaaaaaacaattctctttaaagtatatatctataattaaatcataaatataattcttattatcagaaatcaaaaatatgctattataaaacaaaaaggaaaatgaggaaactacaatctttaagcgctctaaatttttttttctcgatgatgattatgaacataaaagaatcattcattagttaaaaatcattaattttatttatgtgaataaatatacttttaat

SEQ ID NO: 41967 - DNA, 812 bp, Heterodera glycines
gttctgtccgagttgagtgagcaagtgcagtcgccccccccccaggggatggatccattactttgcccccccccaataacctccaatctccccccccccaattactgctgctgttgtttatttgtccacaattcgtcgcccccattgcccccccccccctccccaaccctcccgcgctctttctcaattgtcgacagtccatcaaaattcagcagcaacagcacacaattgagaagtcgggggaatacgcggcgcacaaatttatgtgctgccaatgaatccgataaacaccaatttgcatatttattataaattttttttttttggattttttcgattcaatgttttcttatattatagtccattgatttaattaaggtcagagttttatgcatttttatttgatatgacaaacaaattgaatttattgggaaatattacatttttgaaagctctttcggtgaggataagctgatcaaacaagccatattaagtgcaaaggatttgaaattattacatagagaaggaatcttgggaggaattcgatccaaaatcctttgggagagtccccacaattcaattagctgtgcaaagagaacgaaaagcatttcatcgaacggacgatagggtcggtagtggggcaattaagcttggataattaatagttccggtcttgaagattgtactatatgtattctctactactttccaatgttgtcccttaaaaaagaatgcaatttcttaaaatactataatcctttcataaaataatgaaatttggcgccttgtcatttggcatattgtttttcccg

SEQ ID NO: 41968 - DNA, 823 bp, Heterodera glycines
ttttttgcaaaattaattcataagtattttttcagaaagtgctctgaaacacacaaaactttatttacaggttaattaaggctctctgatgttttttctatcaaaagggagatgaataaatattttaaaaatttttaattcctttttaaacaggccaaaaagtttaggcttatattttaaaaagtttcatcgaacctagcgcactaaaatcgatataatctctccaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaaatctaaaaatattgaattgctttttaaatatgcgaaaaattttaggcttaa

SEQ ID NO: 41969 - DNA, 985 bp, Heterodera glycines
  misc_feature (46)..(46): n is a, c, g, or t
  misc_feature (54)..(54): n is a, c, g, or t
  misc_feature (61)..(61): n is a, c, g, or t
  misc_feature (65)..(65): n is a, c, g, or t
  misc_feature (100)..(100): n is a, c, g, or t
  misc_feature (106)..(106): n is a, c, g, or t
  misc_feature (110)..(110): n is a, c, g, or t
  misc_feature (969)..(969): n is a, c, g, or t
aaatgtaattttttttacatgaaagcatttggatggcttgctgttnacagtggnctagtcnttcnttgcaagaagcagcacaactttgtttgggcccacngacccnccanaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgattcatcttttttatggttagcgcatatgtctctagctttatagaaacggtcccagaatctgcgaggaactacttttttgagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataaatttttcaaaaaatgattcatcttttttatggttagcgcatatgtctctagctttatagaaacggtcccagaatctgcgaggaactactttttagagaatttctatagattattattctgcatgaatccttcgcttaaattcccatttatcttataaagtcagattaaattaattactccgatttgnttttagaattggtcca

SEQ ID NO: 41970 - DNA, 1240 bp, Heterodera glycines
  misc_feature (14)..(15): n is a, c, g, or t
  misc_feature (856)..(856): n is a, c, g, or t
  misc_feature (874)..(874): n is a, c, g, or t
  misc_feature (898)..(898): n is a, c, g, or t
  misc_feature (959)..(959): n is a, c, g, or t
  misc_feature (986)..(986): n is a, c, g, or t
  misc_feature (1007)..(1007): n is a, c, g, or t
  misc_feature (1131)..(1131): n is a, c, g, or t
  misc_feature (1138)..(1138): n is a, c, g, or t
  misc_feature (1183)..(1183): n is a, c, g, or t
ttattataacccanngctttggaataaataaaggaattttctttttcgtgttgaacgcgcctttgggttcctataagcaggaagccttcagatttagccagaattgttcattcagcagcgaataattttgcatgttttttcgttttttattttgtagcctaagacaaaaggaatagattagtcgttaattttaaaataactgcaaactacgatgtctattgacaatattccttatactttccgagtcggccatatttatggatatcattgttgcagctaacttttatctctgatgtcctcataaataaattagagatccatattgacaaaaaattatcttataaatgattgtcacggatggaagtaaacagttgagtcataataacaatggctgagttcctgtaaaaatacaaaatataattaaatttattataacccagctttggaataaataaaggaattttgtgcttcgtgttgaacgggcctttgggttcctataagcaggaagccttcagatttagccagaattgttcagcagcgaataattttgcatgttttttcgttttttattttgtagcctaagacaaaaggaatagattagtcgttaattttaaaataactgcaaactacgatgtctattgacaatattccttatactttccgattcggccatatttatggatatcattgttgcagctaacttttatctctgatgtcctcataaataaattagagatccatattgacaaaaaattatcttataaatgattgtcacggatggaaataaacagttgagtcataataacaatggctgagttcctctaaaaatacaaaatataaataaatttattttaanctatctaattataatacncatattatttcattccttcttaanaaaaacacatttatatacacatactatccacaaaaaatcacacacaccaactcaaacaacnaaacatctctcaatatatacttcacanaaaaaaacatctctcattttnacatactatttctttatctctattaatacataaacctaatatcaaatctctttttacacaaaacaatctcttttattttacttaaaattttaaacaaaatttcaaaccatcatatacctatttntatcttncactttcactaacaacccttccataaggtcctactatattcttcnaatcccgtattcttagcagacataggataaatcattgaatttaaaattttctttaaa

SEQ ID NO: 41971 - DNA, 635 bp, Heterodera glycines
tattcagtctagttcctcgattttgttcataagcattgtgtctacttaggcccgtcctcaaaattttttttttttgctccgggtcaaaatttttttgtccagtgtaagtgagctaatttttcgcgctgtagaattccccccccccccccccgcttctttcccactttgacttttttagatttaaactcagaaaattttttatgaattttttgaaattttacggggtgcttacaatttttcgccccaattttccaatctgcgcaaaaaaattaattatgtaattaaaaagagtgttttctgaatactaataaaataatggaataatacacaaattatcgaaaaaatttatttttatttatttttctttttttttattatgatgaatgactatttttttaactaaaaagtttcggggtaaacccaactcatccaaacccaactcatccatagcacgatacgagtcgtcgccgtggcatttaatgccacgactaagaacgtacaaccaaaaaatactacgactaagaccgtacaaccaaaaaatgccacggtcaagaccacataagcagaaaatgcaggggcgtatctagaaacatttttcgggggggggggacccgacccgaagacctttttttttt

SEQ ID NO: 41972 - DNA, 868 bp, Heterodera glycines
aaacagatcctgtggggattttgcttagcctgtggtcttaatcagtgtaaaatgaactggaccaagagaccgtaaaaatatttttttttcaaaatatcacctgaaatcctggattttaaaattccgggatctaattaaaaagagaaatccgatgagcccttttttgctcttacaaattagtcacaaaagtatcgttagcccgacattgggctttggggcagggggggggtgtcctttctgaatttttttttcgtcggttttacatgggtacgactctaagttggaaaatcgaacctcccgcattattttgtaagaaaatgcaaataaatacaataaattgaggagagaatggaaatgagaggaacgaagaagaaaaaacaacaaaacaatgatgggaatttgaagggggaagaatgggaaattggggacaaattgagaaaaatgtaacacaaaacataatcaaattttggtgttccctgtggctgatggttcaacaattcaacaggttttgctttgggtgggtgcggaggacagacgaaaagaaatggggcggaaaatgaaaaaaatagttaaatttattttgtttaatttgttttttaaatgggacgactggcttttgcttatttatcattttcgaactttagatcgttaaaatatcgaatgttttggtattttggtcatttgtttcggtagagaatctcgaatttgtcttttcaattcgagactcaatacaataccgcgacatttggcattgtcatcatccgaatgcgatttatcaatttttgaataaaaagtaaataaaagaagccataaaacaattttcatttttcttaaataaaacaaattcgtaattacgttcctttataga

SEQ ID NO: 41973 - DNA, 992 bp, Heterodera glycines
cgcactaaatcgatataatctctccaattttgccgtttttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaagattttaggcttatattttaaaaagtttcatcgaacctagcgcactaaaatcgatataatctctccaaatttttgcaggccttctccattgtaaaggactaacttaacctgaaaaaatgccaacgcttgttgtttttaaaatttttcgaaattctgactttttctttaattatttattattttgaaaaattaatttcataaatatttttttaaaaggtgctttgaaacgcaccaaaatgttaattaaaagttaaataagggctttctgatgcttttcactaacaaaacggaaaagaataaaaaatctgaaacatttagttggttttttaaaatttgcaaaaatttataggttaaatttttttttt

SEQ ID NO: 41974 - DNA, 165 bp, Heterodera glycines
cgtttgtccgtaaagcaatcgctgccaccgcaacagttcgatgtgaatgggaatttggtcactgctgatcggccaacagcagaagaagaaacaaataatgaagcaagcggctttatcacagaaaatccgttaaatttaaattaaaattttatttatttatttttt

SEQ ID NO: 41975 - DNA, 787 bp, Heterodera glycines
tggaatgaattttaggagactgaggggaaaagcgagtttgccttggactaacttgtgggttagggttgaaaaatttgggtttggcaggggtatgaatcttggtaacagattcaatttgttctcgtctgcgcaaaagggacctgaggtagtccttgagtttgtcgggagtccaatcgtcgtcctcttccttgagtttgaataattcgtccagtacgaagcgaggaagtcgctcttcaatttccatttgaaatgacgtcggattaaaggagtgtccttgctggtccatttgcacacaaatgcattccaattgctcagttagggaacgaaggtcgggacaaaaattatcgcccccacggacccgagggaggttacggagggaattatgtaaagaacgcgcaacgtcctcgggattgtcataactttttcggagtaagtcaagagcggtggggtaagaagcatccgaaacgggaagaggactaattagggttaggggggaaccagtcaagcattgtttaagataagtaaatttaattgagtcagaaattgagaggtcatggacaccggctttaaaagtgttccaaaatgattggaaagcggtacaatcacctgaaaattttgggagttcagttttgggcagatggattagttggttgttagtatttgggactgaattggttggttgttggggcttggaaagtcccaactccaatttgcgtttgtcgttccgaagggctttggcgaattggcgcaattcttgtaagcagttatgatagggagtattagcaac

SEQ ID NO: 41976 - DNA, 894 bp, Heterodera glycines
aaattgcattaaaatacttttaagccttgagctaagttttgatttattatttatcaaataaaattcaaataaataaattttaaatattacgattattcatacttatgtcacttcggcttatcacgtaaaaaaaagatatggccagaaaaatatgcctcagactgaatggacccatttcatcaggctcaactgagtttagaatgcaagaaaaacatttttatgcatgcttttgttcaacaacaaatacagcaacaacaattcgcacagaattcagtcttatgatcacttacagcggcaaaatcggttcagaattggaaaaagcatagcgacattcgtggaaaaagaatatcatcaaatacaaagtcgcagatgaaaaagatatgattagaatcagtgctgcaaacatatggttaggcatatatggcacacataaggcaattctcaaaagaaagcacagtatgaaaaatataatagctctacaagggtgctatgacgttagtcaaaaaccatcataatgggcgttagtcaaaaaaccatcaaatgaaaatattttttgatataactttgttcaaaagcatccaaatttttaattcttgatatcattcgataggcctaagggttttctattagctacaaaattccaaaaagtttcgttaagtatcaagaaagttatgactaaaaatgttcaaaaaaacttggctttttgagcttctcaggtcataactttttttaaacttaaagaattttttaaaaattttgcaggataatagaaaacacttagggctatcgaaaaatatctatattataaaatttgatccattttagacgaaattatgaataattttctgtcaacaattattcatttgatggtttttgactaacgtcccagcacct

SEQ ID NO: 41977 - DNA, 898 bp, Heterodera glycines
aggaccttatcgaatttccggtctgtctcgctttggcagcacattccagggtggtcgcggacccatttttgcacactttaaccatccgacacgaggatggaaacacttacgaagttaatttgttggaagagcaggcaggagatcctgaagccgcagcctacattgcgtttgtcagagatggggaatttccagctgatttggatgagaaagaaaaagagttatttgctgcaggcactgccaattacaaattgatttcgggaattctttattttgaggacaagggactacctccgaggatctatgtcccaatttcattacgtggactcatttttgaatcatttcgctcgtctcttttgagtggtggtcatttgaattacaggaaaacaattgccaaatgcaaaaaatatttttggcccaaaatgtactctaacgttttaacttgggtcaaattgtgtgtcacctgccaattgcgtcacaatccaacacccgcgtaccgggaagagatgctcatggtgccagccaacacactttttgccaaagttgggctggacttggccggcccctttccaatcactcaaaaagggaataaacacattttaaatatcgtttgttggttcaccaaatacgtgatttctgtcccagtccccgacacaaaagcacaaacaattgcccacgcttttcttaccaattgttacttaaaatacggtggttgtgttgaattaatcaccgataatgcctctgcctttgcttccgaatttttcagggaattttgctccatgctttacatcgacaaaaagtatgcctgtcctcattggagtcaaggcaatgcgtcaactgaacgcacttttcggacaccttggaggagtctggccaaatacatttcgaagactcagcccga

SEQ ID NO: 41978 - DNA, 865 bp, Heterodera glycines
gccggatgcaaaatcctctctgccgaaatggcttcttggccgaaaaccgcgcacaacgattgatctcctgatgccgcctcttccacagccaacggaaagagacgcaaaaatggaaaaacatttcaatcgccggtttgggactcgaccgcaacaatttgtgtcaaataagccaatttgggctagacaccgactctcgcagaactggagtgcaggaaccatctgtgaatgcaccggagtcatttacaaggtcaaatttcccgacggttcgacaaatcgcttccatgcgaaccaattgcgaaaccgggaaaacacggcaaatggacacgaaccattgaatgttttaaatgaggcattccatctgccgatcaccgcgccgaacgttggaaatgtagggcaggaccttgagccaaggcctgaaccgatcaacgatgagctccaggacgagatcgaacccgaacaggcccgtcgaagcccgacaccgccgcaacaacaagtgccgcgccggagtggacggaaccgccgagcccctgatcggtactcgcccggatgagccaatcaaaaggggaggtgttcgggtgatgaccccgagagagacatttaaattattttatttaagttatttccctctctctgtctcccgcactatttctctcattttattgtgtctgcactccctttgtaaggtcagacacatctttcctcccccatattgtgacccccgctcatttccatcgttcattctgtcttcttgttaatttcccacatttttctccgattgtcctccgccccaaatattaatttatttgtttccaataaataattgattatttcttggactgtttaagctcggttaggtaagaccgaa

SEQ ID NO: 41979 - DNA, 1041 bp, Heterodera glycines
  misc_feature (906)..(906): n is a, c, g, or t
aaacgagaaatgtcattgacgttaacggcaagcgcgtcgaatgctacggcataatttctcttccagtcgctcgaagagactgcgagcctattaacattcaattccatataacggacgctcccattggattaccaattctcctcggaacaaatgctttgggcccccttggtttcaaaattcttgattccaaacatggcgagcttatcgaatttgagcttgctagtgaaaaatctgattctgttcgcttaattcacactataatgctcgagccatattctacaaagttggtcgaactttctgtttcgaagtcctttgatcagaaaaatgttttaattgcgtcatccggcgtaataaacgatgtgaaagttgaatcatcagtggacagagtgagaaatggcaaagtgttcgcttcgattacaaatttttcgctaaattcgataattttgaaagagaatgaaagggttgccgtagtggaaactgtcgatgaaattgctaatgccgaagactgcttaaccaattcatggctatttgataactttcaacaaaaaatcgactcggaatgcagaaatactaatttctcagaatggaccccaaggatcggtgcccttgacagtgataaagcaaagacacttgaaaaagtgttactggaatctaaggatatttttgtttttaatgacaataaattgacccaaacggaaatgataaagcatcacattgacacaggagaagcgagtcctgtcaaaaagcgactgttccttacgcttaccgagaaaaagtggctacaatgatccaagattatttgggccggggaataattcgtccttcgctttcaccttggtctagtccgattgttattgtaccaaaaaagtatgggtcgttaagattctgtgtcgattacagaggttngaaatgcaattaccagaaagattgctttccattttgcaaatatgagcgaacactgctaatgcatgggggtcggaaatttttctccacttggactttatttctagttattggcagattaaaatggacgatgagtca

SEQ ID NO: 41980 - DNA, 1070 bp, Heterodera glycines
aaaaaattgctcaaattgatcatggacagtcaaaaatataacatgaacattttaagcgtgttttgaataaatttgtaaaaaatgaggctttttgatccaaaattcggtttttttttgcatgccaaatgaggcttttgaaaattttaatctggcagccttggtcatatagcacccatgctatgtatagacagacgtttggcaaaagttgactttttagaattgttccgaggaagcgaatccatgtgatattattaaagaaggatttccaaaaaagtgctgcagaccaagaaccaaaaaaactacggtaggtatacgatattagtatacaaaatgtatatgcgttttacgagtgtagttttttagaataattctacagaaagggatccacatgacattactgaagaaagaaatgcaaaaaagcgctgtagtcaaaagataaaagaaatttttgaaagcgagacaactcagccgcagccagacaatttgcgctacccaattaacgagtatattagtactaatgagtttgcgcatgaagatattatactcgagctgccaattagtggtatgttaattagttttattacattttgaagacagtttttgtttcagaattcacaatggaatacatcagggaatatggtttggttcgaccgctgttgttcaaagaacaaccagagaatttgggaatgaggtcttaattagatttttggaaaaaaaaacaataactaataattactcattaagaatgccgaatccaaatgagtttagcgttcgggatgttcaaggtgcttctcattttttgtttctgtatttattagagccctgacgggatcggttcctgccgcgattttctcggattccgacccaacttttggaaaaatagcgggataaagatctcgagaaaatcgggaatttggatcaaagtctcgtgattcaataccgacaaatctgatatttcaatcccggtattattccgaactgattacattcccaaatcccgattttttgataaaagggcaccatctaaatatcgacaaatttggcttagacttttttgtttgggacttaaa

SEQ ID NO: 41981 - DNA, 124 bp, Heterodera glycines
tccgccgacgatgacgatacgttccgaggtggctggcgtcgagttgggcatcatggctcccagtatagaggcgcgggcccccggacgggcaagcctgcgccggggttcagtgcatcacgaagcg

SEQ ID NO: 41982 - DNA, 887 bp, Heterodera glycines
  misc_feature (809)..(809): n is a, c, g, or t
  misc_feature (831)..(831): n is a, c, g, or t
aaactcactcggcagtgcttgcgtacctttaaatttttgtgctgctgctactgttgctgccgtgccgctgttcaacgttgctgccaaattttgctgccgccggcatttccacggaggatgatgccgttgtgccagcctctgaacttgttgagcatcgtcgttgatgatgaggatggatgttgaaccaattgttattgtggtgatgataattatgatgttgccgttgcaacaaaagtgccggctgaagctgttcatgatgggcggcataggacgatgatgatggcaccagagcagtagcatttgccgaagtacaattgttgaagaatggaggagagcctggtttatatttatcagagcaattaatgatgatgctcgagagttagtcttgacattcagatcctaaactaatttgtcccaagaaaactaagaactgatccaagacgaagaattggtcccaagactctaagaattggtccaaagactctaataactgatccaagacgaagaattggtcccaagactctaagaattggtcccaagactctaagaatttgtccaaagactctaagaattggtccaaagactctaagaattggtcccaagactctaagaattggtcccaagactctaagaattggtccaaagactctaagaattggtcccaagactctaagaattggtcccaagactctaagaattggtccaaagactctaagaattggtcccaagactctaagaattggtccaaagactctaagaattggtcccaagactctaagaattggtccaaagactctaagaattggtcncaagactctaagaattggtccncagactagagtctcatacttgaccccaaaaaaaaactcgagactttccttggaccg

SEQ ID NO: 41983 - DNA, 1575 bp, Heterodera glycines
ctttgcgcagtacaaagacagcggcccaattcgtttgaaggactgctaccatggaggacgtgtgggtccacaacgactacactacgaggtgccggaggggtggcggatgaaatattacgacgttcgttcactctacccccacacgaatgctgtgacagcataccccgtgggtcacccaacacgagtgaacatcattggtgaggcagagcaggcggttgactggcgacgcgccgaccaggtgccggtccgaggcattctaaaagtgttcgttgtgccgccccatcacgttgatgtgcctgtactgcccgtgaaatttgatcagcggcttcttttcccgctgtgccgtacgtgcgctctgcaacatccgcatggagccgtcaatgaggactacgagtgcacgcatcgcgaggatgatgagcgggggtgggtgtccactgtgacgtcaatcgagttggaggaggcgcttcgcaacgggtaccggtgtacggcctactatcgctccgtcgagtgggacgatacgcggtggagcgaccgcgtttttcgaggctacgttgcagaattcatggccatgaaaacacatgccagcggcttcccggatgaaattggcacaaccgaggaagatcagcagcaattcatagaggaatgtgaggacaaattcggaatccgaatcgagcgggaaaagatggtgcacaacaaggccaagcggaccatcgcaaaactgtgcaacaactccctgtgggggcgcttctctttgcgcaatgggttgtccaaaatgattgtgaccgactcgcccgcggaactgcgcgctctgcttgacaacccagcggtggaggtcagctccgttgaccagctcaccgacgaatgcgttctggtcacctatgcggccggaaacgaatgggttgaggaacacgagtgctcaaacattgtgctctctctttggacaacatcagtcgcgcgcctccacttgttgcggctaatgcagacggttgtgcgcgcaccaaactcggtgctcatctacaccgacacggacagtgtgtgtttcgctaatcgtgaggcggacgggtgccctctggagacgggacctcacctaggcgacctttcggatgaatggccggaccatgaactcgtggaatttgtttccggcgggtgcaaacagtacgccctgcggatgcggcaccaccaaagcggggaggagaaaacagtgctcaaagtacggggcataacactgagcgccgatgcctgtcagcttctccactttgacacattcaagaggagtgtcctacactacgcaatgtgcccaatgtgccattcaaatgatgatgatgatgatgatgatgatgatgatgatgatgatgatgatgatgatgatgatgatgatgatgatgatgatgatgatgatgatgacgaagacatttgttcaattttgattgagtaccccaattttctgaggccccaacattaaggacggggctgttatttctgttaagctgtcgaaacgctatcgtcctatttgaaactaaagggggttgggggggatgaaatgctattgtacatgattttggtttttttaaagga

SEQ ID NO: 41984 - DNA, 979 bp, Heterodera glycines
  misc_feature (19)..(19): n is a, c, g, or t
  misc_feature (31)..(31): n is a, c, g, or t
  misc_feature (127)..(127): n is a, c, g, or t
ttaaaaactttactttagnaaacaaatatanaattatgccatctcggagacatggatgagcaataagttagataattcgtttatagtccaaaattttccttacacaattgtacgtaatgatagaaanaaccaaaaagatggaggcgtagcctttatcatttctaatcagataccttttgaaattatcaaaataccaaaacacaaaaattctgaaataatttgcatagatattctttctccgttttccgaccaaaaatttcgcttaattttgtttataggccagtaacacaagaaaaatatgaagactttttagaacttttagaagtattatcacttttaattgaacaatcaaacaattgtcttctttttggcgattttaactttcctagtctaaaatggcattttgatgtctccaaaaatctgaccgaaaaatctttagaaaaaattttatcattctttcatggttttagccttcatcaattagttatctcaccgacaagaggggaaaattttcttgatcttctatttacaaataataaacaattaatatcaaatgtgcttgttggccctccctttaacattgtgatcataacagtatttcatgtgaaattaagctaaaaatttctaagaaaattctaaaaaaggtttcgattttcgtagagctaattaatttcacgcaatattttcgtaaattcattcgtttccccataaatttcatacatttttccccataaagttttcttcatcccttttctttttccactaatgttaaaattcaaaactattctgcatttattaatggtacggaaaatagcatttattttgatcagaatttttgaagaaaaaacactgaagaaaagttcaacctcgaaattacattgttatttgaaaattttaaaattattattaatattcaataaaaaaaattaaatttaaatatttttattgacactgagactattttcggttcgacctagca

SEQ ID NO: 41985 - DNA, 1414 bp, Heterodera glycines
gtctctcaggaatacatatggggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccttatattctgctgcgttaccgagtacaccataatgtactgtttgcatatggtaacaaagcaaatattaaatatgcactcaagtacccattcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtccctgagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacaacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactccggcacagcataaagtagcagagcttgaagccctagccgacattgattggcggctgcacagctgctttaacttaagctgtgtgcattttagcctgccagacccgccaacttcaattgccaaaaatacttgacgcggcaattgaagagttttttcttggcgatgatgatttgaatttgcctccagggcaccaaatcctcgtccacagccaaatacccctcccccacttaacaccgaccaacaaaaaggcctttgaagctgtttt

SEQ ID NO: 41986 - DNA, 1039 bp, Heterodera glycines
  misc_feature (44)..(44): n is a, c, g, or t
  misc_feature (1035)..(1035): n is a, c, g, or t
ttttctatctcgtacccccgatgttaatcgttccggagagctcnttcaaaattttttccataccctaagagctgcagaaatgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcagaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttataggacaattttctatctcgtaaccccgantgct

SEQ ID NO: 41987 - DNA, 1235 bp, Heterodera glycines
ttttttctccgagggacaactgagtcccagcggctcgaaaactgactttgccgtcagtctcagtgttacgaaattttttgcttttgctttcagagcttagcggaccccaaaagcgaaatgccttaactatggcctacaactttgccagcaaaaaatttttgatcagatcaaaggcctgacctgtaggttaggcaacgtaagaatcactttttttggacacttcagtaccaggcgaatagctcgtaagggtttgctcggagcagggggtcgccagcggacttattgtagagctcaatgagctcgatttttccaaattttaaaatttcgaaaattttcaaaatttttcgagttaggcctaaaattcggtttttcggtttttgaattttatgattttttaacgatttttccagggaaaacgaagaccacttccaaaacatcgttttttgagctctatcgattagtgatgtttttagaaaattttcgattttttccaggaaatagaaaaattttttggcctaagcgggacatttgagtcccgggcccataactcgtcgggggttggttttagcgaaaaattgcctaagagcaaaattgtagagctttttaagctctatcgaacggtgggatatatgcccggaaaatttcaaaaattttcgagctaggccacctagaaattttcggaaatttttttttggttgaaaatgggggtgaaaatttttttcctgggttattttgaggtgctgagcacgaatatgatgtttgttttacgtttcagaatttttggaattttttaaaaattctttattttttggcaattttttggccctcgggattttggcctaatatttgaaaattcatatctggcctaaggtttgaccaattttgattaaataaagcattaaaaatggagaaaaatcaggagaattttatgggttttatttagattctctatcatgaatctaaaaaaagttattccggaagttctggaaaaattcgaattttcagaaaaaaattctgaactcggttctgaaagatgtattggaaaagtaaaataatacaaaaatccgcaattttttgctctattttataaattttattttagctttttatcacttttttgaaaaaagttatagaaataaaagtgattttgggaatcgggaccaaaggggtgagtgtaggatttttgagtgaaaaaattttttcatcaaagaccttcaaaaaacatgtctttaggg

SEQ ID NO: 41988 - DNA, 1292 bp, Heterodera glycines
  misc_feature (359)..(359): n is a, c, g, or t
cgggagccatcattgacttcgaggcgggctggcggtctgtctcaaaggatgggccggtcggacatttttcacgtcgaattcggcttagaccgctggggaccttgtgccaatgccgaagcggtcccagcacaatcagaaggaaattgtccaagtaagacttaatcatttgttaattaaatgttaattgggatttcttgcactgccgcgaacccaaattcgcgcattggttatggaaaattattttatgagaaaacgcaggaaaacaaaaaaagaaggcagggatggtcacaggacttcgcccggggtgggtgtcccgtgccgcccggacgaccacttattttggttgcaccccccccccnccctgaaactcaaaaaagtaaacaattttcagcaaattttttgcaatttttttaacaaattgaattaaaattctcaaataagtttccgggcggcgcctaacggcaccgctgtacccccatttaccatatttttgaaaaatggagaccaaaatggcaaaaatagtaattttctggcgaaaaacggctaaaaaatttgtaaaagcttatcaccctctgaaccgctgcttcagcttcgctaataattgatttgtaatcgtaaagttagtctttttttaacttaccactcccaatcatctgctgataaagcaaataaaaattatgggaaaactcaaaatagaaacgtcattttgtatcgatgtttcaatgtttacggaaatattacccaccaatcaatcatcaatatcaaaaaaaaaagacaatttcatttaaatgttcctctccaattttttctgaatattaattaatttaattatccttaattgatttgaattttcttcggtttttctttcggtgaatatttgataaattttaaattttattagttttggcgtaatgccatttcaaaataaaaagaagacgccgcttccttttttgtctcgctacggcatagcaattggaatgtggtggatttgcttttattttatgtgtgttttatgtgccttttttgtttgtcgagccttttccgtttgccctattggttttcttccgttgcatgagaatggcactggaggagagaaatggcagcataaatttttgagtgacagcatcatcaagttttgtggatgatgccagcattttttaaacagacgaaaagctaaatttccgaatgaattattttttctaaaaatattttttatttttcacaaaaaaaccgaataaattctctaattaaaaacgttaaattttagtggcgccaaaatttgaaaatttata

SEQ ID NO: 41989 - DNA, 836 bp, Heterodera glycines
  misc_feature (791)..(791): n is a, c, g, or t
aaatcacgccgctagaaatttttaaaaatttctagcggcgtgatttcggccggcgtgattttggggtgcacccatggtttaacttgtttttagttaagtttaggccgtttcaatttcagaaaaatggattcgcatagattttatttgattcactttggtggggggctttaagaattttcgacagcaaaggacattttgataaacaagatttttccggcggtgagaccaaaaagtacgaaaagcaacaaaaaaaagtggtcgtccgggcgggacgggacacccaccccgggcgaaatcctgtgaccatccctgccttctttttttgttttcctgcttttctcataaaataattttccataaccaatgttcaattttgggtttgcggcagttcaagaaatcccaattaatatttaattaacaaatgattaagttttacttggacaatttccttctgtttgtgcacgtctcccttcggcattggcacaaattcgtcagcgtctaagtcgaattcgttggcgaaaatgtccgaccggcccatccttttgacagtccccgagcccgcctcgatgtaaatgatgtctcccggtgtcactttttgcttcagcagtgagtcgtaaatggtcggatccaaacgtaattcgcgcgacccttttgtcgttttcagaacgcaattaacatgcgaaatcgtcttcccaaagcctccgatcggatggtcggcctccaccggcgccaaatcgaccacttcgccctcaacacttccttcacttctttgatgcgtacacctaagaggngacgggggagggtaaacaaaatcgtcttcaaaccagggtttttcc

SEQ ID NO: 41990 - DNA, 946 bp, Heterodera glycines
ttcggtattattccgtaaattcctttaaaatgtttttcgttggtcttccattttattttggcaaatttcccaaccctccccctcccgctatcccccacatttccttttccttccgcttcacaaacatcgggcggcgctgctcgtccgtccatgtgatctccgccgctgtcctctcctcgcccatttcgtcccgtccatttttatcaaaatcatgaaacgatccactgattattttcatttattccccactcaccgccatcccatgaatccccccaatttcgcctcttcaatcacattttcacttcccctccccccactgttttccacacaattttccacactctgtgggcactgcgccaaaagccaattattccatcagagcgccgccaccaccgccgccaccgcgctcatcgggcggtcggcgcggccaccgttttaccaccaccaccaccaacagcagtaagcagcagcagcacatcgtcgcgtcgtcgtcatttcccatttcgccacacatgccacccgtcgacccatccccaaattttattattttacgctaaatgtggccacaaaacctggggaggggaaggggagaccccgcggggacgggagacccctggggccagcggagagcacaaaaacaccgcggcgggtgggcggatgagtacgaaacgaagatggacgggcactactgctatggtgatgagtgtgtttgtgtgatgtgctaatccagtttaattattttgccacccaaaaatgcgagggtctgccgcttttgatgtttgctgctgccggtgaaaaaactcattagagtcaaaaacccaattaattaattcattaattaattgatcacccatcccaatcagctgttgtgtgaatgaaagcctttcgacccccccccccccatttactcagttagcccccatcctcaaaaagcaaccccaattag

SEQ ID NO: 41991 - DNA, 1254 bp, Heterodera glycines
ttttccgccacctcctggcaaaaattgggtgtacccttctgtcgaaaacatccacggaatggattttcatgcttaagaataggggcagttattccgaaggcatcaaaacccaaactcttcccaatcggtccagtaaaagcgctcctccgctccattcactgtcagcccaaagggatactcaagcggggcgtaaatctgaaaatgccttttcttcggttggctttcgccatttatctccgttcttttgaaacggtcagaaattgtggcaaaattttaattccgatgccaaaatgggggagggggtcatacatagcttatgagtgatgattgattgattgactgaccactcttcgccccgttccgtccagcccaatgcatgacaattgctgaatgcccgcgtcaacccaacaaagccatctccgctgctgcagcagaaccattccgttgggcaagtgcacgtcgtccgaaatgaaaactgaaaagtccgtcgttgtccaacgattgtttgggagtgtctctccgaaccgactttcatttgcacttccatccaacgaaactctgccaattttgggcccttctcgggaccaatcggagtaatacaaatgccgactttccaagtcgattaccaatgccctgttggaattcaaatcaaatgccaacgaatggggggaggggagagaatgaatgcctcggattgttcagtccctccgtcagcaaagccttctgaaagcgtccgtcgatgctcaacactcccaattcgtttttgatgctgtccacatagtaaatgttgcgcgaaggccaatcaatggcaatccctgcgcaaatttctcttttatgtgaaaataaacacggcaaaaaccctcggggcttcggagcacttcggaaaagttggaactgagcccagtgccattgagaaaagcagaacgaatggaatgtccggaaatatcactccaaaagaaacgttctgaatttgttccgtgagaaaagggaaaagcggacaaatggtcacccgaatgacaatcgaattcgatgtccaccacaatttgatggggtaaaacaaccaactgcacagaaaagcaaaggatgacggatagaaatgccatttcagctgcccgacctgcttgccgttcacgttgggttccgcgttccgctgaatgatggccatcccccgcccgattagcaaactttcggtgccgtcccctcgcgcgtttggtgccattgctaaagggcagcgatttgttgggcttttgctgc

SEQ ID NO: 41992 - DNA, 839 bp, Heterodera glycines
taagttaaagaaatgcttaatttaaaaataaaaaaatcaattattcactttgtgcaatggcttaaatatattttaaatttaatccctccttttgtctacccgctttttctccttaattaaatgaccactttttggtttcattttcaacatgtgaaaaccaaaaacatccattctcactttttggctctgattacttttttatcgtttagtttaaggtgagcgagagattttgtacgcatttgtagccacttttgcctttaattattaaaaattaatctcttcggcggctgtaccccaatttaattaattatatattctaatttttgtcctcctcacttttatcgaaacgaatgcctcctcttcttcaataaatatgctgaaatttagaatagcacgtattgccccggaagctctcacacggctacaataattgcttactttaataatcttagtctggtgagtgaacgaggcggaaaaaaagttcgaacttggttttggacattttaaatcgcataaaaagccttaaatgtgttttaggaggtgattttattcacgaaataaaatttcattttcccaagtccatattttaaataagcatttcttattttcaaatccttttcacaacaaattaattccccggcttccattcagcaccatcgtattttttcttagtgttcgtaagactcaaaacccctttcaaagcccgcgaatgggcagccaaagcccgcgaatggtcagccagaggcccgcgaatgagcagtcagagaccgcgaatggcccgccaaaagcccgcgaatggacagccaaagcccgcgactggacagccagagcctgcgaat

SEQ ID NO: 41993 - DNA, 1190 bp, Heterodera glycines
  misc_feature (1108)..(1108): n is a, c, g, or t
tacctcaccggtgggacttctctgctccggggactggctgaacgtttagaacatgagcttgtccaactcgcgccggcttcagttctcgttcaggtgcaaattttttttttaaattaagcttttatcgttgttgtatcatttaattaaattgctcaatgaaagtgatttattgttttttttcctttaattattttttttattaatctttttttatttctttgaattttttattttttttaataattttttacttttatttttttattttctaatttaattttttatgattgattttttttttgttgatttttatttatttatttttttgtagtaagttaatgacatttctgcgatttttctttaataaaaaacaaaaaaaaaaattgctaaatcgatgttacaaattatttaatcgaaataatttggcacatttgaaatgcatgatcccataatttaagtgtaatttattgtataattaataaatctttgctttataggtgcttagcagtccatggcgtcgccactccatctttttgggcagtcacgcaattgcagcgagcgaagaatttgaaaaatgctgtgtaaatgggatgaatttggcggaatatttaagcaggattgacggagaatgaatgaatgaatgagctgctgatgaaccatatgaaacaaatttttggggtttttaactttttttttcatttttaaatgcaaataaattaattatttggaaatgttcaacctttttataaacaaatttaaataaatcaaatttcttgtctaatttttatttaatataggaatacatgcttttattggtgttgggtcgttactacaaaactacccaaaatgggcattactcaaaaaagcacaaatggaaattttgacaaaacgcttaatccttatggcataagtagccaaataaattaatcattgattgctatgatctaattttttatagtacaaagttttaaaaatggtatgttttaattaattaacttattttgggctttcccgcacccatttaagtggtgcaaccctttgatgttgccacccagggatatgttccagcacgtgccaggtgatttcgacaatgatagatctcgacagnggattgatttcgacattgtggactcgacaaagagtgatttcgacagcaccgataaatttttaaaaacacgagtgtataaaaa

SEQ ID NO: 41994 - DNA, 1709 bp, Heterodera glycines
  misc_feature (44)..(44): n is a, c, g, or t
  misc_feature (51)..(52): n is a, c, g, or t
  misc_feature (54)..(54): n is a, c, g, or t
  misc_feature (86)..(90): n is a, c, g, or t
  misc_feature (92)..(93): n is a, c, g, or t
  misc_feature (97)..(97): n is a, c, g, or t
  misc_feature (101)..(105): n is a, c, g, or t
  misc_feature (107)..(107): n is a, c, g, or t
  misc_feature (113)..(113): n is a, c, g, or t
  misc_feature (122)..(122): n is a, c, g, or t
  misc_feature (124)..(124): n is a, c, g, or t
  misc_feature (126)..(127): n is a, c, g, or t
  misc_feature (142)..(142): n is a, c, g, or t
  misc_feature (145)..(145): n is a, c, g, or t
  misc_feature (155)..(156): n is a, c, g, or t
  misc_feature (163)..(163): n is a, c, g, or t
  misc_feature (166)..(166): n is a, c, g, or t
  misc_feature (171)..(172): n is a, c, g, or t
  misc_feature (174)..(175): n is a, c, g, or t
  misc_feature (186)..(186): n is a, c, g, or t
  misc_feature (192)..(193): n is a, c, g, or t
  misc_feature (196)..(200): n is a, c, g, or t
  misc_feature (204)..(206): n is a, c, g, or t
  misc_feature (212)..(212): n is a, c, g, or t
  misc_feature (214)..(217): n is a, c, g, or t
  misc_feature (231)..(234): n is a, c, g, or t
  misc_feature (236)..(236): n is a, c, g, or t
  misc_feature (242)..(245): n is a, c, g, or t
  misc_feature (250)..(251): n is a, c, g, or t
  misc_feature (253)..(253): n is a, c, g, or t
  misc_feature (260)..(261): n is a, c, g, or t
  misc_feature (264)..(265): n is a, c, g, or t
  misc_feature (277)..(280): n is a, c, g, or t
  misc_feature (282)..(282): n is a, c, g, or t
  misc_feature (289)..(289): n is a, c, g, or t
  misc_feature (293)..(293): n is a, c, g, or t
  misc_feature (301)..(301): n is a, c, g, or t
  misc_feature (309)..(309): n is a, c, g, or t
  misc_feature (315)..(315): n is a, c, g, or t
  misc_feature (317)..(317): n is a, c, g, or t
  misc_feature (326)..(326): n is a, c, g, or t
  misc_feature (330)..(331): n is a, c, g, or t
  misc_feature (337)..(338): n is a, c, g, or t
  misc_feature (343)..(343): n is a, c, g, or t
  misc_feature (353)..(354): n is a, c, g, or t
  misc_feature (356)..(356): n is a, c, g, or t
  misc_feature (363)..(366): n is a, c, g, or t
  misc_feature (375)..(380): n is a, c, g, or t
  misc_feature (382)..(382): n is a, c, g, or t
  misc_feature (388)..(388): n is a, c, g, or t
  misc_feature (394)..(394): n is a, c, g, or t
  misc_feature (397)..(402): n is a, c, g, or t
  misc_feature (405)..(406): n is a, c, g, or t
  misc_feature (408)..(413): n is a, c, g, or t
  misc_feature (416)..(417): n is a, c, g, or t
  misc_feature (420)..(421): n is a, c, g, or t
  misc_feature (426)..(429): n is a, c, g, or t
  misc_feature (434)..(436): n is a, c, g, or t
  misc_feature (438)..(438): n is a, c, g, or t
  misc_feature (441)..(443): n is a, c, g, or t
  misc_feature (445)..(449): n is a, c, g, or t
  misc_feature (451)..(453): n is a, c, g, or t
  misc_feature (455)..(457): n is a, c, g, or t
  misc_feature (463)..(464): n is a, c, g, or t
  misc_feature (466)..(468): n is a, c, g, or t
  misc_feature (472)..(472): n is a, c, g, or t
  misc_feature (474)..(474): n is a, c, g, or t
  misc_feature (476)..(480): n is a, c, g, or t
  misc_feature (482)..(484): n is a, c, g, or t
  misc_feature (486)..(488): n is a, c, g, or t
  misc_feature (492)..(494): n is a, c, g, or t
  misc_feature (496)..(499): n is a, c, g, or t
  misc_feature (502)..(503): n is a, c, g, or t
  misc_feature (506)..(508): n is a, c, g, or t
  misc_feature (515)..(518): n is a, c, g, or t
  misc_feature (522)..(523): n is a, c, g, or t
  misc_feature (525)..(528): n is a, c, g, or t
  misc_feature (532)..(539): n is a, c, g, or t
  misc_feature (541)..(548): n is a, c, g, or t
  misc_feature (554)..(557): n is a, c, g, or t
  misc_feature (561)..(563): n is a, c, g, or t
  misc_feature (566)..(567): n is a, c, g, or t
  misc_feature (569)..(572): n is a, c, g, or t
  misc_feature (574)..(575): n is a, c, g, or t
  misc_feature (577)..(577): n is a, c, g, or t
  misc_feature (580)..(583): n is a, c, g, or t
  misc_feature (585)..(585): n is a, c, g, or t
  misc_feature (592)..(594): n is a, c, g, or t
  misc_feature (599)..(600): n is a, c, g, or t
  misc_feature (603)..(604): n is a, c, g, or t
  misc_feature (606)..(606): n is a, c, g, or t
  misc_feature (609)..(609): n is a, c, g, or t
  misc_feature (613)..(613): n is a, c, g, or t
  misc_feature (615)..(615): n is a, c, g, or t
  misc_feature (1663)..(1663): n is a, c, g, or t
cgcctggggcggcggctgagggtcctcattaaaagggcccaacngggaganncnggacccaaaaagagcccttgagaaacccgaannnnngnnccgnaaannnnngnagagcncgaaaggcncnanncaaggggcccactcnggncccaaaccanncaaaccncanaaagnnannaagcaaaaagngaaaannagnnnnngaannnaggggngnnnncaaaaaaccgcgannnncngaaaannnncggcnngncgccaannagnncacacggaccannnngnagagaancaanagggcttncgaagggnaccggngncaaacggancggnnagaaanncgctngctgccaaanngngcaagcnnnngcccaggcnnnnnnangggggnaaccgngannnnnnaannannnnnnaanngcnnaaaannnnagaannnanaannnannnnnannngnnncccacnnannngggncngnnnnnannnannnaaannnannnnaannaannnaactggnnnnaaannannnnaaannnnnnnnannnnnnnnaccaannnnccannnaannannnnanncngcnnnncnaacacannncaaannaanncngancatncnggatcacaacagaaaatattatcagaatagttctggtgcgtaccagaattagcagaagtatttggtgcgtaccagaattgtcagaaatatttggtgtgtaccagaattagcagaagtatttggtgcgtaccagaattgtcagaaatatttggtgtgtaccagaattattctgacgcgttccggatttaccagaatcattctggtgtgtaccagaattattctgacgcgttccggatttatcagaattattctggtgtgtaccagaattaagcacaccagaataattctgacttgttccggaattatcagaattattctgaagcacaccagaataattctgacgcgttccggaatttacagaatgtagaaaaatgcgtagaattttataatatttaaaaaaattgtctttaaaatttccggacttattctggtttggactactaatttttcaaaaactttacaattcataattaccgaaattaacaattttacagaatggatattggattaaatgggctttgaaaattttttattgtgttaatttaggttcttagcacgaataagatggttgcttttctttcttataatttttagtttttttaaaaaatctttaatatttttcaattttttggcctcaggatttgggactaatatttgaaaagtcacaactcaattgaaaattattcaaatgaaaaattaatgtaaataaatattttacttaaacatgcaatccacattctgataaattcacacaatggaccaaaggctgccaaaactgtaaaaaaaataattaattttaaatctgatgaaaaaatctggaaatttttacagtaagcatagtcggctccagattcacgaataactgaaaaatcatttttcggtgtacattatttataaaatgccaagacatttttctcacgttccaagctcggcataactctaaattccaatcgattggagacggcggttgtgccaacgaatatgtacaaattttgccaaagcattggcacactgtgcattcaaagcgaaacaatctggatggggaggnggtaattaagtttgctttgatattaaaaatgcaaatatttatttgc

SEQ ID NO: 41995 - DNA, 946 bp, Heterodera glycines
aatcattacaattgtacaatatttatggaggaatttctttaaaaacccttattttctttgatcttgtttcaaatcaagcacatatgttttacctgtttttttcgttttaaattaaattttaagttcttagcatgattcccggtttggattgtttaaaaaaccaaaaacatgacatagcatccccattaattatgcatgaaaatgagggataaattttaggttttaactattttttttgctcaattgttttgaagaaaggagctcaaaaaacgcatttctgcgttaaaattttttcatttggacgtcactagaaatcactattttggcgacttcgtcactaaaatagttaaaaatcactattttggcgttttgtcactgttttttcactatttcgacattttttggaaaattctttaacaaaaatgcaataaaaccaaaaaatacacccctaagaatcgacctaaaaaaattcaaaaaaatacacccctaagaatcgacaaaaaaaatttcaaaaagcgctcctaagaaatgaaaaaaaatttctcaaaaaggtattttcgtggtcactattcgtcactatttcggactttttgacactattttggcatttttactcactattttagttaactatttcgggatttttcttcactaaaattcacgtccctaatcattacaattgtacaatatttatcgaggaatttatttctttaaaaaaccttaatttctttgatcttgtttcaaatcaagcacatatgttttacctgtttttttcgctttaaattttaagtgcttagcatgattcccggtttggattgtttaaaaaaccaaaaaacatgacatagcatccccattaattatgcatgaaaatgagggataaagaaagcaataaaaatttttcaaaatgaagagaagaaaccaaatgcaaaagggaccaaataaattc

SEQ ID NO: 41996 - DNA, 983 bp, Heterodera glycines
tgtaaaaaacttgtgtaaggaattattttttgaagtgagtaaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctttaaatctgcaagaaattaaattggcaataagtggttgtaaaaaacttttgggtaaggaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctttaaatctgcaagaaattaaattggcaataagtggttgtaaaaaactgttgggtaatgaattattttttgaagtgagtcaaacaccctattagtgctttgctgtgccgagaaccggcaggcaatggatggctttcaatctgcaagaaattatattggcaataagtggttgtaaaaaacttttgggtaatgaattattttttgaagtgagtcaaacaccctattagtgctttgctgtgccgaaaacccgcaggccatggatggctttaaatctgcaagaattagattggcattaatggttgtaaaaacttttgtgtaaggaatattttttgaagtgaatcaacaccctattatttgcttgct

SEQ ID NO: 41997 - DNA, 874 bp, Heterodera glycines
ctaaaaggaactgaagtcatgggacactcttttggtcattaatgagttgagtgacgttttttcatttacttttttggccttttaactgccaagaagcctctagttttgtgtccacctatttattttaaattcccttacatttcgctgtttttagaattttctaaaaattggattttccgcggcgatgggattcaaccgggctacgaaacaaccaaaatttcaacagtaataatactaacaataaaaactttggtacttctgtgttttggggtcgcacgtcaaaaattaaaaaatcaacaaaaatgcgcacaaattcacagagtacgaacagcattagtttgggtacaaaatgcaaaattattgctaaaatctggtcaagtggatcagtttggggatataattgagtgaatttgcacgtttttgttgatttttaaaaatttttgtatgcgaccccaaaacaagaaagtaccaaatgttttggtgcttcggaggatgggccatcgtccgtctaatacagacaggagccaatggaaaagctcggaaattcaataagtagataaaaggaagtccaaaataaatgtatccaattcatcaaattaaatcagtttaattgtcaccgtctttattcatcgaaaaaagtaaaataataacaaacaatcaaaaacgacaaagggagaggagaaccgttataagctattgcatcactgtgttatgagtggggcgggcgtgtgccgttcacctaagaaggacaaatgggtggcaaatggcactggtgtgggatggggggggggacgtagcccaattgatgcctcattttcaaaaataaaatattcagaaaaatttaattcgaattatttatgctacgtcccgacct

SEQ ID NO: 41998 - DNA, 711 bp, Heterodera glycines
agcattaaaattttcttttattgaattatagaaattttctttccgttttcaatgtacaagagaaatttttgaaaaaaaagtttcgatctcgagaaatgtcttgggttttgggtcacgagtctcggggtcaagtctcgggaattttcggtctcgagcatcactgctaattactcgcggtccaccactcactaatagccccggagcaattaagatgtttgttctgaacacgttgccgaaggcgtcgtcgactacagcagaggagtccagctcctcctcctctcccattccggcacaaccgtccatcttggtgttgtgcaaacgtgctttgcactgtgtgacgcatgggggcaatccgcgcttcacaattcgattccaaacagtcgcactttgtctgacagttctcagccattgtaataatgtcaaaaaatggttattttattggcactgtgccaagataatgcgcaccaagataaattaattataaattctgtgccagtgtttggcacggtgccaaggaaatgggtacctggtgccaatgtttggcaccgtgccacgaaaatgggtacaaagtgccaatgtttggcaccgtgccaacaaaatgggcaccaagacaaattaatcaaattttgttccgaaaatgtctttccagggaaggacgcgcacattccattgtgcatagggaccgcgacaaaaacggtgcttttctactcg

SEQ ID NO: 41999 - DNA, 903 bp, Heterodera glycines
tcataatcctcacaatcagccaatgctgtggaagtggtggtggtgacgattcgaagaaaaagaaaaaggcaagtttttgaccaccgccccccccccccccataattagcggctctattgcagttcacacggccctaaaaaaataaataatttggcaattttaatggaccataactttccctataaacaactaattaaaacattcttggtatcattcgatagtccaaagagtcctctattatcctgcaaaattaaaaaaaaaaaatttatttcattgcaaagaagttatggccagaaagcttcaaaaaactgtttttctaacatttttgacaacttttttgaaacaaaacaaatttttttgaaattttgcagactaatagaggtctcattgggctatcaaatgataccaagaatgttgaaaactgcaatagtagagcccaattagcagacgacataacaaccaatttacaactgatcactttttcagaaaaagaccgaagcgccgccgctttcgccacccaaatcgacgcaaggaaaagcggaagagcctccgtcagatgttttttcttcaggtgggaaatggattgagaggagaaattgcgtcatttgttgtgtggtgcccccgaaatttccaattttttcagacaacaacatggactatggaacattgaaggattttgaccccaaccgatttggagcaccgccactgaaaacgcagcaaaacatggaaaagaatggtgaaaacgaacatgaacaatttcggggatgagaaaattgtgatcactgatcagtcatttattttgcaaattttttagcaccgccgctcaaagtgccagagaaacgtgccaccgcaaaaaaaggcaggataaaaatggatcaattggaaatttgaatatttttaatt

SEQ ID NO: 42000 - DNA, 971 bp, Heterodera glycines
tgactaattggaagttataaaaagccaaatcaccgcactctatttgtcgatgcattggtaatgatacgtatgaccacatcttagagctgaaacatcgtttaagtcaaagcttaaagtgcaaatgctacaccgtccgagattcataataagaaaattattttagttaatgctgataaatttagttttgtgtttttgtatatgaactaatggaaaagggtaaaagcaaaggaagggaaaacgaattcagctgattaggcacatcataaataggcaattacatatatgcgttaatctaataattaattgttaaaaaaaataaataattttaatgaataaaaaaattaggtaatttaaaaaatttaaataaaaattattcgccaaagatcactttgacaaaagtcattttacaaattttaattaaatttaaaaaagcacttcgcttatttatgtttttacctgtattaatggatgtccatgacgaggaagttgaaattattgggactaggtcaaatgagaggcaaatggaccgggctcatcgacaagaacaacagcaggaaaaattttactcccaacaacaaatgtctgaggaaagtgaagaagcattgttttgcatttctaagcatgacgttaaagaaataagccaagtggtcaaagcaatggcattccgagacgtgagaagcaatggcaaaaccatggcagaaaacattccgttttagcattgcacattaaatgtaagcaatgagggcattcgcttggcagttgacgaccaacacaatcagcaaggcagtgcctacttcagatccgagcacttccaagacttcaactttcgtacccaaacatgcagcattaaaataccgatgaggcctcttatggtaaatttatcaaaaatgtacacttttggattcttggcaaatttgaacattataggaagcactgaatatgttttcccgtacgatgacaatggtgcaaat

SEQ ID NO: 42001 - DNA, 756 bp, Heterodera glycines
tgttgttagaaattttaaatgagtgtattccaataaagcgtttaaccaagaatgatttgactcctaaatacccacaacatttattagcatccatcaaagaaaaggctaaattattcaggcaagctaaaacttccaaaaaagcactatacgatagcatttctttacatataaaaatacaaacaaataaataccatagccaaattgagaaaaaggctatttcaaagggaagaaattcaatttataaatatatacaaaattcaatgtcaatccctttgaaatacctaatctaatttatgaaaataaatgctatcataacagtgctgagaaatctgaattatttgccaccttatttgccaattcatttaataatagtgaaaccgactcaagcaatccatgcttgggtaatattatagaaattgatcaatgctttataccggatataaattttaacatcatcgagacccaaaatcttctgaaaaaacttccgaataaaaatggcacttctcccgacaatattagctataaaattttaaaaatttgccattcgtccctgtcaactgttattactgacttgtttaggatctcattagacactggttcacttccagacatctggaaagaatcaattgtttttccgctttttaaaaagggtgacaaaaataatcccgaaaactataggccaatttcattaacctgctcactttgcagggtaatggaaagaattttaagcaaaaatatttacaattttctattaaa

SEQ ID NO: 42002 - DNA, 865 bp, Heterodera glycines
agaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctg

SEQ ID NO: 42003 - DNA, 1244 bp, Heterodera glycines
tttatttttatttccaatcttttacaacaaatatatttttataaaattcatttcataatttttttcatttccttcagtttcattcatttttcgtcctttctttccttttctccgctttgttcagtgaattggccatcgccaaaattcgaagaaatgccatccgcagcatcaaaaaaagtgccaaaattgccaaaaatatcgcaccaatggagaacagaatggcatcgattgaataataagcaacccatcccaattcagcatcggttggcaagttaagctcgttcagatgcggaaattccgctgcaaattccacccaacgcaccaattgctcttttgcaccgaagggcgacaaagcgattttctttcggatgagtttggcattggcacgaaaagaggcatcgtggagaacctaagaaaccaattaacattctgttaaaattttaaaactgattattggagattaatgattcttcatcggaattcgaaatgccattcccaattcgttgagaaaattctgattgtccaaaacaaaaaaaagctttagtaaaataaatcctcctaaaaataattaattttctatgcatttgaagtgcttttcatttttgctttctcattcattttgtttggttgtgaaaagtgatcgaatgatccgatcaatcgatggtccacctttgctcacccgactgagcgctgttcccagcactttgcccgttttgtctgtgatcagctggcgaatgtcaacgtggactgccatccctcggtgctttgccaacacggcgttgtaaagctgatcagcgaacagcggaatggccacaattggcacaccgatttttgctgcttcggccagactgttttggccgcaatgagtgacaaaagcgcgcaattttggatgccctcaaaattcgacaaaatttaaggagtgcaataaaagaatggcacacttaaaatggcattttgcggcacccattcgaaagtgtgaacatttggtgttgctttgatcagttccgactcattttctgccgattctccgtccaatttccaaatgaactcaaaatcggggaattggctgaatgtgcggagaagcatccgtcgcaacgattcgcccaaagtgcgcgtgttggctacggtgccgaatgagaagagtacggtaccggaccgcgaattgtccaaaattgagcgaaactcctttaaaaaatgcgtttttcattaagtttcttttatcaatgttaattgtttatcaacct

SEQ ID NO: 42004 - DNA, 1273 bp, Heterodera glycines
  misc_feature (1199)..(1199): n is a, c, g, or t
  misc_feature (1264)..(1264): n is a, c, g, or t
tttctcaaaatttatcccaaaatttatttattttttctattgacaaaatttttaatttaaaatgtcaatattatctaagaaaatattaatatatttaaattttcgtttacaaagagatatgtagaaccaaaattttccctctttgtttgcttttttccactaaaaaatcgttaataaaaatttttatttacctattttggtacctattttggaatttttgtacctatttaatacctattttgagatttttttttacctatttaagtacctattctgggatttttcttacctaaaaatcgcatccttaatcattatcatttatttatgcaaaaaaagaaaaaagtccacaaaagggagtaatccacttactctgcggacgtgtcatagattaaatcgtcctcgagtaatatggattaaaaattaaacaaaaaaagaaatcacaacaaaattaaatataagaatgaggtcaatgattaataaaaccaaatcactatataaaatatataatatctttaattaaagagataattcacttttccggtcattttatacgttaaggagtttaattttagttttaaattgatttaaagaatttattttaatgatttctttatccagctgattccacaattttgtagccctccccgcaaagggaataaattttttgcctaatttatattttgtgttaaacctataaaaggggacattaaagcgttcagaaggtttgaaaatttttaatatatctagatctgttcggccataaacaattttatgcgccatgaacagatcaaatagctttcgccttttctcaagtgttggtagttgcaggtattctaatcgattttggtatggaattggcggaaggctgcatttaaaaaacacccgtttggtgaaatatttttgacacttttcgatttttttaatatttttttgaagagacggattccaaacctccggagcgtattccaataaaggcctaatataagttttatataacgtaatccaaatcttagatgatttggatttaattattcggaacaaggaacgcatacgtaaatacgcattccttgttatttggttaatatgatcggaaaattgtaatttgttatcaatgtttactcctaaatccctaattgtatccacagcatttattgtattcccatcaaatttataagtttcttttgggttttttgaacccnaaataaagtacaaaagttttttgaattgaaacttttatttgcctatttatttgccccattcgaantaaattatg

SEQ ID NO: 42005 - DNA, 786 bp, Heterodera glycines
cgaatggataccaagaatgttgaatttggttggcaaagaaaaaagttatagtccaaaaactccgccccacgcgaaaacggcctggcccggaaaaacaaaaacccactgaattagagccacctttgaaaaaaccccttgaaaaaaagagcgcctctgggggcactaatccaataaatatggtaaatcgtgattcattttttacaacaaaatttgagttggcgaacgcgtataaaaaagggaaaaatcaatgggaggaaggattatcccttcccccctaggacgttctgaggccccacgcaaaaaaaattccaaaaattttcaatgtttgatcccgaggttgccccaacagggaggtccaaagagtaaggaaggaattttgagctgaggtagggggaggggtataacaatgaaaaaattttttgcaaaatttggagaggggttccctacccactagaattgtctctggaccctcaaaaaaatttaaaatttttaaaatttttcataattggttggttgcccatagccgacaattttgttttgttgaccttgacaaatgaagagattggcaaactcttcaggaaataggcgccgtttcggatctgcactttcagtacggagtcgccactgacgcacaattggaggaacaaaatgcctgtgtgagaattaatgaacaaaatcaaaaatttatttttaaataaaactttattaagaaagctgaaatttaaaataaaatccatttttaaattaaaatattttttaatttattaaaaatacaaaattttttct

SEQ ID NO: 42006 - DNA, 806 bp, Heterodera glycines
  misc_feature (420)..(420): n is a, c, g, or t
  misc_feature (422)..(422): n is a, c, g, or t
  misc_feature (528)..(528): n is a, c, g, or t
  misc_feature (565)..(565): n is a, c, g, or t
  misc_feature (569)..(569): n is a, c, g, or t
  misc_feature (677)..(677): n is a, c, g, or t
  misc_feature (703)..(703): n is a, c, g, or t
aaaaaaaaaaaaaaaaaaaaaaatatatttaaaaaaaaaaaaaaaaaaaaaatatgggagcgggcccccaaaaaaaaaaaataaaaaaaaaaaaaaaaaaaaacgcattaaaataaaaaataaaaaaacaaaaaaaaaaaaaaaaatatttttgtgaaagaaaaaaaaaaaaaaaacaaacctctttctttttcttctctttttaataaaaaaaaaaaaaaaaaaaaaaaaaaaaaaagaaaggatggaggggggaaaccacccccctctccttccactctttattaaaaaaaaaaaaaaaaaaaaagaaaaaaaaagaaaaaaggtttttttttttttttatctctctcctcccccccctctcgcgaaaaagaaaaaagaaaaaaaaaaaaagaaaaagagaaaaaaaatatatatttncnttttttttattttaaaataagtgtggagggggcggggggcgggcgccccccccccctcctccccatttttaacattttttattaatttatcattgtgttttaccancccaaaaacaaaaaaaaaaaaaaaaaaacaaaaaaanatanataaaaaaaataaattatatgtatataaataaatataataaaaaaaaaaaaaaaaaataactaagtaagaaagaataaaaaaaataaaaaaaaaaaaaataaaaaaanataaaaaataaaataaaaaaccagancaaacaacaaccacacacacaaccacccacaaaaaaaaaaaaaaaaaaaaaaaaaaaaaaaaaaaaaaaaaaaaaaaaaaaaaaaacccctccccgccccccg

SEQ ID NO: 42007 - DNA, 77 bp, Heterodera glycines
ctctagagtccggttggggcgatttccaattggcacgcattgaccgcacttggagccatgtccaatgaagacgccga

SEQ ID NO: 42008 - DNA, 1119 bp, Heterodera glycines
  misc_feature (901)..(901): n is a, c, g, or t
tggacaaaaaggtacttaattttgtaatcgccacaaatagttccttcaaaatgattgaccatcacacttttcattcattgctcgcaccgcaacaaattaaagtttttgctgttttaaagcctcgcaaatttttaatgtttagggtgagagccattacagaaagcaaattcttcctgcggtgtataagcaagtgcgggagaaaatcaaaaatgaattagaagaatgtgaatggctttcattcacaactgatgcgtggagcgggccaagcaacaattttctatggtaaaaaagctttttgctcgaacgaagaaacatctttctggcaaaaattttatcatggataagggaagaaaatgacgtgttcattagcccaccaattacggaaattgatgagcttgactgtgcgccgccgcctataaaaaaacaaaggccttctctgttcgacgatcttgatgaaatagcgtcatctagcaataaagagaacgaaggcattaaatatttttttttacacataaaagataaattaagtgggagcccatgacatcgaagaagaatttaacaaatatctgacactcagttgtgcacactcgcgtgatgatcctgttgaagcatggcgaaaaatgtcatcgaaatttccacttttgtcaaaaattgcgcgaaaatacctttctgctcctgcgacaagcttgccaagcgaagcaacttttaaagttgcacgggatgtttatgattacagacggtctcagttgaaaccggaaacagccgaaatgttaatttttttaaacaaagcacttccggaaataattacaaatactgaatttaccctcacttccatttgttgccaatttgttgctagttgtgttttttcatatttttttttgcttagaatttttaataaatntattatagtcttttagctttaaatatttaaggtttttattaattaaatcaatttttatcgaatatgaaaaaaatttttaaaaaatccgtatccgtatacggatccgtatttttcctggatacggatttttacggagtacggattttccggatttttagtccgtaaatccgtaatccgtatgtgtatctagtccgtaatcctgatcctgatccgtattt

SEQ ID NO: 42009 - DNA, 1004 bp, Heterodera glycines
  misc_feature (862)..(862): n is a, c, g, or t
  misc_feature (876)..(876): n is a, c, g, or t
  misc_feature (960)..(960): n is a, c, g, or t
tctagagtccgaccatcaaacttcaacaatacacacattgttgcaatatcattagtcaaatgcacgaaataatgagtttaaaaattgaattttttgactttttttattcgggcttagggttcagaacaggttgaaatagatgtcagaatcgaaatctccgactttgaaatcccaaaaaataatttagaagggggtccattaccttaactattacccaatattaattaattatggcacaaaagctgttgccatttatcctaaatttctcaaattttctccccggtggcgctgtcggaagtgaagcagaaccaattccttatagtgttccttaaaaatgctcagattggtcggttttttaagcaaaatcgttgattaaaatgaatttaacaatgattttggtggccaaaatgacaaaagtacggataattttgaatttatcaaaatttcagaaacgcgactcataaaaattgtggaaaatttccgccctcccaaaaaaacacccaaaaacggacttgaaactgctgtcgtagatgacccgcttggtgttgagcatttcgtacgcgcccttgtcccatcctttgcttcgcttcgaccgtttgacctccttcgtcccgagcacaatttcattggcggacggttggaattgggccaacccatcgccgaggcgcgaggcgatgtcatccgagtcgtcgtcaaactgctgctggtcctcggcaccatcaccaacggagtgggactgaaatgggcgcgcgcgagtaaaatgaaatttattttaactttaaccttttttttgacaccctccctctcccataaacatttgtaaggttaggaaattttggacgaatacccctaaaatttttanaaataaaatatggncaaattgggagcaatcatttcaacagctaggggtttccaattttccccaggcggcacctctcggcagaacggcgacacaaattntgttttaccccatttggaaaaaaattctaacaaatggaaaagca

SEQ ID NO: 42010 - DNA, 838 bp, Heterodera glycines
agtatgagtgtgggcgaagttaaaaaagtatgagtgtggcgaagctaaaaaagtatgagtggggcgaagctaaaaaagtatgagtgtggcgaagataaaaaagtatgagtgtgggcgaagctaaaaaagtatgagtgtggcgaagctaaaaagtatgagtgtggcgaagctaaaaaagtatgagtgtggcgaagataaaaaagtatgagtgtgggcgaagctaaaaagtatgagtgtggcgaagctaaaaaagtatgagtgtggcgaagctaaaaaagtatgagtgtggcgaagctaaaaaagtatgagtgtgggcgaagctaaaaaaatatgagtgtgggcgaagctaaaaaagtatgagtgtggcgaagctaaaaaagtatgagtgtgggcgaagctaaaaaagtatgagtgtgggcgaagctaaaaagtatgagtgtggcgaagctaaaaaagtatgagtgtgggcgaagctaaaaaagtatgagtgtgggcgaagctaaaaaagtatgagtgtggcgaagctaaaaaagcatgagtgtgggcgaagctaaaaaagtatgagtgtggcgaagctaaaaaagtatgagtgtggcgaagctaaaaaagtatgagtgtgggcgaagctaaaaaagtatgagtgtggcgaagctaaaaaagtatgagtgtgggcgaagctaaaaaagtatcagtgtgggcgaagctaaaaactatgagtgtggcgaagctaaaaaagtatgagtgtgggcgaagctaaaaaagtatgagtgtgggcgaagctaaaaaagtatgagtgtggggaagcttaaaaaatattggtgggggcgaagctaaaaaa

SEQ ID NO: 42011 - DNA, 1112 bp, Heterodera glycines
  misc_feature (20)..(20): n is a, c, g, or t
  misc_feature (63)..(63): n is a, c, g, or t
  misc_feature (91)..(91): n is a, c, g, or t
tcaccaattcaattttttgnagttttaaggaccaattaggacaataaaagaaaactcatcccntaacattaaaaattttgtgggataattntaatagaaaaagcttatttgttagcaacataatatgacggcaattaagctcccaacattaaatcattggaatgaattttctaataaaacgcactttattttgtaaaaaaatattcaaaaatttaaattttcacagtttttcaccttcacagattattatttaaaattttctttaatatatatattttttgaaaatacaatatacataatttattttttataaaaaatgtcaattttcgttcctttaaaaatgttttccacttcttcggcgtaaacaacaggattcgacgggggaattgaaagattaatgttctagcaaagcccaaaatcgattcatctaactaaatcctcgctttcaaaaaactcatttcctttatgatggctaaagaaaatgaaaaagaattgaatccggaggtaatataattaatttaatttaatattttattttaaaaacttttttttccttttcagttggataagccaaatccagaagaaatgccactcttggaaaacactcccatcaatgatttagtcaaaaaaattgaccgttcagttggccatacatcaaaatctgatttttcaaagcaattctcatggctgttgaagtgtgcattatgcataattttgccggtaaggcacattttaatgaagtattagttaattaatatgtacatatgttggaatgggttccttttttaatttaaaaatttttgatggagacacgaacttgctgattagattatcactgatcaataaaaaaaatttcattttataaaatataatttttcttgattttgattcgaactttctgctgatccgaaatcattgatcaacaaaaatcactttcagtttatgaagccaaatacattttcttggcctttgacccgaacttctttttgatcagaaatcattgatcaaacaaagactacaattatttttatattatataattaattttgacccgaacttgccttgaaaaaattacattttttttccctgcttgttatttattttttagccca

SEQ ID NO: 42012 - DNA, 998 bp, Heterodera glycines
  misc_feature (10)..(10): n is a, c, g, or t
tattaattantcggaccttaaattttcagctaattaataagaaaagaatgtacttaattgctcaccgatcacatattaattatcggaccttaaattttcagctaattaagtattcattttctcattttaatttaacgtcaatttttacgtgattgacctgatgcaccaatgtttacccaatttacaggattgacctttacagaaaaatgaaatgaggaaggaaaagacaaacgaccaacgcagccatccctaatcaccgattctcctgcctattttaattacagcattttttgtttgccaattattgctccgctaaaaatccgatccctaaagtgctctagcatttcaagcatagctaaattatatgcgtccacaattaccacttatgtgggaggttgcttatacgtgaccttttcaatcgaaaaattatgcatttaattaaatccaatattcagcttccgaggcaaacaatttttatattttcaactggatttttcaggactgatatttctgaactggctttttcagggcatctcatctgtttatgaaaactttactttttgtgttattataagcgtcaacgggtattcgaacatctcttccatatccgaatacatttttaaaacttttataatttaccccaaactagcgggtgcgtgaaccgtcggatctgggctgggaaaaagcgcttcgcgctttgtgagcttcgctacctaggcgcgttttagtctgttagggtctttgcgtcagccgacatgcacttggtttcctccaataattggagttgacacatcgcataatgcaatggaaaccggaagtgcgtacaaaagtgattagaagaggtgcaaaagtgattagaagaggtacaactgtgattaaaggaggtacaaaagtgattaaaggaggtacaaaagtgattaaaagaggtacaaaaatgattagaagaggtacaactgtgattaaaggaggtacaaaaatgattaaaagaggtacaaaaa

SEQ ID NO: 42013 - DNA, 941 bp, Heterodera glycines
aaatattctccatcgggaggaggctaaggattttcatctgtagataccctagccgataccctatccttagcattgtgaatatgcaatgaggatagagttagggatggggatttttttgctagttcagaatacggataccttatccctatcattatgaatatggatttatctgcagcttgcggattatctgcggatagttagcattgtgaatatgagcatgattgagtgacaggtcaaagggagagaaaaagatacgaaaatacaaaaattcagtgagaatgagagaaagaatagagagacaaagagaaaaggagagagaaagaaagaaaggttagagttacctaattaaaacaccaatcatcaatatacatatctaagcaagcaccttttcctccccccctacccaatgtgttcattcattcttttctgagttcattttgagttgcataaaaataaaacagacaaattttaatgtgctccttcaattaggtcactatgcattttaattacctaattattcatttgttaattacaaacttaaaatgcctaaataaatattcgataattacagaccaatttccctaacaaataagcaaaaccataaggggctacacaatttaaatttgctgcacaaaactaaagggtagtcgccccattttggttttgtagttgtataaaaaactgggtcacctaaagtaaaagcatcgggagccctcatctaggaaagtgcgcataagaaaagagactggcaaaaacttttgcgggagccggcaagagtaccgggaacctggaaaatttctgatagattttgctgaatttccgtctattatagttttctaaagagtttaaaatgcaatttctgccaatcatttttactcccgcatttggtagggcttataaaattggataaaccatgttaagaaataaaaaaatccttattt

SEQ ID NO: 42014 - DNA, 1651 bp, Heterodera glycines
  misc_feature (139)..(139): n is a, c, g, or t
  misc_feature (158)..(158): n is a, c, g, or t
  misc_feature (970)..(970): n is a, c, g, or t
  misc_feature (1010)..(1010): n is a, c, g, or t
  misc_feature (1021)..(1022): n is a, c, g, or t
  misc_feature (1149)..(1149): n is a, c, g, or t
  misc_feature (1163)..(1163): n is a, c, g, or t
  misc_feature (1169)..(1169): n is a, c, g, or t
  misc_feature (1209)..(1209): n is a, c, g, or t
  misc_feature (1301)..(1301): n is a, c, g, or t
  misc_feature (1311)..(1311): n is a, c, g, or t
  misc_feature (1326)..(1326): n is a, c, g, or t
  misc_feature (1329)..(1329): n is a, c, g, or t
  misc_feature (1337)..(1337): n is a, c, g, or t
  misc_feature (1340)..(1340): n is a, c, g, or t
  misc_feature (1376)..(1376): n is a, c, g, or t
  misc_feature (1398)..(1398): n is a, c, g, or t
  misc_feature (1435)..(1435): n is a, c, g, or t
  misc_feature (1438)..(1438): n is a, c, g, or t
  misc_feature (1446)..(1447): n is a, c, g, or t
  misc_feature (1449)..(1449): n is a, c, g, or t
  misc_feature (1455)..(1455): n is a, c, g, or t
  misc_feature (1457)..(1457): n is a, c, g, or t
  misc_feature (1472)..(1472): n is a, c, g, or t
  misc_feature (1475)..(1475): n is a, c, g, or t
  misc_feature (1482)..(1482): n is a, c, g, or t
  misc_feature (1541)..(1541): n is a, c, g, or t
  misc_feature (1556)..(1556): n is a, c, g, or t
  misc_feature (1582)..(1582): n is a, c, g, or t
  misc_feature (1588)..(1588): n is a, c, g, or t
  misc_feature (1590)..(1590): n is a, c, g, or t
  misc_feature (1592)..(1592): n is a, c, g, or t
  misc_feature (1594)..(1595): n is a, c, g, or t
ttttacttaattggtcagtgcttaaaaattatgtatcaaacgaaaacttaaagtctctgggacctaaacaaatactgacattatgaaaatacaatgagaaaacagaatctagcttttttgagtatattcaatataattnttgtctgttacctttatcncaaaatttagttatcgaaaaaattctacaaacttttaacctttagtttgataccaagaaatgtaggcattgaccaagtaaaaaaaaaagttatggcctaagaaactgaggatggtcactgattggtcgtttaaagcgcaatagagccctaaacatgtctttacaggtatcctaattaaaaatagtttaaaattagcgcataaattggcatcggcgtagatttttttgaaaaaaaaaacttttcctatggccacaatctgtacagctgtgcacacagatggcaatattctccaaagtttagaaagatgaaaaacattgtattgcgttttcattgtcatgtgtttttatcgggaggccgaccgaaactggaaatgcaatgcaaatccgccgaaaaattttcggaaaatttatgcgggaaaataaatccgtcccccgcctaacacaacaaaaaaaaagaagcacaggaaaaacaaaagtaaaaataatattattgttgtaaatatgtatatagaggaaatttaaaaatataaatttttaaaatttttgaaatgcccagagacgaattgtggcgctgaaaaatttggcgaattgcccgccgccaatttgtgcgctgtgaagcggaaatgagtgagaaagagagagggcgcgagagagtgaaagaaagagagagagagagagagagaaagaaagatatatgggagagtgggagcacagcgccaaatttgcgaattttgagtgattggatgagacaaatttaactaaaattggaggacatttcaaaatgaaaagacggggggggggtggtgtgttgcncggctctcttctgtgctttttctccttgttgggttggtgntttgctccggnntgttggcgccttttcttggggggttgggcccctttttttttctcttctttcccgctggctctttcgtttttgtctttgtttgtgtgttttttgtcccttgttttgtgggttctttttcccgctgccntttggctggcctgngcgttnccccggttttgggtggcttggcttcgtgttcttcttttgnggtgctttccgtttgccttgctttcttgttttttgcttcgttgttgtcttcctctcgttgtgcggccgctgtgccccttttcctgctctctncgttggccgncgcttgttcggctcncgntcggtctntcntttcggcggcgctggtggggggggggtgctgcgcgntctctcgttcgcggggtggtgnggcgctccgcgcgtttgtgcgttttggtctttttctngcnccgtctgnntntcctcncntctcttggcgggcgncgngcggttngcgcggcggcttttgtttcgttctttctcttttttttgttgctgctgttcttgttgctnccctcgttggtttcnttgtgtgtgctcaaagattttctggncgtttntntntnnccgtctctgtcatataagagtgttgttagttttggtggcattttacttaattatat

SEQ ID NO: 42015 - DNA, 151 bp, Heterodera glycines
gttccatatcgcggtcgtagtggaacaggctgttgctgtagatgctttccagccctttgcgttcgatttgctcggcggtggggataaagcgataggcgccgacgatctccaactcctcctcatcccacagcaccaggtgataatagtcgtc

SEQ ID NO: 42016 - DNA, 1737 bp, Heterodera glycines
attttaaaaattttttaattgctttttaaatatgccaccaattgtaggcttaacttttttagtgaaaattcgatcactcatattttttgctaattgagcagaagcgtaccaaactttgcagggatactccccggtaaaggactaacttacactgaaatgagcgccgagctagctgctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattgaaaaatcgattttttttgtttcggggcagtccccccgaacgatgcgcccagatttatgggagaccgatcctttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaa

SEQ ID NO: 42017 - DNA, 979 bp, Heterodera glycines
  misc_feature (888)..(888): n is a, c, g, or t
cggaagggacaaattatggcggaggagacactaccctctttgggttgttcttcattttgttcagttactggttgaagttgggcaagatgaaggacgacgacggcgagaaaaatgaggagaaataattggacattggagtggcgaagaaaagaacgacgaagagccaaggcaaaaaaaaagtgccggatcacggagggggaggggatcgttttccaatagaattctttgaattttgcacgtcataacggaaaaaattactatcgaattaaatttttaactaaattttctatatagcaaaattgtcaaattttcatgcctaaggttggtcagactaaactcgtgagcacagtaattccatcgacggatcagttaaaatgtacgatagccatgccgaccgacattgtgatggaaccgaacgttcaccacagcgggaagaagcattgagggtgaagcagagataactttttggtgaataattgaaaaattgactgatcagcgatcactaatgttcagagagtattctaagtaaaaattcataaaaattattagttttaaaaatttaaatttttgtttaaaaaaatttggcagaggtaaatttagcgtttcagaaatttgtccaagtttcaaaaacaaatttagcacaaaaaatgcgaaaaaatattaatgatttcgacgaacaattaaaatattcactaaaaattattttcaggaaaagctggtttttagattaaatttaaaactttttttttttgcttttttatgttgtatttttgttttttattcacattttaaatttatgtttgatcatttatttaaaaatgagaattgtcaaaatttttaggaattaaattaaataaatcataaacttgccaaaaaattatttaattntaaaaaatcaaatgataaaaaattcactccaaatttggagaaaaatactcagagaaatggtattttttgtctttcacatgagattgctaaa

SEQ ID NO: 42018 - DNA, 1190 bp, Heterodera glycines
  misc_feature (70)..(70): n is a, c, g, or t
agcagaaactccatacacttactcttacataagcaatggctatgtacggctgctcggcacgttcaaagcncaaaaatcggcatttctgccggcgatctgatcggttgtggtgccgatttcaataaaaaacaaatgtttttcacaaagaatggtcgcattatattggtcggttataaaaaaacaacaacaaataatttacaaaaataatgctttatttttgcagatgccgacaatttatttgccacttctaacgatgcgttttgtccttttgttagcttatactccagtggggatttggttgaagccaacttcagccccaacttcaaatttaacatttccacaatcagaaaatgaataaagaatgaattcacactttaatatataataactgatcactcttcactgatcacttttttttatatttgttgtctttttttttgttatctaaatattctctaagcctaaataaaagtaacatttattattctgatttttaaattgatttatttgagtttaatgaatagggctataaattatatgcactaaaaaatgccaaatatgcgcataaaatatgcactaaaaatcccttaaatatgccctaaaaacccgaaaaatgcccaatgcactaaaatatgccttaaacattccccaaaatggcttctaattttcaaaaaaatgccaaattggtgtaaaaatacagaattgactttaaaaactccaaaacaatgactaagaaacttttttttagacaattgcaaaaaatattgactttcaaaatttatatatgcaattttgaatttttttttttttaatttttattttatgctcaaacaaaattactttttttgtatcctttgcatcaaaatttttttttcaaaatttcttataaaaatttcaaaatttttcgattttcaagggtgtattttttttatttccaaaaaagtcgatccttaggggtgtatttttcattgttattgcatttttcttatgaaaatttgccaaaaagtaccgaaatatgctctaaaatttcaaaaatggcgaaatatgcatttattctcgaaaaccccaaaatttggattatatgcactaaaaaccctcaccaaatcaaaaaaattttaatctagaaatgctatttttgagcccctttcttaatagcatatgcggcagaaaaaatatgcaaaagcatataa

SEQ ID NO: 42019 - DNA, 879 bp, Heterodera glycines
  misc_feature (222)..(222): n is a, c, g, or t
  misc_feature (863)..(863): n is a, c, g, or t
tttatttaatatgacaagggcaaattttaatcaggtcatggtagaaagttggtggtaaagtaaacgaagacggttggcgggtaaaaaacgggtggtttctccagcagaaaatttaccatcttcttttactgccgtttttcacatggttggtcgttatttgaccaggtcaaatgaccatggttaatgccctggtcaaataaccaccttctttgactacggccncctggttgttgattagggttgctgctttttgtccgttggtgcctgctgcctctgaccgtgttgtaataattgggggatgatccatggagtggcgaattgttttcggctatgtttcgactcgtcctggcactcgtcgtccatctaggcatttcgtttagcatattcgctatttctgctgagttgtcattttgcccattctgtacactttcactttcactttgttcccctcgggcgtcattttgcgccgcttttttgtcttttttcttgctacgcataagtttcttaataaattctggcatttttaatttgccgccgccttccgtttccgagtgttgtgccatcgaatcgtggtcactttggtgattatgcatggagtcattcttgtgtttaatactgttacggggcactgaccaaacagtgggacaccgtaagcacagagagaggacaaaagcaagggacaggagggtactgtagtaaaaacgcatttctcaggaagggaataaaattcgagatgtaaaaattgtctttgttaataataatgcatataatatgtaaatgtaatgactatgaaattatttatctataaataattaataatagataaatcaataaaaattcaatattccctcccctcccctcgnccatggctctcacaat

SEQ ID NO: 42020 - DNA, 579 bp, Heterodera glycines
attgggcctagttaatcagtaaaaaaaatttggagcgatttgaatgagaatagaacgagccagcttcgacggagttttggtaacccaaaaaactatccgaaatatttaaaaatctataaaaaacttacaaatgacaattcatgcgagattttcttgaaataagcttaattggtcctagttaagctgtaagacacccaccccttttgcacttaaaaaaatttcaaaaaatttgatcgtccataaataatttgtaattgatcaggggctcaccaaattttgcagagatacgtatcggagcactacaaatgcttactaatttttctagattttttaaccccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttggaaaaataaataaataatgaaccctcctccttaataattttcctgcgcccaaggtactcactcg

SEQ ID NO: 42021 - DNA, 1121 bp, Heterodera glycines
tttttagcaaaatcaattcataatatttttcagaaactgctttgaaacgcacaaatgttaattaaagttaaataaggctctctgatgcttttctatcaaaagggagatgaataaaatttttaaaaattttaattcctttttaaacaggccaaaaaagtttaggcttatattttaaaaagtttcatcgaacctagcgcactaaaatcgatataatctctccaaattttgcaggccttctccattgtaaaggactaacttaaccagaaaaaatgccaacgcttgttgtttttaaaatttttcgaaattctgactttttcattacttatttattttttgcaaaattaattcataagtattttttcagaaagtgctctgaaacacacaaaactttatttacaggttaattaaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaaggccgagtgagtacgcttcggtgcaggtaaaattattcgaaaggaagacagtttcattaattatttattattttgcaaaattaattcataaatatttttttcagaaactgctctgaaacgcaccaaatgttaattaaaagttaaataaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgtttttctatcaaaagggagatgaataaaatttttaaaaatt

SEQ ID NO: 42022 - DNA, 1288 bp, Heterodera glycines
  misc_feature (36)..(36): n is a, c, g, or t
  misc_feature (1147)..(1147): n is a, c, g, or t
tttggtttggccagcttgtataattcttacaattcnagctcattaacccctcaaaataaactgtataagtgtgcggaaagtatggagttgataaacgctaataatttccgatttacaatttacttaagcaaatttatacagatacatttggaggaaaatgagctgaaaatgtgaaaatttcacaaagatggtcgtgaaaataataagtcggagattattggcgctatcaactcaatatttccgcaacgctgttagagtttatatttagatgataattagctgaaatttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcgataagcgccaataattttccatttattattttggtttggccagcttgtataattcttacaatttcagctcattaccccctcaaaataaactgtataagtgttgcggaagtatggagttgataaacgctaataatttccgatttacaatttacttgagcaaatttatacagatacattttgaggaaaatgagctgaaaatgtgaaaatttcacaaagatggtcgtgaaaataataagtcggagaatattggcgctatcaactcaatatttccgcaaccctgttagagtttatatttagatgataattagctgaaattttgagaatttcacaaggatggtagtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcgataagcgccaataattttccatttattgttttggtttggccagcttgtataattcttacaatttcagctcattaccccctcaaaataaactgtataagtgttgcggaagtatnggagtgataaacgctaataatttccgattttgcatttacttaagcaaatttatacagatacatttggaggaaaatgagctgaaaatgtgaaatttcacaaagatggtcgtgaaaatataaagtcggagatatcggcgctat

SEQ ID NO: 42023 - DNA, 1218 bp, Heterodera glycines
  misc_feature (1203)..(1203): n is a, c, g, or t
tttttagtgaaagtttgatcactcatattttttgttaatgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatatttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaaaacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaacgaatccttcgggagtagcttccctnatagccctgtacttt

SEQ ID NO: 42024 - DNA, 766 bp, Heterodera glycines
  misc_feature (712)..(712): n is a, c, g, or t
  misc_feature (744)..(744): n is a, c, g, or t
cccgagggcttggcgaatgggcatgcgtggcacccgtgagcagttggaacccgagggcttggcgaatgggcacgcgtggcacccgtgagcagttggaacccgagggcttcggcgaacgggcacgcgtggcacccgtgaacagttggaacccgagggctccggcgaacgggcctcgcgtgacacccgtgagcagtcggaaagcgagggcttggcgaacgggcatcgcgtggcgtccgtgagcagttggaacccgagggcttggcgaatgggcatgcgtggcacccgtgctcagttggaacccgagggcttggtgaatgggcatgcgtggcgtccgtgctcagttggaacccgagggcttggcgaatggcatcgtggcacccgtgagcagttggaatgggcatcgcgtggcgcacgtgcagcattggaacccgagggcttggcgaatgggcatcgcgtggcacccgtgagcagttggaatgggcatcgcgtggcacccgtgagcagctggaacccgagggctttggcgaatgggcattgcgtggcgtccgtgagcagttggaacccgagggcttggcgaatgggaatgcgtggcacccgtgctcagttggaacccgagggcttggcgaatgggctttgcgtggcacccgtgagcagttggaatgggcatgcgtggcgcacgtgcagcattggaacccgagggcttggcgaaggngcatgcgtggcacccgtgagcagttggaaggngcatgcgtggcacccgtgagca

SEQ ID NO: 42025 - DNA, 100 bp, Heterodera glycines
tgtcgtcggcgataggcgcctgggtgcgcgcaacgccgcgcatctcctgacggttgttgccgttgatcaccgccagcttcacctggccgtcgccttgcag

SEQ ID NO: 42026 - DNA, 889 bp, Heterodera glycines
aaaaatggggtttgacaagtttattggggaaaaaaagactttacaaaataatacccctgggagaagggagtgggaaacatgatttcaaaattttcaatttttttttagtctaatctactcaaaacggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaatttttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgattcaaaa

SEQ ID NO: 42027 - DNA, 774 bp, Heterodera glycines
  misc_feature (745)..(745): n is a, c, g, or t
gatttattattttcacgaccatccttttgaaattctcaaaatttcagctaattatcttctaaatataaactctaacagcgttgcggaaatattgagttaatagcgccaataatctccgacttattattttcacgaccatctttgtgaaattttcacattttcagctcattttcctccaaattatctgtataaatttgctcaagtaaattgtaaatcggaaattattagcgtttatcaactccatacagtttattttgagggggtaatgagctgaaattgtaagaattatacaagctggacaaaccaaaataataaatggaaaattattggcgcttatcgactcgatccttctgcgacgcctatacaatttatatttccatgataatgagctgaaattttgagaatttcaaagtgataatgaaatgtaaatagagaatctcacaatttcagctacttaatctctaaataaatactgcagcaatattgtagaaggatcgggttaataatattctctgatttattattttcacgaccatccttgtgaaattctcaaaatttcagctaattatcttctaaatataaactctaacagcgttgcggaaatattgagttgatagctccaataatctccgacttattattttcacgaccatctttgtgaaattttcacattttcagctcattttccttaaaatgtatctgtataaaatttgctcagtaaattgtaaatcggaaattattagcngttatcaactccatacttccccgcacact

SEQ ID NO: 42028 - DNA, 1212 bp, Heterodera glycines
aatttgcaggagagtgtctccgtcgtgaaatgcacagcgctgcgcggtctgccactcagcccgaccgcgtgtgcagacagccgtgtcggtgcgatcaaataaaacaattaattttgattgcatttaatatgaaaattaatccataataaaaaaaattctaacttttcttcagtgagcaggtgttcagcattacgtacagttgtgccaggtaaatattgtaaaattcgaaatgttttcaaattccgggcggggggggggggggggtaccgttttgttaaagtatgagaagccatttttatgaaaaaatattctgggaatgcgataccgacaattcatctgatcattttttcttctcggtctcaagtctatctcagtccatttgagctgttaaatccctttctcatttgcttaattgaatattgaatttgctattatttttataatttggcgtttttcattattttctcatgctttattaaatttattcaataaattaattcaacagatggccctccagcgatttggcattgcacggcgaatgcgacccgtcgctgagcggtgcccaatgtctgcagttccatcgagaacagtccgccattgtcgaggtgtactttgaacaattgaactacgagagtttgcaggagagcgaagcatacggagtaaaaacgaaaaatattttatttaaaattgaagaagggagggggaggaggggccaatgcttaatggggaaatatgtacgcggaaggcaaagcggaccaactgcgtttaggaaaagttagaaaccatcaacaaagttggcatcattcaaatgcgctaaaaagctctacagctaaccaaaactcataatgatttgcaaagaagtaaacaattaaaaataagaatatacaaaaattctgacttttctgcagtttcaggtcttaatttttatctggttgttaatctcatagaaataccttacatatacagtctaaatatagatgaacaaagaaaaaattttggctacaaaaagccattaaataccacaaatttggctttctgtctcttaaagtcacaatcaaaaatctcgagtaattgttgcgagaagttgttactttttttcttgtaacaatatcaaaaatattttgctgttttcccatagatgccaaatttgctgtctgactttggcggacagcatggcctatggatgggtgtttcagtgatcacaatcatgga

SEQ ID NO: 42029 - DNA, 989 bp, Heterodera glycines
cttgaatttatttgacaaatccaagacttaaaactgggagaagaaggggctgtggctgggggcctaaaatttggggccacatttggagaattaattctgatttctgaaaaagtcccagaaatgactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctgaggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcatgtagagctcgagctgctctttccaatggtcttatcccggtctcgatccgtgccgaactcacaaagttatggagtgaaatgtgaaatattgttttcaccacaaggcattttttctgaaaaccggattcaaaaatctgagggtttggtataaccgttttagaaatagtgtagaaaacagcttcgatatcaagaaatcaagtcaagtccagaaagaatattttaaacgatttcgttttgttttggcattatgataccgaataactttcgggaaattatggaacaaaattggagaaattcgaataatttttt

SEQ ID NO: 42030 - DNA, 1085 bp, Heterodera glycines
tttggcaattagatggaacttccttttgtttggaaattgccaaattcctcttctcgtctggccctcatggccagcacagaaattcgttggattttgcatagtttcttgtcaaggacgtcctttccagaattcgctgtgatgcaatgcgttcatgggtcaaaattccgtccaaatttcctcttcaaaaaaatgcgtcgtttctctcaccagctgattgctccgtcagccgctcctatctgttcgcatctgtcatcttatgctatgttaatgaatttgatataaaaaccgcaatgtttccaaccaattgaatgttccgccgctctgtcccgagagtcatcgttctgttgtagtgtcacatcctttttatggcacattttgtgtataagagtcatgttattagacttagacgtccgttttgccgcatttcatgtgttaaaggttgctgcagcatctctgcgtcagcaagcgtgattagttggaaattggtcatcagtattgcagtttcagttctcaagttcggcacccatgtcgtcagcaactgtcctggtgacaaaggtgttttttggaaatttaattttatttgatttaaaaatttgaaaacaaaattttatgtttttataattataaggtaatggatttttaggaataatcgccggcgcctgcggagatggtgtacttcaggctgcggatgtcattcttttttgccgctgccagtgctgcaaattgcgcggccacaagccaaaggactgctggacattggctgcttggcgtatattttgtttctttgttttgataaattgaatgcctaattcatgtgagaaccttgccacaattgcgtcagcaggcaaggaactcacgttcaagtggggaaaaagccgttttgatttgcgcggctatgccaagtaaatgtgcatcccattggcgtctgcatgggatgtgctcggtaaggactaccattttttgtgtcattttataaatttattttttaattattgcagaggaaatcaaagaagcagtgcaagctgccaggacattgtttccgccgcaatccacaaaagggatgtgttttgcgtgccaaaagacaa

SEQ ID NO: 42031 - DNA, 1329 bp, Heterodera glycines
  misc_feature (1317)..(1317): n is a, c, g, or t
ctttctttaattgcgtcattttccctctctctcattgtgtccttttccctctctctctcattgcgtcctttccactctctctctctaattggtccctttccctccctctttctccctttccctctctctctctcattgcgtccctctcccctccccctttttctttaccttttgtgccaccgtcgcagtttccctctcgcggatatttcctccatcttatcccgccatttgctgcgcaataatttcccctattttcttgcgaagcacttttttagtcatcttcggtgtcggtccgtttgacatcatccataatgccgctatgacgttaagtaagaaaagcgcaagtgtaaaatgaaaggcaaaataattatctaaaatttaaattttaatgacattaataatttatttattgaaatattcgctacctaattaaaatcataataataataatcatataaataaacgcaaggaatggtaaataaatgcaaacacaaacgctgagaaagaaaaggaaagtggggggaataaacccaatcggaaaggaaagaaaggagtgaatggacacggaatttgcttcggttttgatcgattgttttggtacacatatttaggcccctaattgccttactttgttgtttttgtttgctcctcttctgttgcccttttggaattcattttgcgcaattacagtaattaaatgatccgtctcaatttgctttacatttgcttccgtttcttattttaattattagtcgacgacaattcgcatgttaaataaatcattattttctgattttctttttccgatcgcttcgatttgaatctctctccgttccgactgatcagcagaatctctcctttttgtcctgtccttttctgctaccaccatagccattgctcttcgtcctccccaattggcaaaaaaggacgtttcgttgccatttcattttggtgcctttccctccccaaaatgtccctccgttttcgccttcgctgttctttggccatttggaaaagtgcggagcaaagcccctccaaattgtgttgcgaacgtttcagctaaatcttggtttacaaaaaaatatttcggaattccccggccccaccgatttctgacggcacattctcagcagaccgaggagctgctcgccctcccgggccgccaattgtcccccgcttcgcattgcatcggctgagtattcgctccggggggcgccgatcagtccgccgtcaatcccgccattgttaaggtctgaacatggaaggatacgcagaagggatccgctgtggggaggaacgacagccaagtgccccccnaggccaaaggga

SEQ ID NO: 42032 - DNA, 1201 bp, Heterodera glycines
ggctcaaaaaaatttttcgaaaatcggagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataaaattcacggtgcgaaaaatggggtttgaaaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttgtaaaaatttttaattcctttttaaacaggccaaaaag

SEQ ID NO: 42033 - DNA, 546 bp, Heterodera glycines
accgggaccgggccgggaattcccggtcatccgaggtcccggtcccggtcccgggttttgaaatgctcaggtcccggtcccggtcccgggttttgaaatgctcaggtcccggtcccggtcccggtagggcaaccgggaaccgggaaaaacaagcactggtaagaatgggttctgagtgaaaaattagtgaagaaaattagagtcaaagggaaaaataaaaaataataattaatatattctttaaaagtaacactgcccaagtgtgcaaatggcctaatggctagtctccttgactttgcccttcttctttcccctggttcaatccctctacagaaattagattattttcaattttttttttgtatactcgtgggtttcctataaagaaaatatgattcctcatagtttttttttaaattgatacatattttatcattttttaaatgaaaatcctaccaattgagcttaataatcgcaaaaaccaacctttttttgttgaaaatctgttaacaaattgcacccaaatttttaaaatttcccccggcg

SEQ ID NO: 42034 - DNA, 1229 bp, Heterodera glycines
tcagttactgtttactcagacttctcggtaaaagcgacttttattttacaaaacttttcaaaagaacaaaaattatgaattcaaagcattatttttattttaattttatcatagacgatttctattatctgaaaaatattcttttagatactgcattacagattgggattttatttggggtatgtcaaattgcccatttgattcaattatgcttattctttgtcacattctaaaaaaggtttaatatccttttttattcgctgttttaaatcaattctatttgagcccaccatgagaataagaatgaatcagttactgtttactcagagttctcggtaaaagcgacttttattttaataaaactttttcaaaagaacaaaaattatgaattcaaagcattatttttattttattttatcatagacgatttctattatctgaaaaatattcttttagatactgcattacagattgggattttatttggggtatgtcaaattgcccatttgattcaattatgcttattctttgtcacattctaaaaaaggtttaatatcattttttattcgctgttttagagtatatataatttgttgctatatcctggtcttttaatatttttgctgaactagcgaaccagcctacacaaaaagacgtctttgtcgcaatcaattctatttgagcccaccatgagaataagaatgaatcagctactgtttactcagacttctcggtaaaagcgacttttattttaataaaactttttcaaaagaactaaaattatgaattcaaagcattatttttattttattttatcataaacgatttctattatctgaaaaatattcttttagatactgcattacagattgggattttatttggggtatgtcaaattgcccatttgattcaaatatgcttattctttgtcacattctaaaaaaggtttattatcacttgaatcaatcaaccggacttacaacatttgaaagtggcaagcaaaaccagacataattttcgatgatttcgtggccatggaagcccccgcggagatcacacaaaatgcgacaaaagcagccgtacaaaacgacgcgtattttccccaaaattttgaccagcgtcgacaattaaatttctcaaacaccgaagcagcctgaaaccttcaaatgctacaattgcggccgtgaaagggcttcgtctacacgcaaatgcaatgctcaatggaggag

SEQ ID NO: 42035 - DNA, 961 bp, Heterodera glycines
ttaatgaaaagtcagatttcgaaaaatttaaaaacaccaagcgttggaatttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaaatgttaattaacatttggtgcgtttcagagcagtttctgaa

SEQ ID NO: 42036 - DNA, 496 bp, Heterodera glycines
atgtttgaaaattcataatccacttctaaatgaatcaattaaagtgcaaaaagcattaaaaatagagaaaaaaactggagcattttatacttttttagaattttctatcttcaaaatgaagaagttattacataaattttggaaaaattggttttttgagaaaaaaaattaatagcactgttctgaaaaggttttttgaaaaacacgaaattcttcctctataagcttctgtttattctatatttttataagacttttgaaaaaaagtacaaaaataaactgattttggaattcgggatcatagatggaagcaaatggttttttgggccatgggttcagatccacttgcctgtaaaaatgttttttagggtttttgggaccactaatcaagaacttggcatccattttgcccaattccaaagccttgatccgaactcgaaaccccaaaaataatttttaaaaaatgttgcacgaatgtggatttgaacccctggcc

SEQ ID NO: 42037 - DNA, 57 bp, Heterodera glycines
attggcctgcaccacgatgcggcggctgccgttgttgcggctgatctggttgggacc

SEQ ID NO: 42038 - DNA, 1109 bp, Heterodera glycines
  misc_feature (1076)..(1076): n is a, c, g, or t
  misc_feature (1090)..(1090): n is a, c, g, or t
cgggtttcaaaaattaagatttaaaagaggcaaaattacagacgtttttcaaattttgggtgtctccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcagaagcaatattttgtagagcccctcaaacacattgtgcttataggaaaggccgaattaaacaataggggcctttttattatgattacaacaaatcagcatggcgtctcgctgatatggtatgtttcagttaaggtttagccgatctacaaatttcggcactgtctaatttgtaaaagcgaagcaaattcctttggattccaaagtggaattacagaattgcaacggcaaatacaaaatagacaacgacgctttcattataaagctttaagggaggaaaagtaatacgaatatttcaatttcttacttatcagaatagacaaagataggttacacacgaacatttttatagaaattccggctgaaactaaaatccctcttttggtcttaacttatgatttttggcccattatggatgaattaaatatagaaggcgtcgcagaaatacattcatattttctcaattcgggtttcaaaaaattaagatttaaaagaggctaaattacagacgtttttcaaattttgggtgtctccgaatagaaagaagttgtaaatcagtacttttcacgcctataaaattcgggccgaaaaatattggtgtttgtgactagaaaaatagcagatgcatatcaaatgactacagaaaattaaagcctccaagaaaataattgctttgcagaagcaatattttgtagagcccctcaaacacattgtgcttataggaaaggccgaattaaacaataggggcctttttattatgattacaacaaatcagcatggcgtctcgctgatatggtatgtttcagttaaggtttagccgatctacaaatttcggcactgtctattttgtaaaagcgaagcaaattncctttggattccanagtggaattacagaattgc

SEQ ID NO: 42039 - DNA, 1099 bp, Heterodera glycines
tttcccttttcaaagcaaagaaaggaacgaaaaggggaaaaaaggggggggggggggggacaaataaaaataaacgcacacattgcaataaatgggaacagaaagcgcagcggagcattcattctttgggttggcatgtgatgaaagtgataattgataaggggacaaaagacgtaacaaaataaacaatcgtcgcaaaaattcaatttaatcgtacaaaatttttaaatttaattcaaaactaattcattaattaatggaagaaagaaaatgacgtaatattataaaaaaggaaagcggagaacggagaattacgctttatttgtgtttctttttgcttttcctcccaaattcctccgttttatttgccaaccaaagaacacacaaaagcacaaaggccaaaaagaagtgggcacagaataaataaatgtgccatctgctgcttagggaaagtgttgggatgcaaaggcattcttcggacggatgactcatcgcttttcctttcgcttttgctgtgccaatggccattcattctgtctctccctttatccctctctctgtcccttcctccgctttatcctccctttatccctccctgtgtctctttatccctttttgtcctcccttttcgtctgttctcgaagggatggattttattattaatattaatcttttcccgccaacaattgttcgttcgttctttcgcttcacgtggggggacaccgattaattctgtgacagcgcccaatgcgtcgctaatcgtaagccgtgacattcatcgctcatcgattcactcacttttgcctcgtgctttttatttgcacaataaaattacttccgaagttcagccgatgacgacggcacagccacgggtcattaattaattgattcattcactaattaattaactgattcgtcatcattagttaaagtgcaggcattaatgttagtcaaaaggtggaactaattgatcagcagaaggagagaaaaaaaattgtaaaccaaaaaatgataatttaattgtaagtaattttatagcgaatgcgaatttgatcaattaataagaaaatagaataaattaacttttaatacagcacat

SEQ ID NO: 42040 - DNA, 303 bp, Heterodera glycines
tggtcaatggcaactcgtacaaaaaaaaaatttcaaagaatttcactaaaacttataatttttatataaaaaaactaaatggattttctagcctagaaaaacttttttaaacacttaaattttcaaaaaatttaagaaattttaaaaaatcagctgaaaaattagtaaaaaaaacttagaattttttttaagtttttctaggctagaaaatccattaaggtaaaattctaagtttagttgaaaattcttagaaatttttttttgtacgagttgccctgtgtacgagttcccatgccactaaaa

SEQ ID NO: 42041 - DNA, 1337 bp, Heterodera glycines
ctttgcctaagaaacataggattgatatgatggaaaaccgtaataaatgagccatgttttaggtattttatttcctgacatttattttaagcaaatgggcgcaccaactgtttttaactttgtttttgacccgatcacattggaggtggcgctggctcacggttggtggtttggtgaaaaagcataataacagtttttgattaattatgaaacaaaattcccaaattagtcattgagcattaatatgtccgcatcaattatcaaaaatggggttctgggttttgttcgtgttttggctctatggtctcgtactctgctcgaggcaattagttcgggaagagacagggagtgagtgagagagagaaagagagagagaaatctagaatcttccaaattaaacattcttggaatcatcaatagccctaagagtcctcaattagtttgtaaaatttaaaaaaatagttgtttgtttcaaaaaatttacggtcaaaaatgtccgggaaacgagttttttgaagtttacaagccttaacttttttgatagactaaaagaggactcttacagctatcgaatgacaccaagaatgtttaatttaggtgattctataaatgatcccttaaattttacaaattattttatggtagtgtctttttatggtccggtggactgatagagccatcagagtgcttattccgttcaggtttaatcaacccaaacactggagtgttcaatgaccgtgcgaatgtacaacagccagtgccgttgtaccatgcgcttcggcgcggctttatcaaattgccgagcatggcaacgggaatcgcattgacacttaccgattgcgttgagtggttcttcatcgacgacaacaccggcaaattcagcgaccgtttttccgatgatcagttctcattgttcgatgcgatccaccaacctcgtccgctggtcaagagcaacgtgcgagaaatcattgacatggcaaacaatcggcggcttactgttgcggaagcggtgcgtgcgaatgtcttgtgccaagacactggaagattcatcaatgtgcacggacacgctgagtcgctgcgtgatgcgtaccaactcaaattggttcaaaagccgcagactttggccgaggtcattgatagtggctcgctggacaacgatggtcgtttcatcgatggtgttaaacctcgcactctgctcgaggcgatttgttcgggaatgctcgacccggatgtggcgcacatcagagcgggaccaggcgacgaagtgatttccatcggagaggcgctgaagagaggtcgcttgacgccgcaaggggagaattgtgttgactctgggt

SEQ ID NO: 42042 - DNA, 1784 bp, Heterodera glycines
  misc_feature (6)..(6): n is a, c, g, or t
  misc_feature (806)..(806): n is a, c, g, or t
  misc_feature (1610)..(1610): n is a, c, g, or t
cccctntttcgaaaaaaaaatttcaaaatttttttctgaagaaaagtcattttaggggttttcgcggtcagagaatccgattcttacatccatttcggcccaattcgaaccttgaacccaaattcgaacaaaaagtcgaaaatcaaattttttatagtttcgcatttttggttcaaacccggctttaatgtaagaaaacaaatcaaaagtcataaatgatgttttttgatgaggttttacgaaattggttgcttttatgtcgcctaattaaattttttatctttaaatttttcactttttcacgaaaaaattcacataactcacttaaaacacgttatggctaaaaataaaggtcagattcttgatcagcatcaaaaattagcctagaaaaaattattagaaaaaaaatttcaggggggtgacaaaacctagaagtaccgcctttacttggttttacacattttatattatattaaaatagcataactgactttgcacggcaattctgtagcctcatctccgactacaaattccgataggcaaattgggcaatcaccacctttgttttcttcatctattttctgttttgataggttggcagtgattttcaaacctaaatttttatgaagaattttatgtgttgtgactttttttagcaatttttaaagaaattaattgaaacttttaattcattgttaaatgtatataaaagcttttctgtatttctgtctccagtttttgtaaactattttctgaaattaaagtagtcaatttaaatcagtttaagtgttatttgtatttcattntgttaattatttttaattgaaattacaaaaagttttttgcctttttccgactgttattaaataaaacattccccaacgcccaatttgactgattcgattatctttacctttctgttttgttttgtattcattaattttgaattttgcccaatgccaagcacatatcgctataattatggccaagctaaatagcaatccaaaaaaaatatccgccactcgcttcttacgccgactttttcgcctgcctttcttttgagctaaattttaattttgtttttaattcgctgataaatttattcgattgttttggtttattattttttgcttcaaataaacaatatttaaatgcgtgctggcgcgtttcttaaattccgccacccatgcgcgtttcttaagcccgccaaaatgggtttgcgcgtttcttaaattccgttaaattccgccacccatgcgcgtttcttaagcccgccaaaatgggtttgcgcgtttcttaaattccgccacccatgcgcgtttcttaagcccgccaaaatgggtttgcgcgtttcttaaattccgttaaattccgccacccatgcgcgtttcttaagcccgccaaaatgggtttgcgcgtttcttaaattccgccacccatgcgcgtttcttaaacccgccaaaatgggtttgcgcgtttcttaaattccgttaaattccgccacccatgcgcgtttcctaaacccgccaaaatgggtttgcgcgtttcttaaattccgccacccatgcgcgtttcttaaacccgccaaaatgggtttgcgcgtttcttanattccgccacccatgcgcgtttcttaagcccgccaaaatgtgtttgcgcgtttcttaaattccgccacccatgcgcgtttcttaagcccgccaaaatgggtttgcgcgtttcttaaatcccgccacccatgcgcgtttcttaagcccgccaaatgggtttgcgcgtttcttaaa

SEQ ID NO: 42043 - DNA, 1252 bp, Heterodera glycines
tttctttttaattgtcctgcattttcgcaaaaaaaaatttgttttcaagcaaagggatgcttgtctcgtttgtaaaaaatgtacttaacattaactccagcagtggtcttatgtgggcattccatgaaacattgtgccactgttttctgaccgacctcaacagagaaagaatggaattggcgatgagcagacaaagttgacaaaatgtaagacgctgttcaacaccagtgcagcaagtcaatgtgtcagaaaaacatgccgtcaaaaacgcgtgccaacacaccatgccgggcccaccactgagtaattttggcatttacatcttccgcaaaagtcccgcaccatcatacaccttgcacaccacaaattcatcctcgtcctctgctgaacaaagttactgatcggagacaaaatgccaatgcaaaagggccttttgcgccgcctgtgccatccgaaaggttctgccaaaattttgattccggacagtgcaccaatttgatcaaatgatttgttgcactgttcgtaatcaactcaacattggatggaaaataataacaaaaatgagaaaacgaatgaatgaatgggatgggaagagaagagagaatgagataagaaggaagaaaggtcagcagaagcattaataatgtgaaaagagagtgcgaaaatagcaggaaatagtgtatggcaggcagagggagggaaagagagaaacgaaaattgacaaaaacaataaacaaaaaaaaagtgctctttgatccccgaggcagcacatttcttcaaccgcgccatatgtatgtaaatgcacaaaactaaacgattgaagaaaaaatatatgtacaaaaatagcccggaagcgtaaaggaagtttcgaaaaattttttattcggcacttttgcagtttaggtgccccctaatttggacagagaagtttgtggcttttcgggatcgctgctcatgtaatttgacactcattttggcgaattttgaattccggaccagaatttaacagaaaatccaatgcctttgaattttacactaatgttcaaatttaacccttcaaaaactctaattggtgtcccaccaatttttcttggcatttgtaaaagtcggacaccgcaggggccaagtaaaccagcgcatttgagccacaccagtgcaggcaatggccaatctttagattcatgaaatgtttaaaaattcaaaaaaataaaatgaagaataaaaaaattcaaatttccgaggaattccgaaa

SEQ ID NO: 42044 - DNA, 190 bp, Heterodera glycines
ttcctatttttctatctttttcgggatttttgtacctatttacctaatgtgtaaatatttggtacttttccattatgctgacacaccacaaatttattgtgctttatgctgacacactccaaatttattgggcttttatgcttcttaaataattttttgcggccgtataaaggacgacgacgatccattc

SEQ ID NO: 42045 - DNA, 870 bp, Heterodera glycines
tgggcgcatcgtttcggggggactgccccgaaacaaaaaaaatcgatttttcaagtgtccgtttggggtactcaaacaatatgggggagcaaaaatccacgccagaattaaagtacagtctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatcgggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacagactatagggaagctattcccgaaggattcggtctccccataaatctgggcgcatcgggtcggggggactgccccgaaacaaaaaaatcgattttt

SEQ ID NO: 42046 - DNA, 1029 bp, Heterodera glycines
  misc_feature (981)..(981): n is a, c, g, or t
  misc_feature (992)..(992): n is a, c, g, or t
tttttcaaaaaaggataaaattcttgaaaaattaagcaattatcttaacaaattacataaaaatttcaaaactttttgctggcggcgcctgacggcacagccgatcccccattttagcatatttttgaaaaatggacccaatattgaaaaaagtctttttttttgtcgaaaacaaatacctgcaaaacacacctcctaattcgggatttcaaaaaaagaaaggaaaacacccctaaaaatcgattaggaaaattgatcagaactgttatctcagtttgacataaatcagtgagtttggctagtctcggctctatctcatcaaagagttcattttggaaaatttatttaacatttttctaaattagtgaatcaattttatttgacacatgaagatctttcgaaacacaccaaattttaaagttttggtaactctaaaaagttatgaacggtgccgaaacggtgggcagaattgtgcctgtccaagtacagtacccggaaattgaacggtggcacggcagggcccagcgcagcagagaccaaatgggtcggatgaaatacgtcagtgatttgggccaacattatgccgaggggacggacagctgcacttaattactaataattgattgaaagcaaccacaaatacgcgcactgacaaattaattgaatttgaaggcaattaattatatacacattaaattgaaacgctgcttgagggcaattaggggacaaattaattaattattatacataatacttgaggcaataaaaataacagagagcggggcgggggaagagggcgggtaacagtcagtcaacaaaacggggtgtggggcacaaaacagcggcgggctgaaagtggggggaggggcagcgccgatcaaaattggctgactgatcagtgatcatcagccaaccccattcacccgtgttcctcagtcgtaaacattgattgaaatggacaacggcagcagcaggaaatanaataattaggngacgaaaggagggcaaaggcgtgccgcgggggagcat

SEQ ID NO: 42047 - DNA, 51 bp, Heterodera glycines
cccggcttgcgttggatcagaccggcgcgttgcagccccgtctcaatgcgt

SEQ ID NO: 42048 - DNA, 1028 bp, Heterodera glycines
ttttaaattttttatagatttttaaatgtttggatttttttggcttaccaaaacttcatcgaacctggttctttctatctcttttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttaaattttttatagatttttaaatgtttggattttttttggcttaccaaaacttcatcgaacctggttctttctattctcttttaaatcgccccaaattttttttacagcttaactaggccctattaagcttatttccaaaaaatctcgcatgaattctaatttttaaattttttatagatttttaaatgtttggatttttttttggcttaccaaaacttcatcgaacctggctatttctattctcattcaaatcgccccaaattttttttacagcttaactaggccctattaagcttatttccagaaaatctcgcatgaattctcattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaa

SEQ ID NO: 42049 - DNA, 881 bp, Heterodera glycines
ctattttgagatttttcgtcactaaaagtcccgaccctaatcataatgcttgaaaaataattaattttttttttaaatattcaattctttcttcaaataaattggaataaataatacatttaaatacaaataaaagatctttgcttccattcattagaatgtgctttcaatcggacatcatttgttgcgtgaacaattgcattccgttggacagcgattggaaattgccattgggcggcggcggctgcagaaattccaccgatgcggcgccatttggcatctgaaagcgttggaagtgaccgtcctgtggattggccatgttgtggtaccattatcgactgtgttccggtgggatggaattgggcgtccatttgtgtcgccgctcctccgtctccgatcgggcgctgctcagtccaaaggcgagcattttgtgggaattgacgaatttcgaccggtgccaagaattgttgctgagtgctggcacacgactgctgctggtcgccgagttgggcagggcccggcgaaccggcgatcatcggaccgacgcccacggcgcgaacactgcgaatcgtttggtcctgaaaagtcccacttttggtgttctcatccttttggccattcattcttctcctttccaatttcaatttttgtttgtgcaaaattcgttcacttcattacgcaccccgggcaaatcgtttgcttaggaaatgacaaaacggagaaaaggcgcgaaacggcgaccgatcggacggatccattctcaacgcgaccgatcaacacaacgaacccattcatcatcatcatcataatacacaattcatgacaatgagaagaaaggaaggattttgggaatgtttgtttgcttatttggtcggccgaat

SEQ ID NO: 42050 - DNA, 897 bp, Heterodera glycines
tttgcggtaaaaaaatgagaaaaaagagatagccatctttttggtcaagaattttttttttgtttgcgtttcaaatatcgtaagattgtttgataggagacaagagaaggcaactgttggtaccaattttgcgttaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcagatatattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaagtttgcggtaaaaaaatgagaaaaaagaaccatttttgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaatgagaaaaagagataaccatttttggtcaagaattttttttgtttgcgtt

SEQ ID NO: 42051 - DNA, 814 bp, Heterodera glycines
cacatttgatatccgctgactcatgatttaagtctttttgtctagctaaataattttgcctgagaaaatttcgcgattgcgtattttgtgggcgttgcggatttgcgttgttcggtttgggtttataagcgggactttttggtcaaatgcattccattcgcgtgcatcagtctcctctagttgccgcaacatttcacgtttgattaactcatagcggaaaggtactgtcgaacatgccgacctaaaggccctctcggctcgtccaaaaactttggactcgagcgaacttatccttttcgcatttgtccattcgccagtattcgaatcaaaacgcttgaaaaattcacggaacttttccgcaccttcattgacttttagagcggggatttgactaattatgagtgcgtatgctacttggtccattcccggttctcttccccgttcaatgacattctcaattggacgattttcgaaattttggcgagccaaattttgagcggcattaatttgttgctgttgtggttgcgaaattggctgaacaacttgcggaatgtgtgcttggtttatcatgccaaattggtggttcccttggggcaaatacggctgttggagttgcgggttataagcattttgcatttgtggtggattttgcgcatttgtgctcataaaaccaatcatttgttggtttaaaaagctgcatgagtaatggtgctagctggtaaaatggatttattgccgggtaaatccaaaagggccctggaactgcttgctgaaccggcgggaaaaatgctattggttgctgaacgacttgtgg

SEQ ID NO: 42052 - DNA, 849 bp, Heterodera glycines
gagaacacttgttttaggggttttcagggtcagggaaaaccggttttgacttcaatttcgaccaattccgaaccccggacccgatttctaacaataaatcgaaaattcatttttaactaaagttcatcttttgttccaaaaaacgctttttaggagttttaagggtcaggaaaaccgattatgacttcgatttcgaaaccccggacacgatttctaacaataaatcgaaaattcatttttaactaaagttcatcttttgttccaaaaaaacgctttttaggggttttaagggtcaggaaaaccgattatgacttcgatttcgacaattccgaaccccggacacgatttctaacaataaatcgaaaattcatttttaactaaagttcatcttttgttccaaaaaacgctttttaggggttttaagggtcaggaaaaccgattatgacttcgatttcgacaattccgaaccccggacacgatttctaacaataaatcgaaaattcatttttaactaaagttcatcttttgttccaaaaaacgctttttaggggttttaagggtcaggaaaaccgattatgacttccatttcgatgaattccgaaccccggacacgatttctaacaataaatcgaaaattcatttttaactaaagttcatcttttgttcctaaaaacgctttttaggggttttaagggtcaggaaaaccgattatgacttcgatttcgatcaattccgaaccccggacacgatttctaacaataaatcgaaaattcatttttactaaagttcatcttttgttccaaaaaacgctttttagggggtttaagggtcaggaaaaccgattatgac

SEQ ID NO: 42053 - DNA, 1341 bp, Heterodera glycines
ccataactttgttcatattcaaacaagtcctaattttttattacgtatcattcaaaagcacaaagtcttaaagtctcagcgtttagacaattgccaaaaaagatatgattatttaagtattaccttattctgaatttgtgcttttgaatgatattacaaaattaggacttgttcgaatatgaacaaagttatggtcgagaaattcatgattgctagttgattggactcataaagtgcaatagaacccgggattttgcctaatccgggccaaaatccaatctcaaaaaacctggattgattgaaagctttcaataatccgaaaaatccctaattcttcctttttagcctttctttttgactttccattgactgtgctttttgtccacctttcgtcttcaattttgttcatccaaaatggcggaggaaaccagcaaaaccagtgaaaacatcgctgaggacaacggcatcaaagtgctcgactctttgtttgccgccgtcgcccacgcctcaaaatgtttggcattcgctgccggcacgcccaacttctgcttggccacgcccgccttcctggctgtcatggtacggcctttcggacacttcctctatttttaggggaggatggtcagtaataaaatggtgttttcgtaatttagaaacacttccgctccctcctccttttttgggttggcaaataaaatgccatcatttcgctgtgtgatttaggcgctaggatttctataaattgtaacctttgacacgtgcgcatcagaaattaaccccacaaactgcggtcaaatttatccttgcaaaaaatgttggcaaattcggcggttgcgcccgaactttttttttgtcggttgagtaagccgaaaaatggaccaccttttttgttttggcctctgttcaaaccgaaagtaacacaccaatttaaaaaatcaaataaatcttcggaatgaatttccccattttccccaaaaactctgtttttctatttttaggtttggtgctgtttcctcatgccggtaatggtcatacggggagagggcatcatttgaattgagtcgaaatgcgttttgtttcagcctgtcgctgtgcttttccgcagctatcgccgcgacggcaacgcgttcactgtgcaggcggcgtacaacgtcattctgtggtgagggggcgggggaggaggtcaactgcatctgagcaaagccataagttatatgatttggtatctatcaaaagctatggtctttttgaaaaaaaaaacgattttctttctaacaataagcaatcgcaacccacataggaggaaattttaaatttattggatttgactaaaaataaaaa

SEQ ID NO: 42054 - DNA, 1040 bp, Heterodera glycines
ctgttggtaccaattttgcggtaaaaaaatgagaaaaaagagataaccatttttggtcaagaatttttttttttgcgttttaaatatcgtaagattgtttgatagggccagacaagagaaggcaactgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaagagataaacattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaattcaactgttggtaccaattttgcggtaaaaaaatgagaaaaaagagataaccatttttggtcaagaattttttttgtttgcgtttcaaatacagtaagattgtttgatagggccagacaagagaaggcaactgttggtaccaattttgcggtaaaaaaatgagaaaaaagagatagacattttttggtcaagaattttttttgtttgcgtttcaaatatcgtaaaattgtttgatagggccagacaagagaaggcaactgttggtaccaagtttgcggtaaaaaatgaaaaaaaagagatagccatttttttggcaggaattttttttgtttgcgttcaaatatcgaatgattgtttgatagggccagacaaaaaaggcaactggtgggaccaattttgggggaaaaaaatg

SEQ ID NO: 42055 - DNA, 652 bp, Heterodera glycines
  misc_feature (7)..(7): n is a, c, g, or t
aaaattntgaggttcacgctccttacatgtgctaatttacggggaaatgttgcgcatgggagttcgacctgagctgatccgccagggaaaccacctgctggagatgaaagcacgaaagcgtggtgccatcacaaccacagtgtttcgggacaggcaaaaaattgaaaaaatgaatttattttaattttcgatcactttagctacaagctaatcccgatcaaactggccagctttgtcaagacgttcggccttgaaatcgagggggtggacaacaaaaagtattttccccacaaatacaacaaggtcggggggggggggggtgaaaaacaagaataaactgaaaaatcgataaaaatacaggctgaaaactatggcactgtcctggacaccctgccaccgatggaagaatactaccccggcagcctttttccggcagagcgcacgaaattcgagcagtggtacgaggagaaccgggagacggagtttgacctgtgcgaggtgattgccgattactgcaagacgggtaagaattttgaaaaattaacttccagaattaaaaattttaaagatgtccaaattttggcccacggtctggtgaagatgcggcaactgtttctgtcccagaccaagcatgacatcaccgactcgatca

SEQ ID NO: 42056 - DNA, 843 bp, Heterodera glycines
  misc_feature (802)..(802): n is a, c, g, or t
aatttgatcaggctttgttttgctcaattcgcattatttatggcattttgttcggtttagtcactcaaaatggacttaaaaaaggaaaagtgccaaagattgggtccattttttaaagaaattcactcaatctaaattaattttgcccatattgttttttttgaatggactcaattttcatttattttggcatatcaaaaattttaatgccttttaagtgaagtaaaaatgccattttttgcagtaaatatatgaaaaagtaaacagacgactgacaagtgcctgacgacggcggcagtaaaagacaacacgccaaatgtacacacccataaataaaaataataaattctgtgtgtattggggggaatggggcagtggaacgggaacggggagggggcacaaatcggggggacggggagagatcggcgggggggataagcggggggaggagggggaagagaagggatgtgtaaagtgaagaagcaattcaggcggagggtgagaaccaaagttgagtgaaaaagctggtgaaatggaggataagcaaaaaaaataaaaatttaaatttaaaattacaaatttaaaaaaacggatgggatgaaaaggactgggaatgggatggatggagaaggggacgaacaaatgggataaaggcagataaaggaacaccggaaatcccgattgaacgaccataggaaatttcggaattctcgggcctaatctcaagtccgatagctcatgaaatttccctatttttcggttccaacccaagttctagcctggttactttcctgattcctgngactaatcccgagttttctgatatgctcgaaaaactctcga

SEQ ID NO: 42057 - DNA, 835 bp, Heterodera glycines
attttagctcgaaatggctgacccattgaatacccgcgggtcgactcttttccaggcaatttcccccgaatgctatgccaattcgggcacttttgcgcacattacgggattaatgccgtgagtatttttgcgcactctaaacattactttacttttaccattgttacttttacagtaatcacgaataccgtttccgattggccgcaatgaccgccacgggtgatgtgctgtactccgagccgatctctgcgcgcacccgacatgaacaggcgccagtggtgtacaacagcaaagaacgacgcgaattggacggaacacatcatcaacagcagcacaatgataacagagtagggaagagcaaaataaaaatgagcaattaaatcacgagtgggaaatttaagggcactttgacttaccaaacgaccccacgtacgtccatccttggccacgactcggctgaccatcatccgccgcatcatttgttcggccaatcatccaaccatatcaaaaaattggcggtctcctccgttcaatcatcgtctaaaaaacagcaaaagaatgtgcaacaaaaaccaatcgcaccacaactgtcagcggaagaacaaccagaagaaactacggcaacttccagggcgatgttgccgaaagcgccgaactgttcagcacccaccttctcggcattgactagtgaaagtgcacgagtcgcctggaaattggtcaaatccgccgaagatggaggaacaaaggaactgtcaccgaaggtggagaaacaaaggaaaacagccaaagcacgtcgtcgacatcagcactgatttcgagcttcaagggtggacaa

SEQ ID NO: 42058 - DNA, 1312 bp, Heterodera glycines
  misc_feature (741)..(741): n is a, c, g, or t
gttgtttggagaatgccgtgtaatagaaagcagtcgaagttgagcggatttaagaagaatggaaattttcattggggattttcatccaagagaatgaaacaatgggagtaagtcgacgaaaagtctcttcactaattttatggagggggggggggaggattttccgggtgggaaatgcaatttcgcatatccatgccaaacacaaaagtttatcgtggtgcaaaaaaacctccagcttttgataggtacaagttgcccctccaacggtttcaaaataagttatgtaatagggggggggggatctttggtcactgacttttgtctccgtcatttgtcccctccccccagcaaaatcattcatcggaaacgagcctttgactttattactgtttttaaagaataaagcgattaatggcatattattttgtaattttaatgaatttatttatgccagcgacgagcggaagaatttaatttaaaaattattattaatatagtcattaaggcctcacattcaagtgtcatttaatgttgaaattaagcagtttatatgcattttccttgttttttaagtattgccaccggaaattccgcgccaggaaaggggaggggggaaagcacggattggcatttacggttccctgcttcggcactattttaagccgaaggaatgttttggtgcgatttttggcatggaatagcaaaggcgcaggcaaaagtaatcagaacgatttgattttngaaagtaaattgataataggaaaaacatcacacgtgccgatttgtcttaaataggggttcgcaggtgtccttatttctaaaaacgcgaaaaacagcaggctgtgaaattgaagtccaaagccttatatatttgaagccttttatccttattttgttttgcaaaggcgctttaaatgcattggacaaataaatacatggaaaaaacaaagggtgtccccaaataacaatacgccgtgccaaccatcgcctttgggggatgcccgcggggtcacaccgacaggtgacaaaacgccgacgagaagcgccttttaaaggggtcccatgtaaaagcaatgaatgattccttttgagggctatggaaagagcgaattttgttttatgggcgggagcgaacaaacatatttatgtcgtctgaacaatttataagtatttcctgtaggaaacaaatactttgttttgaaatattaatttttgattggttcttccttttccggacgttgggatggccggaaattaaaacgaaatgatcaacagaaaatttactaacaaatgtttgcactagaaaagacaa

SEQ ID NO: 42059 - DNA, 471 bp, Heterodera glycines
ttaggtctatcaaatgatatcaagaattaaaaatttggttgcttttgagcaaagctataaataatttttcgacaaaaattttcataatgatggtttttaaataacggctccgcccccttattttaaccaaaggagcatcagcggagacggggcgtagtgccggtgtcatggcaactcgtacaaagtttaaatgaatgtggccataactttttttagtcggccaatttcttaaaacttggtatcattcgaatgcctttcatgcttagaagcgttgattaagcagaagctaagtgattaagttcatctcacaaagaagttacattttaaagaagattaaaaattcacaaaagcagacctttttgcaatttataaattatattcttttttgtgagatgcttaatcgcttagcttctgcttaatcatcgcttctaaacatgaagcattcgaatggtacaagttttaagaaattgg

SEQ ID NO: 42060 - DNA, 918 bp, Heterodera glycines
aaggaattccggcgcgcctgccgcctgggcgacgcgggcgccgcctactcaaaaaagtcgatggaaaattggtcgacgatgggcggcggcggtggcggcgccgcgccatcggtcgccggcgtcagcgccagcggctgcagcaccgcccagcgctcgccgtccgccgccggcggcttctatcgccagtcgccaacgcccggcgcagcgaccgctacggcgacaacggcgcgccagcagaggccgctggcgctgccgtcgctgtccatgcgccggtcgccgcgccaaaagccggcgcggcgccaacctcaaaatccgcagcagcaacagaataagtggcgactgttgtcccgcaaaagtacctcaatgtcatgccattcggccttattatgagagagagacaaaatgccaagaattttgaatttgaaaataaaaaaaacattttattatctctcttttttgtgtacaaataaatatatgtgtataagtactgagttaaaaagtgataaactgataaattttatatttccatccatcttctcgagagaatatttattaatattaattaaaaaagaaaattgcaatgtcaaaactctcaatttttcgagtttttaaccggttcaaaaattggttaagactcatttccctaattggagatttgttttttcgtgtttatctactcgatacaattattggtaaattgttcaaatgcatttgaaaaacgctatttcactcgcaacttttcaaattttttattcatgtacaaaaaaaccgtgctgggtcgtttcgtaaaaagtgccaccttgggaatgtttcgtaaaagtgccaactattttattcgattttgataacatataaaatgaatatataaaatatataatttatcaatggcaatttttattttttatctgtgcaaatacg

SEQ ID NO: 42061 - DNA, 1318 bp, Heterodera glycines
ctcagattcatgatcattgatcagcaccccaaaaagacagcgggacttggagattacagccccattgtttttcacagcgcgtagacagaaaacttttttgaacactcttaagttgaaatgaagaattttaaagaattaaatgttccgacggtgagacggtatccaccgaagaattttttttttggaaaatttaagaaaattttaagagattcttgacaatcagctaaaaataattaattcaaaaatggaagttgaaatcaatttgaaattgtttagtacggattggcggcggtgatggtaaatcagcagatccaatgggcacagaatttaaaggcttatatgaagaacataaaaaatccgaaaaagctaggaaaaaatatttaaaaaatcagccaaaacaaccgattcgtgcagctgttgcaaatgaattttcgagacatagtaagaaaaattaaaaaacaaaataaaattgtaaaataaaaagtttgaaaaaattgggtattttaaatccttgattattagagatcggatacggaccagatccgtatacggatttttacggatccatagtccgtatttttttcggccgatacggattttttacggacaacagttttccctggtttttagtccgtaatccgtatcgatatcaagtccgtaatactgatactgatccctattttcgcaaaattccgatctctattgattatcaacgaaatttgtttaaaaatgcttaaattcatttttacttaatttttcttggattacatggtggttgaatataccaatggacttgaaattatttatgtatttttattttcatttaaaaaaatattgctgatttttattgaagaaattttcgggatgaagaaatttttaaaagcttccgcaaaataaaaagtgactttttttacttttttttttgctttttaatttttaatatattttctggtttaaagaagataaaatttaatttatagataaattttcatattacagtttgtttgtttttttataaaatttagatatattttttttgtataaaaaataaaattttaaaaaacaaaaaaaaatgaagaaaatcaatttttgtatagattcctggcgcggcaattttatgtaaatccggtagacgtataggagccggtgactttaaaaaaacaatttgttgattaaaattttataatatattcacaaaaaattcttaaaaataacccgtttaaaatctaattgtttaatttgtaaaactacaaaccgttttagggtgtgcttcttataaaatgtccactttcgttgccatggaaaatgacctgccagg

SEQ ID NO: 42062 - DNA, 1233 bp, Heterodera glycines
  misc_feature (13)..(13): n is a, c, g, or t
tgaggagttaacntccggagccccaaacaacatccacactcaaaacacccgttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagtgaagaaacccttcaaaccactaatatgggcaagactgtagagaaaattttatcgaaaatttattttaatttaaaatctccggcaagttttgctggaattcaaaaaattttaaatgcggccaaaaagattgacccgaaaattacgaccgatgacgttaataaattcctagaaaagcagaaaacatacacgattcacaagcccatcaggaaaagattcccgagactaaagacgataccaagtggcttccataccgattaacagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaagcttttgatcgtgtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacactgggagccaaaccgtcttcaattaattttgaaaatgcccgtgcgctctgggaaaaattatataaggagaaggaatttaaaatttcgaaaaagaacaaatttaaaattggcgatatcgttcgaattacaaggaaaagggaaaatttcaaagggatacctcccaactttaccgaagaattgtt

SEQ ID NO: 42063 - DNA, 990 bp, Heterodera glycines
tagggaagctattcccgaaagattcggtctccccctaattctgggcgcatcgttcggggggactgccccgaaaacaaaaaaatcgattttttcaagtgtccgtttgggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattcccgaaggattcggtctccccataaatctgggcgcatcggttcagggggactgccccgaaaacccaaaaaaaaattttttagataaaaattatttaaatgaactgactagataatacctagaagaggttatttctcttcctttcagtatccctgcaa

SEQ ID NO: 42064 - DNA, 1101 bp, Heterodera glycines
gttgtcatgacaccgaaaaaggcattcaaaatgagggagactatgtataaaaagtacattttacaaaaatgttggaacttgtcttggtgtttttcttggtactcgccgttcaacaacaacaccatttcacatccgtgccattctcagctgttcctcggcatccaacgcgcccgcatcgcacaccaccgacatttgctgggattggttgaccacgacgtcatcgatgccggcggataatgccgttgccatcgtctgcggtgtggtggtgccattcagaattgagcccgtgttcaggaatcgttggtgcaacttcttcacttggtccatttgcggtggctccatgccgaactcggcccgatatcttcaaaaattggaatatgatcaagagttaaaaaattaatcattatttgtggtgatcagggatgtgtaggaatgccggtttcaattactgagttccaacatttttggcacggaatttcgattgaatgccgaaattttttgagctatcggaattccatgataatattgagtctccatggtcataaattcgagaatgccaaaagccccgcccaaatttatgtaaatttaattagaatagtcctaaaatcgtaaccaattattttatattgtcgaattactgtctgggttttttcgaatcaactgaaatggatgtcataccgaaattccttggaatttaaaaaattcctaaatttttgaattgggaaactccaaattccactgcatcttcttttccccatttgttgtgccatttgactaccttcgagcaacttgcgcaaaggaatgcgtctcctcaaaccagcagaccaatttgaccttctcaagtacactcagcactcgtgcccctttgttgatcgccgctcgtgccatttgatgggccattttaattggattttaaaaattcgaaatatttataaatttaaaggttgacgattttggtaattcgacgacaaaaaaatcgccataacttttgtcaaaatcgatcaaattaaacattcaaagcaatggaggcactcttatctattgtacatgcaaaattcaagaaaagttacatctttaaaaaagttatatgtaagtacatga

SEQ ID NO: 42065 - DNA, 714 bp, Heterodera glycines
caatttttttaagaaaaaattataggtttactttctgcgattcatttagaagtcaaaattaagcagtacaaaaactaattaaattaggaaattggaacgtcaaaaatctgtctgccgggggaatcaaactgctttcttaattttcagcccattaggaaggggcattaatagaagaggagggtccctaatggagggaaattttatttttcaattttatatttattaaatcggcacaaaaattacataattttttaataccagcaacatatgtatttgcctatagagaggcaagtagagtagagaagagaacagagtgtgacagacgaatgagagagtggaggagaggctagtagagcctgagagaaatagtgcttcatagacgttattgaagagagaatagaggaggagtgaaaaatagagcggaaaagagaaagagcaatttaattcgctattaattcagtttatagaaaacttattaattaagaattcagtatttctttggaatttttgcaaaaagttttcggaattcctcggaaatttgaattttttttatttaaccattttatttttttgaatttttaaacatttcatgaatttaaagattggccattgcctgcactggtgtggctcaaatgcgctggtttacttggcccctgcggtgtccgacttttacaaatgccaagaaaaattggtgggacaccaattagagttttt

SEQ ID NO: 42066 - DNA, 1171 bp, Heterodera glycines
  misc_feature (1163)..(1163): n is a, c, g, or t
ctactccctattattgtcctatggaaataatcaaatccatagcagaacgcacgctacaggtgtaaaaaatttttttttcctttgtaaatttttctaaacaaactttttttttgagagagcggaggaggccttgggcgcggagacgaccccgctgggagcagaactggaaaaactttgtgcaaacgccgaacggatcgcagtgcaacaggagaagctcatggaaaagatggaactctacaagcaaaaactgagcagcggattggcacatggcacagcaatgctggtggcgtccaaagtggtcggagagcggacacccttcggagaagccctgcagaagacggctcaaactctggcagctcttgacgcggcgcgacgacagctcagcaaaagcgacgtgaagctgggaggcaccaccacaacaatcagcgctatccgcgtgagttagcttgttttgtttttgttttttgctggtaatttcccattttcagaaacaactggcactgctgcagacgaaacgcttggatttggacgtcttcaaagcgaaatttaggcgcgcatcaacaaccgaggaaaaaaatgccgtgagaatgttttttgttgttgttgctgctgagttcacgatttttcaatccttttcagattcagccccaattgcaacgagcacagagcgagttcacgcgccttcaaacacagctgaaggagctcgtcttggactaccagaagaatatgcagaacatgaagaagagcctgctggagttcgtggaggcccaaatcaaattccacacgatgtacgtccaagcggcaacaacaacagcaccagcaaagccgatggcagaagctccgagaccattccccgacaatttgatccaaaaaattgtacggtcgaaacaaatggagtttccgaaagaggtgaaaaagcgagttttgcattgtcaatttcatccctttttgcaggtttccagcggagaaattcaacaactgtgcgctgccgcaactgacgccttcaaacgccaaccatcgctggtcgaaatccttccgcctgttatggtctgcggcgacgtccacggccaatttcctgacttgatgagaatcttcaactgcctcgggaccccgccggagaagaaatacctgttcctgggcgactacgtggaccgtggcgcgcnaatccgtg

SEQ ID NO: 42067 - DNA, 705 bp, Heterodera glycines
cccccccccccctctccccccccttacgctcgattccgctctttctccacatggatgccgttttcgccactgcctgaggccaaattgcgttaactttgccccctaaacattcgccccccggcgacttcccccgccctccgccgcccattccttttccatttgacaatcaacggccaattgttcgtttttaagcaaagagattagatgatgaccagtgggcggaagaaggggcaaatgggctcagaaagtgtgccaagtgccgtggtgatggcaaacacacaaattggaaattggacgggagggaaagaggggggggggatggcacaaattagggagtattagggacaaatagccaaatgaggggaaactctgtcattaagcaccattttctgattgattggcatgtgaaataaatgaaattataacactggcagccattggcatttgccattttcttcgtccattggtcattcgtccgtctgcgccgccgtggcaccgcccgccatttgctggcggcgcggcaacaaattcttctgctgccggtggcgataattattatgctcatcatcgcctcatattgccttggcggacaattctcaaaccaattgagacaattggggcgaaagctgaaaaaggaaaatgagacgaataaagggaggtaaagaacaaattaaaggggaatggaaactgacgcccggggggggg

SEQ ID NO: 42068 - DNA, 597 bp, Heterodera glycines
taaaaaaagaaaaacgccaaaatagttgcaaaaacatgtcaataaatgtgtgaattttctaaaatttccttatttttgtccttttcggttgcacaattgtaaatcaaacacatttgaggattttcaaacataaaaagttttcgtttgtctgccaaacatggccaggatttttgctttttttaaaaattgattcataaaggtccatttttgttttgttttttattgcatttttcataataatttttagagatcgacattttgaaaaaaacctggacctggacctggattccttgttggacctggatttcctggacaaaaatccaggaaaatccaggtccaggaaaaatccaggctcctcgagacgtggatccaggcctggacctggattttttaaaactcattttaaaaatcaaaaaaatgtttgaaatattcaattaattgcgtgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctgga

SEQ ID NO: 42069 - DNA, 1677 bp, Heterodera glycines
  misc_feature (1567)..(1567): n is a, c, g, or t
  misc_feature (1574)..(1574): n is a, c, g, or t
  misc_feature (1600)..(1600): n is a, c, g, or t
ttttgattttaaaaatttttgtttaaccccttactctaaatggccattttttgctggggaaatccccaatttttgctggggtagcgaaaatgccatcggtcacatggaaatgcgatgaaaggggcgaaagaatgagaggaaagagagagagaggaggaggaggggggggggggggtcacaattaaaatacgattaaaaaaagttgggataaatatttattatataagggaaagatgaggaatttaataaattaatttaaaaatgcacatttatttcaatgggataaatttggaagggatatttttgaaatgaaacggagccaatgaatggacagagagagggggggcggggcgggggatttaacggagagcacaaagtccattaaaaagcaaaaaaagagcccgccaattttcgctaattttattttgcacaatttctgttcatttaaattttgcagatggacaaacaaaagaaacgaacgaccgaaaattatgagaagggtgagagagaagagagggacagcagcagagaagaaaaggacgaagagagcggaggaagagcgaaaaagagaataggcagagaaaattggcaaatcccagcggaaaaacagacatttttgaaaattaatttgacacaaaaaggagaaaatgccattaaacaatgacaaaattaaaatgattttgaattttattaacaaggctttttagtttatttttcggaatatttaatttaactaattttattgacccccaattagcgacagaatttcaattaaattaatatattccacttagtccgttggttttgatttttattttattatacatcttaaaaacatgtcaaaaatgcaaattaattaattaaattgggattttcccccattttccatctcccatttggccatcacataaatttgcatcgatttgtcttctcaaaaatattcccttccaaaacagaaattgaaatgccccgcagatgtgaagtgtaatgactccaaatgttcacattgttcacacattcctgctcggtcagctcaatttttgtctgaaaacgaattaaatttcatttatttattttttaattcaattaaatggaataaaaatagcagataatttacaaacatttaaaatttagagctgataattaacattattgagtttttatggcggggtggggtaaagaaatcatttgctatttgtaagggaagagattggcacaatccccgccttacggcatatgccccaattagttaattgccaaaaaaatttgccaaaattcttttatatttccacgcagaagtgagtgaattgtccatgcttaaactgtgcctgattgatgggacagtgttggatggacgggcatttcctcttcaaattcttggctcggtcttcgtccggcgtcgacgccaaataacagtggacgaattcgccaattaccgactcctttctcggcaatcgttcactaattgcctccatcgatttgttttgtctgtacaaaaagtccgaaaatgctttttcgagcagtgcgccgtcaattcgcaatttatccgctgggaaaattggcttanattttanacttatgaaattttattcttttttanattctgatcacttttttaagccgtaaatgcaaaatgaatgcgtcgctttgggggactccaatttcacggaagccatt

SEQ ID NO: 42070 - DNA, 1123 bp, Heterodera glycines
taaacaattatgtttcgttgttaatttagtaaaaattatcgttttatttaacaaaaaatgaattaaacaattaagaaatatccctttattcaaaatttgttttatatttatattatttatttaatgcttttccaaaataaataaaattatttgactttattaaataaataaccaaagaatctcatgattaattaaaaaaagaatacgttaatttttaaaaatttttcccaatttctttaattttttttaaatgttaattacccctattttacctttttgtgttagcaagcagtccacccattccaaaacataaaaatgtaattgaatacctgtaataattatgatgtcatcccaaaatcatttttccattaaacgaaattttagattcaaaaacgcaaaaaaaaatttttttaatttttttgttggatgttttattaattcaacaccacacacacacccagcaaataatgatgactactgcagcagcaatgacaacatccaccacaccacagctacaacatcatcatcatcatcatcaacagcagcagcaaagcatttttgcccggctttccgccaccattggccaccacagtcaatcggaacaaaaattggcacgaatgagggccgcttattctggcgccaacgaaggtggcggcggtgccagtgccaatgccaaaatccaaaaagccgggtaaggagatgctgggttttttggaaatttttattagataaatgaattttgctgagggaaattgaaaagcaaaattagattattttatgtgattttttttttgtgaattttttttattaataaatgaatttttaaatgtattttatgggaaaaagcgaaaagaaaaattaaatttatgtgaataatttaatttaattttagttaatgtaaattttttttttttatattgagagttttaatcttacaagctgaattaaattaataaaataaattaaattattatatatcatctgcattaagtaaccgaaaaagcttggttaagtgaataaaattttgttttaattcgattttagtttaataaaataaaatatttttcccttttaagcttgaaattgtcatctgatacatccaaatccccttccatcacttcca

SEQ ID NO: 42071 - DNA, 1105 bp, Heterodera glycines
tttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgtttagtttatgcactctgatgcttttttctttcaaaatgggaggggaataaaattttaattgcttttttacttttgggaaaaaaagtttaggttaacttttttatggaaaagtttgttcactcttattttttt

SEQ ID NO: 42072 - DNA, 871 bp, Heterodera glycines
tgtatgtgcgcggttgggtggtgctacgggcgcgcccatccctaatccgtccgcgtgcggcgcgccgccgccattttggactcagatatagcattttcctcccccagtttattgcttggtgaccaccacagacagatccaacgttgtttttttttttttgcgttgtcttgtccagcattttggacagttatccggcacacaaattgatcaaaaattgttttctatggcccgtgccggaattttgatgagcgttaatcaggtggatgcatgaaaagcaaaaaaaattttttcttaaaaacgaaaacaaacgaaaattaaaaaccgaaaatgctaaattaattgaaaattttacatttgaaaagtcgaaaactaaagtttttgatggatgaaaataaaacacgaaaagaaactcaaatttgcccaaaaggggaggatgagataaaaaaaaaatgaaaaacgaaatttcgtccatccctgggcccaatgtgtacagaatttcgtatttcttgacacattttattttctggctacctgggattgcaaaaatttgcaataaatttcacaaagtttgaaaaaaatcattttcctcaaccagtattttttttacaaccttcacaggtttttaaaacttgaaaatttcattatgtgaaattttgtttagagaaaaaaaatgtggttttttttttaaaatttgcacgtcaacgaaatattttaaaatttgcagactgataacttttataccaattattttcctgaaaaatttcaagttattctgtaagaaaacccagcttttcaaacctaacaattacacaatatatatattttttaattttggtcttaaattttcaaatgactcattttccgtcagccc

SEQ ID NO: 42073 - DNA, 310 bp, Heterodera glycines
tgcttatttttccttttctaaattttagtcattgaattttttctgctttcaatagttaataaatactgaataaattgttttattctttttaaaaatgaattattgtagacgcttttttcgcccgatttctcgcgttcttgtaactaattcacgtttctctgcgtgccgaagatcttattatgcaatttggtttgaatatatatagaattttaagaaagaattttcctaaatttaaaaaaataataatttgttttcttactttttctgtgtttaaaaaaacaatttatttattatttgatatatttaattt

SEQ ID NO: 42074 - DNA, 1231 bp, Heterodera glycines
  misc_feature (21)..(21): n is a, c, g, or t
tttttgttcaatgtccttttntaggttattttccctctgtcgtccatttgcccacccacgaaatgatgccgagcagtcgtcgcttttccttgctccttcgtccctctatttcctcttccacttgtgcccttcccttttcgtcgccttcttccaaatcgtcgattttcttcctcagttcggcgattttatcgtcaaaatgattggaaactgtgaaagttttttggcacttctgaatgatctcagtcctataaaattgaaaattaatttttgttagccaaatttggttaattttgaagaacccatgcaaaatggccttattggggggctaacttagaattagtattcatttggccctaattagtacccatttagccccaattaaagcccaaagattgggctttttctaattaattccccggattgcctgaagctcttctccgtcggctgtttgtctgccatcgccaccttctcctcctccacttgctttttgcacaaatccgaatataatggacaaaagtggggctcttccaccgctttgtcaaagatcagatcaatgatcatctgtgaggataacaatattattatgattttttagttttgagacagcgaaaacctccaaaagtttggggtcttcgtggattttgtatttgatgaattcctcggataagtctttgtaagtggacggagtgactttgttgagcagtccgcgcatttctttgcacaacttctgaaatttcatcgaaatgaaattgttggacggattgaaactcagagactccattctatggaatttgtcccgtgttaaaaattttcgaaaatccaactgtaattccaatgaaatggatttcaccccaacattcgaccaaatatactcgacaccaattaagaattaatcagttggaattcgctcggtgccgtgccctcccccccccccaataattaattgcccacctcatatttcacttcttcatcatttctttccggtgcgttcatgtcaaaacgttcctcgcgcttcggcttccatgcatttgccgatctccttggcaaattgtcggccacttgcggactgccgctgacctgcgccaatttgattggtcgttggtcgagcgattggcgcgcaattgggccctaatgaggcgggagaggggaggggtataattaactaatgcatattatcaatattaattttttgtgccaaaattcgaaaatgtagcaattttttttctctaaa

SEQ ID NO: 42075 - DNA, 763 bp, Heterodera glycines
atctcacatctggttgaacgttatttgttgtcatttcacaattttcgattgttttcaacgcattatttggattttcttttggtggattgtcttaagttttattttgtctgccctcaaaaggaaagggctgatgaagaggacgacgaagaagaagattgatttgtggcgcagctgcgaattgatgagtaagctgaggaagagagagagactaatgatggggaggggagggaaggggaggggaaccggttgaatggtggacggactcaaaaaaggaacggaggcgggggctcaagagggagggggggggacgaatggggcggaattaatgtaatttatctccacggtgattgaagtttgcggacaaagacatttacataagattaaagcgcatttcattcgattcaattgttttggtgggaatgatttcgcatttatgaacggacggtgaacatcaaatgcatgcgaaacaaaacatttaatgggtttcaattgcatcctcccgaccctaatatgtaaggtaattgatgaattaagtgtttaaggttaaaatttctttgctttttttctccatgtttttccttggcccataaattctcaaaacggaacagaaattaaaaagccctgaaaacattttctaagaatttttggggttgctgatcacgaatatggcattcatttagtgaattttgaaaaattcgaattttcgactttttgttcgaattcgggtccagggttcgaaattggcttaaatgaatgccatatt

SEQ ID NO: 42076 - DNA, 926 bp, Heterodera glycines
  misc_feature (777)..(777): n is a, c, g, or t
  misc_feature (904)..(904): n is a, c, g, or t
agaaaattgtcctaaaacgagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaacgagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaacgagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctanaacgagatagccatttttctgagaattaattcacaatttccgcagctcttgcggtaatggaaaaaattttgaagaggctctgcggaacagattagcatcggggttacgagatagaatattgtcctangacgagatagccatttttctga

SEQ ID NO: 42077 - DNA, 882 bp, Heterodera glycines
gggagcaaaaatcccacgcagaattaaagtacaggctatagggaagctgttccggaaggattcggtctccccataaatctgggtgcatcggttcggggggtctgccccgataacaaaaaaatcgattttttcaagtgtccgtttggtgtactcaaacaattatggggagcaaaaatccaacgcagaattaaagtacaggctatagggaacctattccggaaggattcggtctccccataaatctgggcgcatcggttcagggggtctgccccgaaatccccaaaaaaattttttggataaaaattatttaaatgaactgactagataatatttataataggctattcctcttcccctctcccttactctctctccccctcctctctatccttccctcttcccctctcccttactctctctccccttctctatcgttccctcccctaaaatttttttgaaatcgtccagaatatttttgtttcgcaccgttcccccccccccccccctccgttgaagcaacattttcaatgtgaccaacgcaatgtcccagcaagtgtggatgttccagcgctatgagcaggttagcatctttaattcctcccccattaattaattaatgctttccccgtccttccgtttgaggttttggagtataaatccacgcccattttgcctcctccggtcactcctctcgctcaccttttaatgtttgtccgtcgcttcttcaaagtgagtggcatgtcaattaatttggcattcattaccttccgaatagtcaaaacatcgtccgtcgtttcccttttatttgtcaaatcgtcgcaaagagggatcatttgcattgagtgagttggcaaaacccaaagtcagtcggggggggggggg

SEQ ID NO: 42078 - DNA, 1305 bp, Heterodera glycines
ctgaacctggtccaattggaccccttgattttttggacaaacctgacaaaaattcggagtttccataaaaaatctagccacgataaatccagcaggttcagaacggcctctattttcagacccgtattcagtgggaaggttgtctccgaactttaaaaaattcaagcaaaattaaaacatctaatttcataacaaacaacccttaaaatttacgagaattttctgcattgttggcacggccggcgaacggcttaattcctttaaatactcgaatttgtaattgaagaatatttatgtacaattgtcagggaattttttctgaccaatttttgaaaaaagtaaagcaaaaattatgaagaaaagccaaaaaaatttttaccggattttgtcgtccttccgaaaaaatggcgttaatttttttttcgtattaaaattttttgcgtccatttcagcaccaatcgcttggcgcaccgtacaaagtgcagggctttccgaccatcaaagtattcgggcttgacaagaataagccgacggattacaatggtattttacatcactttttttgtttacctaatcatttgtggcctcataatttctctttttttttgtcttaattttttcaaatttttgttgggtattgtgtttttgagttaattagctaaaaaatttaccaaattaaaaaaaaacttttcgtctttgaaaaatacaagtttttaaaaaataagtgtaaaattttcagggcacaggaaaggtggctgcacaagattatagaaacctgacttttgaaaaagactaaattgggctggaaaatagaccgggattgggttttcgagattcaaatcccgattttgtcgggggtgctctttagggcgtttcaaaaaaccaagcctggtgatcccgttcgacccctgcaaatttagttatttttttcagtcccaaatacggtggatgcggggggggggggggagtcaaatggacccttggcatattgttgaggggtaaaaacggaagggtttcaaaatttggcataatacaatttatttcaaccccaggacaacgcagcgcccaggacattgtgaacgcggcggtcaacgaggtgaagcgggtggcaaacgcgcggctcgccggccgcgccaacggcggcggttaccagcaaaagtcgggcggcgccggctcaaacgcggtggtggaactgacggatgccaactttgaagtacgtattgaaaatgcaattgcaaaataatcgttacagggagggggggggggggtcattttttgattgctaaaaattaaaaaaaaatttag

SEQ ID NO: 42079 - DNA, 1326 bp, Heterodera glycines
ttcaattttaataaataacaaattttcgctaagaattcccctttttgttattaccagctgatcacccagaaaaacttgatacttatggagcaaaattattattgtttaaaaaccaattaactcaaccttaatttgattaagtgaagagttttaatggacgtttattaaagaaaacaatgataacaaaaaattcaacaaaatggacaaatttaaaagataaaatgaatctccaaattgtccagcctttccatctttcttaaggccactctccgatcagcctttgctcttcttctttttcttctgacccttctgctgctctcctccgctgggctcctccgtctcttcccttgccttcttccgagtcgcttccccctcctccccttccgtctcttccaatttgaccttcttttgctccttctccttttgctggtgttcttccgtttcttcctcccctccctcagtttctccttcgcttcgcattcgtttcgtccctttttttgcttttccactctgttgttcttcctgttgcggttcttcggcctgttcagttcccttttttagcgtcatgtcgaactttgcgtcataatgatgcacctccccccttaaaaatgttactttttatatgaagactaatttaacattaagtccaattggtgatggtgagttttcagatgaagaaaaattgaaatttaaaaacgaaatcaattgtatttagagaaacaagataaagtttcagtaaaaaactaacaaagggagcattttccccatttcgcgaaattttaagcataaccgaaaaccggggatcaatttctcctcgattgactcactttttgaaagtgtacgcgcccttcggtgcctgtttcacgccagaaaagcgttgctttttcgcccctccccgcgcgtccgcctcttttatcgcctgctctatgtacaccctcgcctcaattccctgtccgttgcccaatgattcgtcgcaaagtgcgtccactcgcgtcgcaagtgaaacttttgctgccaattttcgtgctatctttaaagacaataatgatttgtttgatttcttgttaagggtattgcgtttttagccgttttatgtttgtcacattttcgtctcacctttccctttgacttttgtccggcttgagtgaccaattgcgcgtgataaattattccatattttggcgtatcctttttagttttgagtgctcggaagagcgctttctcagcccccaaaatttgaactgtcgaagcaggacactttgccaaagccatcagcgagcctaaaaacaatagcaaaatatgtcatcaattggggtgcacttcgtt

SEQ ID NO: 42080 - DNA, 802 bp, Heterodera glycines
accgtttttagcgtatttaccgtaccatgcgaacactgtaaatgcatattgtgatgtttctgatcactttccatatgtaataatgagtagcaattggcccactttcaggccattctttcgcctctcctcggccctcctctcaaatcgcttcttctcgtccccctcccccgcttttcctccccctccgtccattttttcctccaattccttcacggcggcctttgctccatccctccgttaacttccgatgaaaatccgctcgatgtttgggagcttttcgaattgggtgcctttgttcggtccgaaatgttcgtcaaaatgttggcattgaatgtgcgagcaatggtaaaacaataaattaaatgctattgttaacactgcttaatttgttttagcttttccacttctttcatcggccttgcgtcgcctgcgtttcggccgtttttgacgctttgccaaaaatggaattggaaattccggtgaatgccaatttccctttttgtctttctctctaattgacttgtcttttacgtaaaaaggctctccgtgaattatttgacgaagctttgcgatggcaagcggccaatttcacgcgcatttggaagggtttgctgtcgcactttaagacaattaaatattgctcatttcggttaattgtttcaggccgcatctttttgcatttgtccgaccgttggcaaaggcactgtcgcgacgcccttctccaatcggtggacgaagaaaactttgtcgacgttttgcttggctgtgagaagctgcaggtgatccttccccggctcaaatc

SEQ ID NO: 42081 - DNA, 997 bp, Heterodera glycines
ggactcaacccaacagcattccaatcactcgggactcaacccaccagcatttcaatcactggggactcaacccaccagcattccaatcactgggactcaacccaccagcatttcaatcactgggactcaacccaccagcatttcaatcactgggactcaacccatcagcatttcaatcactgggactcaacccaccagcatttcaatcactgggactcaacccaacacagcatttcaatcactgggactcaacccaccagcatttcaatcactgggactcaaaccaccagcatttcaatcactgggactaaacccaacagcattccaatcactgggactcaacccatgggactcaacccaccagcattccaatcactgggactcaacccaccagcatttcaatcactgggactcaacccaccagcatttcaatcactgggactcaacccaccagcattccaatcactgggactcaacccaccagcattccaatcactgggactcaacccaccagcatttcaatcactgggactcaacccatgggactcaaccccccagcatttcaatcactgggactctcacccccagaatttcaatcactgggactctcacccccagcatttcaatcactgtgactctcacccacagcatttcaatcactgggactctcacccccagcatttcaatctctgagactctcaaccccagcatttcaatcactgtgactctcaacaccagaatttcaatcactgggactctcaccaccagcatttcaatcactgagactctcaacaccagcatttcaatctctgtgactcacaaccccagaatctcaatcactgagactctcaacaccagaatttcaatctctgggactctcaccaccagcatttcaatcactgagactctcaacaccagcgtatcaatcactgtgactctcaccaccagcgtttcaatcactgtgactctcaacaccagcatatcaatcactgagact

SEQ ID NO: 42082 - DNA, 51 bp, Heterodera glycines
tccggcaaagctttgcacgccaggccacgatttacgggttcgactccagca

SEQ ID NO: 42083 - DNA, 539 bp, Heterodera glycines
tttggaacaagcggagggctcgccgacccgatatctcgcggcgcataccatgcaccacacagtcactaatcggcgcggatttatcgtggatttttcaatacatcctcggcgattttggcaggcgaatgctaatgagaaagaaagagagtgaaaattggaactaaaagataaattttaaaaagtgggactaaattttcaaaagcaaacgaaaaatgtataaaaaaataaagaaaaagaaaaaaacaaattaagtcgaattttgcatgggtgattattagcccatggtggtatatgacaaacccatgttttcataaatttgtacaattattatttttgtctacaaaagtgagcgatgaccgtcacaatttttgtagtttatgggacagtattttgtggccttgactcccatttttattattatccaggaaatttctcaactccgagttgtgtcccagtttatggtgaactttggaagccattaggaattctatttgcctcgggattttcgccgtggagaggatttctactgtactccggct

SEQ ID NO: 42084 - DNA, 706 bp, Heterodera glycines
tagatcaattatttcttcttttctaaaatgttctcttcacttttcaaaaaatattttctctcaacccttccccccccccctccccattcttaccagtgcatgaaatctcgtgtctcgtgccaaaatacgagatatgagacgagtcgcccctaaaaatacgagattacgagaaacgagacgagcaacatccctggtatatatatcgctaaaaaattcatttgacttataagctacaaacaaatttctcaatttaagttaaattaataatattttacattataatatttttttaactttcgattatacttttcaatttctcttcaatatatatttttaattattagcttataatcaattatcctagtcaaaataattttttgttttttaatcagttaaagtggacatatttattaaaccaaattaaataactagcttagtctttacaaatccatttttctatcttccgaccccgtccaatagtagcttggacccatttattttttcttaacaagttcgttaaattttaaaaagtattacttaatttatttacattttaattttattcctctgttctaatattacaatatttcatatttacataaatttatttattagtcacatctaacatacgtaaaattgcttgctatttaaataatgtcttttgattatataagtattatctaaataataattattgcgttctaat

SEQ ID NO: 42085 - DNA, 1017 bp, Heterodera glycines
ggagttgctgctccacgccattctctgctgcttcaacgccgcctcccacaagtgaacgccggatgcattttctttggggtgaccaatctcattttcagactgagctaccctaacttcagtgcttccgaccaggaatatgtgagtgagaaggaaggcagaaatactattcaaattgagagatgcacccaaaaacctcaccgcaggaatttaaaatttttttaaatagaaaaaaattttcaaaaaaaaaacttcgtaatagattaggccctaatcgttcattccccctcaaatgtggcgggtggtggaacctctcctatctctgatctgtttacttggccctttgccacgcttttgtttctcagatttgtgaattggcactggtggtgcgcgacattttccgccacattccgccgtaccatcatcctccacaccatcagcagcagcaggagaacggaaggagaaagtacatggatttgttcttggagcatttgcaggagcaaaaggcattcaaaaaccgaaaaaacggagggatggcggcagtgagaaacactttgtcacaacagcagcagcagagacagctgacggacagatccgacgattaatggggggaggtgaaacctggcgaatggtcgtcagtcgactgtctgggatgtatgatttttcgtttttgacaaaaaaaatttatgatcgaagctgtcctatttcaagcttctgaaaatgatcttttattgtgcaaaatgtttgtgtaacataatcattcattttcctgttcctgatgtatggccattttctatatgtaaaaaatcaatgattttccgttttcatttatttatgcattgggatggatgtccgtccaacactgtatcagcagtgtctctaacaaatgaataaatcaaaaggtgattagaaggtattcagataaaagatgggtaatgctgttgatgaagtagttttgaaaatacaaaggagaagcgagaaagagagaacgtaaaaggagaaaagcattttcagtttaat

SEQ ID NO: 42086 - DNA, 1006 bp, Heterodera glycines
  misc_feature (902)..(902): n is a, c, g, or t
  misc_feature (945)..(945): n is a, c, g, or t
  misc_feature (970)..(971): n is a, c, g, or t
gcaaaaccgtggactatttcaagaagacgcttgtcgtggagggcattatttacgacaggcacaaaactaaaaaatgccacaaaaaaactgttgaaatttgcacagaattggcgaaggtgaagtgcggaccaacgtgttcacgctggagaaggcgaagaagaacgaactgttctcccagaagaagccgtccatcgccgctgttgtcgcacaggcgacgccgccccgttgcttttcgcaccaccacctgaacaacaacaacaacggcatcatcagcaccaacatggacacctgtggtggtgccgagacggtgttgggccgtcacagggcaacccgtggcagccgcaatcggtcgacctcggcatggtcgtccacgcaggagagcaccggcaccgagatgcgcaggtggtggcaaaaagaaagcacacagagagacggacttgggagggtgcacacgtacccccgtcctccgcagtttccccggtataccgacacttgcgccgccctataacccccatttgcacattcattcaaattccatttaactaattacttcctttaatgtgacttattaaatcttcatgatttttcttttcattggcacaaatttgcctttgctgctgatgcacgtattgacaaaaaacaaaaaattatggtgtctatcgttatgattagttgtttttttttgcatatcttttaattgctttttttgttattgcacgttgaaaattggtaatatcttaaaatatgtttttgcttggcggcgcaagtgtcgaggcgcaaatttcgcaacacggtttcccccagctcaattcatcataaaattaaaaaaggcttaaaaatttactaattttttttcttgaaaagttttaggttttgaaaattgaaaaacccctttaatttgngcatttcgtcgatggaattcggtgccattctttctgttcattntctctctttttgcagtgcctgcggnntccatgcgatgttttcccatcgtgagctcgactcc

SEQ ID NO: 42087 - DNA, 1287 bp, Heterodera glycines
  misc_feature (1244)..(1244): n is a, c, g, or t
  misc_feature (1273)..(1273): n is a, c, g, or t
gcttatcaaaacacgtacggcgcactttttttcaaaaattttggggaatagggcggcgggggtccagcggtgccataggcgcagccggggaaaattttaaaaagggcccggtgttttttttgaaaatttaccgggcccttcctgtctctactaacaaataagcagttttccaaacaaatagtcatggtatcgattttgttacgaatttactaaattaataaattacgatgatttaaaagaaataaaataaatttacaaaaaataaaatttaaacacaaaaaataaattggccaaaaaattgatcacctgctgggagagaaataaaaatgtggaaacgaaaagaactcatcaaaaatgaacacattattaaatcatttaaaagaaaacttaaaaattacaaaatttttaaatgattttatcatttcgtaaaagtgccaatttttagagattttgcgaaaaaaaactcgtatatgtttgcttaaactcaaccaaattaaattattttgatgtcaaaagattgcttgttgattgctctactggcacaaaaaaattccattcatttttcaaaaagttatggccaaaaattctaaaaaaaaattgtctcccaaaaaagtgaataatttttcatgcttttcgaaaaatcaatagctatagtatgattaccaagattatttcatttggtttcatttggttgcgtttaagcaaagttatacgagtttttttcgtaaaatccaaaaaattggcactttttacgaaacgacccagcacgtaaagaaacaaatgatttctgaggaaaattgcattgcctataaactgaagagacaaaaatcattcttgatattgtacaccatttttccgatttttctatttcaagtcttattttgggctttatttatttagataagcaaatatggaaattattggtcattaaaatatgatgataacaatcacaaataaaattgttaaccgacctaaaataaaaataatgcataaaaagaaggaacaaagcctggggtttaatttatctcacaattcagctcatttatactcaatgccttctttttggattgctaccgtactatgttatattgacactcggcatttgtttacagtgctttcgcgggttgatcttcggcatttggctactgtaccgcactgttttggcattcgatatttggttaccgtgctttggcatcttcgtgttctgcatttggttactgtttcgtgttttcttttacgactgngcgaagatgtcgcagtgattcgtccgctngttttgactctaga

SEQ ID NO: 42088 - DNA, 1173 bp, Heterodera glycines
attggccaacggtttcgagcactctttgcattcgtaacgcgtgcgtccattcacttgctgagagttccaaaattgatgctaaatgggggggggggggcggtgaagcggctaattgtccctccgttttcttccgctgctcactttttgctgttccgcgtctcccccgccgcgcattcgtccgccgccgctttgcctctcagcgccgctcgcggttggtctccgcgttctctgctggtgctgctgctgtctctgccgttgttcctccctcgcgcgttcagccgccgccaccagcgccgcctgataagcgtgcagcgaatgacgcaattcggccgcaattgacgtgccgttatgatgcgcggcgccgtgcgaatagtgcggcagcggtaccaacgccgtggggggcgcgggcggacgcattcggtcgatgtcgatcatttgctgtgagtgggagagttgctgctgaagagcggcggaacggttgtgctgctgttgttgctggagagccgccacaattacataaagcgaggaatactcagcaccgttctgcggcatcaaattggggggcgcggcgtttgaagtggcaccgcctgaaagaacgtgaaaccctttccgctaaatgcaaccaaatgcccaaaccattcgctccggcggcggttgtgccaaatgctggaagcagcgggtgttccgcagcggcgcgtccacctccgttcgtcatattcaatgcaggggtgggcgatgccgcgggcgccgttgcggaaggcagctgcgacatttgtgcccaaaatgccgcgttccccgcccctcctccgcctcccggcgccgttggctgcgatttttgctgctgctgctgggcggctgccgcaagtgcgagccggcgcgaccacaaatagtgaaagtccactgttgcgggcggcgggaaaaaaaaggacggagccggaggggcggcaggcacagccgcggggcgcaaaaacgcactgccggcggctgacgaatggtcaaatgcgacgaggccgcccaacggattgaccgatgccgcggccggcggatgggaacccatcgcatttggagaagagccggtggctctgtgctgctgactctgttgttggtgcgcatgattgccaaggcgttctccgaccgattgcggagatgccgggagggaaggctcaattttgt

SEQ ID NO: 42089 - DNA, 1474 bp, Heterodera glycines
tgatctgatagctttcattgaatatcttttcatcagcatttactgtaattttaaattctctggacaatgtaatggtagtgttattttcggtgccataatactctaatgcattttcaatgagattaaattttaatgttttattgtcatcaaatgtttgaccgtttaaagtccacgacaatgtttgttcttcgggctcaatttcaaccaaacttttgatctttttcttcagaattgccacagtttcattactctttacccaaataggataatttttcacttcattctcaatttcttctcgaacaacaatttgaaattcaccaatggacaagcgaataatgccacttttttgaaactgataataataaatttttttttcatcattaagaaaaacataatcatcttctgggccgtattgcagtgatatttttgtgagttcagttccaatctttgttttggtctccatttccatttttccaattatcttttgcttcaaatcttccaccttttccgttccatttaccctaacagtgattatcttagtttttatgggcgactgttcattgaatatattttcttcagcagtcactttaatttcaaaatttacgaacactaaaatgactgcgccttcttcaattttattgtcagccattgtatcactgtcctgaagcacagtcacagtaccatcatctgggtttttgattccaaatgttttcttttctgactgaatcctccaagcctcttttttgatcagctccttcaactctttcactgtggttgagccttgtaccacaacagtggtctgattgctttccttggttaacattgcatcagctttcactgtaatttgaatgccatcaatggatgatggcattatcatcagcagcaaaaatattgtcaatagccaaacagaaacaccaatagagaacagtgaaaggcaaaattgcttcattttgggtaatggtagaaacttcaaagaatggaagggtaattaatctgatgaatgtgagggatatggagataggaatatatgtatcgctcttgtcaaggggccccttttatgggaagaatctactcaaatatttgaaacattaatgatcacttcaatttggcaaatatagtaaattattgaattggccaatgagtgatcattttaatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgagttattgaattggcaattgcgtgatcactttcatttggcagtgttatagtgaggtattggattgggaaatttgctgatcactttcatttggca

SEQ ID NO: 42090 - DNA, 1002 bp, Heterodera glycines
  misc_feature (7)..(8): n is a, c, g, or t
  misc_feature (810)..(810): n is a, c, g, or t
  misc_feature (926)..(926): n is a, c, g, or t
  misc_feature (939)..(939): n is a, c, g, or t
  misc_feature (946)..(947): n is a, c, g, or t
ctttacnntttgtacgggagaatatgagcgacaaaaacatggatttttggacccaaagactttaattatacaccccaatgcgcgggaggcgaattgcaaggaatttcgctatttgtatactcaaacacggggaatagtcacccaatatgaccaagtgacaggggaaatgcacgaattaccacctgattctgtgcattatctctccagacacgggaagattgacttcccagaaataccaatacatttttttagaaataaagtacttgccaatttatccgagctatattccccggaaaattttgaagaaacgatcgaagtggcgaaggttgtgcaggaaattgcaagactctcgcggccaaacgcctgggaaattgtctcagagaaaaatgatcaaatggccacaaatatagtctcgaatggcttattttcctttttaagagggggaataatttcagctaatcaattatgggtttttctttgttgctgctatataacggtgacagtattaattcagtgcttcttaccagcaccaattgcacaggccatacagtatttgggcttaggtggtcttattttaaatggcttaagaatggtgcaaaactttacgggtgacagagtcagaaataatgcagcaatctctcaggaggctgtggaagcgcagctggtcaagtgtaatcccaaaccagtgctggaaaataagtgcagtatggctggggcaaggccaaatgtgattgaaatggaaaagcacttcgcatgtaacataccgcttactgagaggtggctatcggtcgattcaattccgaccacctncaaacggagaaaaaacgaaccagccgagcccggaccgtcagaaaatagaaaaatcgttacaatcgcaatgatgcgtgtgaattcatgcgatgaaaagtttagaagtatggccagangtaatggatatgnaataaannatgtgtggacacgggtgcacatgtttcgctgtgtaatgtagaaactgcacgaaaa

SEQ ID NO: 42091 - DNA, 1513 bp, Heterodera glycines
  misc_feature (37)..(37): n is a, c, g, or t
  misc_feature (57)..(58): n is a, c, g, or t
  misc_feature (69)..(70): n is a, c, g, or t
  misc_feature (82)..(82): n is a, c, g, or t
  misc_feature (98)..(99): n is a, c, g, or t
gttaaaatttattgaaatttaatttatccacattatnaaattttttcaataaatacnncaaaaatattnngagagtcctttngagcatagattacatnntaagcattagcatttgttttcaaaatgtgtgccgaactttgatgatgccaattttgttgatgaatcactgctttttgtgccaattactcaccaatcggaaagtgcaaagagattttagagaagcgcaatgaaaagcagaaacaaaagtgccggatgtgataaagacggaaaatgggataattaattaattaattattaattaactaattaattaattaagtaaaatttttaagggttttcgaatgataccattttgtctgggttggtttgacacttttaaaagttaggagatttttttgcgggaagtagcagcctaagtaattcttatcatttaaatagctctgaaattttccaattcaagttttaactaccaaaagcttttcggtgaagggttcagaagttccggcaaataattttaaatttctgaattttaatctcaatttaaatgagtgatctggatagctgatcaatttaacgaggcaaataatgcccggcacgtagttttcgtgcttttttaactttacaagtcatttgtgggatttacttgaaatttcttaatcaaattgggaaaaaaacagcaggcctctctaattttcctgtccttgcagagctaggacttgaagtcacgtgaggccaacaccacttatgtgtcgactggcccttctttttcagttttttttaattaaaaaggagagattttatatctctgtaagataatgataatccatttatgcatttattaagatttatttaaaattttcaacttgtggcactttcaagatcatttgtctgttacataataagcaaaaacgttaatttttaagcaaattgggatacaatttttcatttttaatgctaaaaactgccgaaataattcctttttatttttttgctaagtacctaggaataaactccaaatttttaattccacacaaatcgctgttgggccttgtaggctcatcgagggtcgaaaaatttccaagactcgagaaccgatgccgagcattgaatccacgccgaggctcgagaccaagaaataattctgaacactctatatgatttttaaaaaaaaaaaaaaaaatatatatattcattatcaggaatgtctaaaactatctcggttttcaagcattaaatcttaattataaatgcagtacatttattgttaacaaatttttctaatttacaataattttctattaaaaaataatttttaatttctcaattgctaaatttttcttttcattcaaaaatgaatgaatgaatgaatcataattaattaatctttctgattacgtcccattattacaaaaaaatataagccctatttattatatatattgaattttttaaatgctaggctaaattaaaagcaaaattaaaaatgtattgttatttatttcattttaaaatt

SEQ ID NO: 42092 - DNA, 1049 bp, Heterodera glycines
ttttttgagaatatctattctttttgagacagccattttcaaaccgcccttttgtagggctccaccgcagatagtaatgcgtttttggggaaaaccccacaagtacaacggtgtagaaaaaaagagatagccatttttctgagaatatctattcttctgagacagcaattttcaaccgaccttttgtagggctcaaccgcagatagtaatgcgtttttggggaaaccccacatgtacaacggtgtagaaaaaaagagatagccatttttctgagaatatctattcttctgagaaagcaattttcaacccgaccttttgtagggctcaaccgcagatagtaatgcgtttttggggaaaccccacatgtacaacggtgtagaaaaaaagagatagccatttttctgagaatatctattcttctgagacagcaattttcaacccgaccttttgtagggctcaaccgcagatagtaatgcgtttttggggaaaccccacatgtacaacggtgtagaaaaaaagagatagccatttttctgagaatatctattcttctgagacagcaattttcaacccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtaccacggtgtagaaaaaaagagataaccatttttctgagaatatctattcttctgagaaagaaatttttcaaaccaccttttgtagggctcaccccagataagaatggggttttgggggaaaaccccacatgggccaacggtggtagaaaaaaa

SEQ ID NO: 42093 - DNA, 750 bp, Heterodera glycines
ttcacagtacgcccatccgccgttttcgttctgatcagtctgatcgtcagttttgttttgatcatccgtcttcttctgctgggcactgtcgtcgatcgccgtctctctctccgcttgtttttgcccattccatcggcacaaaattcgggcgatagttccgtgtcgtcggatccctttgaactgttgtttttgtatcgtcaacagagacgcattcgaattcgttcttctcgcttgacccttctccagtatagtatcgtttttcactgtaagtgaaagagtttatcccttatgcttatttatcagcaggcgtcactatctgatcaaagcttttgtagaaattgtctccgtctgatcactcccaaatcattctttcttcgtctaatcacccccccccccctcctctttttacctccatcggtctctttgcttctcttgccaccctctccgtctctcgttgaccatcgtctcagctgttgtacgatgcccaatgcattttcacttcgtctctttatctgctgttgttgtccctcttcctcaattggcaaattgaatgaaattctcttccgcgactgtgccatttcgccgttttggcatttttgctgcttttcctctctttccgcgtcatttcctttcaatgaaatgaaagaagccgcccttttcggctgtcctttctctccgattggaaacatttttgaaggtcgttttggcacttggagaaagtttttatctgtcgctgttgtcaattcgctt

SEQ ID NO: 42094 - DNA, 871 bp, Heterodera glycines
tgacctccatcggcttcatgttcagcacttttgtgatgcgtccttgcatgataagaaagtgcgggttgttcacgtttatgccgacttggcgaaacatatcggacacacgttggtttgtggcagaagtgccgttgatttggtagctgtttttcccgttgatgataatcttgcaataaattgacattatttaaaagtttaagttacaatcacctgccgtctcacgacaatttccttatatttgttgtagccagcaggctgtttatcgggcgggacgtcgttgtcaaaagtgatcgtaacagttgctcggctgatgccggcctggccttgcttgtacaccaactcgttgagggaatgcactcggacctgggcgaggtttgtgatgccaagcaggaagcatatggcatccaaaatgttcgatttcccagaaccgttgagtccggtaatggcattaaattcgggatccaaatctctgactgcttcatgctgtgaatatgacttgaagccctcaatctctatttttttgattctcatctatttaaaaaaaatattatagttaaaagacaaaaatttgaacaaacatacaaagtgcaattttaagatgcttgatctccttgtttgtttgggtctgttgttttgcttgaacttcgaagccaaaagaattcaaaaagaaaaaaataatgccaaaaaaatttggctaaatgttttaaattaaaatagaatacgagtccaacaaaaaatcattgcaggacagaatgggaaaacaataaaagtgggttggtttcccgaactgaaatcccagctttatctcgttactaaaatcccatccgcaaaaaaaaacgggtgtttgggcgttttgaactaatttgactaa

SEQ ID NO: 42095 - DNA, 819 bp, Heterodera glycines
ccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactaaaaaaaattgaaaattttgaaatcatgtttcccactcccttctcccaggggtattattttgtaaacttttttttcccaataaacttttcaaaccccatttttcgcaccgggaatg

SEQ ID NO: 42096 - DNA, 926 bp, Heterodera glycines
catttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaaccccatttttcgcaccgtgaatgttatttttatttgaattctgaaccgttttgagtagattagactagaaaaaattgaaaattttgaaatcatgtttccccactcccttctcccagggggaattatttt

SEQ ID NO: 42097 - DNA, 1122 bp, Heterodera glycines
tcttcttcgctccgtatcttgcatttttgcctaaccattcttgcactttgtcgcattgtctttccaaatgaccaacttggttacatttgtggcactttgccgacttgtgtagacagtctttgtaactgtgatatagttttccacatctccagcatttaggagtatgagctgatgtgtggccctgctggaattttggattgctgcccttttcccttttgttgacattttgcttcatcgcattgaccaccaatttcgaagttgaatactcaatcattttcgcctccgttatagtggtcataaaatttatgcaatcctcaacaacttcgtcatatttgactgattcgccgtaggacgcaagttttgaaaggatgcactgtcgtaggaccgtgtctcttgacgacttaagtgcagttagaagcatcagacccttgaattgttcttcctttaggtttacaaatttgaaattgtttaacaattgcttgtgcatgttgatgaattgacagaagtcctcattttcccacttttcagctgttagacattcgaatctgtcgatgaaaattgattgtggttttgcaaagagcttttccaaatttttcactgcttcatcatagttgaaatcagtaacttttttcggtagatagaatttgttgtactccgaaaaagcgttttccgaaagtttgttcatcaaagctttcactttggtttcgtcctgtgcgtttggtgacgcacaatcaattgcaaacgaaaacctgtcaaaccattcggaaattctgctcttttcttcatatggttcgaagattccgatgtccggcaaatgcggaattgtcgcatttgctggggtcggggcaagtagggacgagacacagaataaataaaaaatttattccgggaaggacctcaaacttgggtaattaaacaaaatatttgaaatggtgaaaaatatcttcgtcctgtgcgtttggtgacgcacaatcaattgcaaacgaaaacctgtcaaaccattcggaaattctgctcttttcttcatatggttcgaagattccgatgtccggcaaatgcggaattgtcgcatttgcttgctggttttgtcgtggttgtcactgtcctccgacgaattgagca

SEQ ID NO: 42098 - DNA, 1095 bp, Heterodera glycines
ataaattgatcattgtattcacagtcctgcaaatttccgtaaatcgaaatcctgttccaaaaattttccataaattgatcattggaatccgcggccccaaaatttccgttaatcgaaatctggtgccaaaaatttccataaattgatcattggaatccgaagtccccaaaatttccgtaaatcgaaatccggtgccaaaaagtttccataaattgatcattggaatccgcggccccaaaatttccgttaatcgaaatctggtgccaaaaagtttccataaattgatcattggaatccgaggccccgaaatttccgtaaatcgaaatccggtgccaaaaagtttccataaattgatcattggaatccgaggcccccaaatttccgtatcctgtgccaaaaattttccataaattgatcattggaatccgaggccccgaaatttccgtaaatcgaaatccgatgccaaaaattttccataaattgttaattggaatccgaagtccccaaaatttccgtaaatcgaaatccgatgccaaaaattttccataaattgatcattggaatccgaagtccccaaatttccgtaaatcgaaatccgatgccaaaaattttccataaattgtaattggaatccgaggcccccaaatttccgtatcctgtgccaaaaattttccataaattgatcattggaatccgaggccccgaaatttccgtaaatcgaaatccgatgccaaaaattttccataaattgttaattggaatccgaagtccccaaaatttccgtaaatcgaaatccgatgccaaaaattttccataaattgatcattggaatccgaagtccccaaatttccgtaaatcgaaatccgatgccaaaaattttccataaattgatcattggaatccgaagtccccaaaatttccgtaaatcgaaatccgatgccaaaaattttccataaattgatcattggaatccgaggccccgaaatttccgtaaatcgaaatccggtgccaaaaagtttccataaattgttaattggaatccgaagtccccaaaatttccgtaaatcgaaatccgatgccgaaaattttccataa

SEQ ID NO: 42099 - DNA, 1279 bp, Heterodera glycines
cctgtccccgtccccagcgattcttcctgttggccgccccctcctcggtcatcatcaaccaaaatattgttgttgttgttgttgttatcagtcattagagagtgaaagatagctagagatttcatatcaacaatgtaattgacgaaaaatgatgcagataataaatgtattaaaaatacattataaaaaggtacgcaaagtatgaatatgtgatcaatatgcaaatttattaaaacatttagtaaataaattgataaataaggcaaattacaacaaaaatgaaaaaattgtatggtggaagtcagagatgaagcaaacacaaagaaagaaatgggatcgaagattgaaatttaataaataaattgaaaaacataatggaaacaaaagccccccccccccttcaccatgtgctgtcaaacagcatcaatcctttccagcagcctgtggatcataaaggactcaaagcggtccattatgctttccagatgcgacgtgccataagtgtaaacttttgtgttgatcgccttcgagtgtcccatacccttcgccgttcggtccaacagcaaactggatgtttcagcttggttccggttccgttcgaccaaagccttcagcacaggatgcgttcgcaacagcccaatgagctcggcactgaacagtgtacgggacgtagcgccggcatgccgaatttcatggagcgaacccagaggaaatttgagcttgaatgtgtgcaacagcccctaaaggatatgaaacatatatttattggcttctgcttatgaagataagatatatacattgagcagcctgttcatgttgttcaactggaacggtttgccgtcccgcacgttgaaaaaaaaagggtccgagggcaaaatttcaatgtgatcaatgtgttggtaacggtaaatggcaaccgccgagtattcaaacatacttttctgttttggttgtggggggggggtgcaatattttgtatatttgtgcattctttgcaaccaacatgatggcacataaatctcttgagaatatttttagtatatttattggcatatgcctatgaatgtatgaaatacatatttttaaaacacctgagaaatttaaagtcctctaaagccggctccaaagcaaccgccccagagaacagcttctgctggatagcgcaatgcttctgcttaattgcctcatgctgcagcaggcacatagcgctcgcataagtgttctgtctgcagccgcgcacggagattatgttgcctataaatgtttttaaaatatcaaa

SEQ ID NO: 42100 - DNA, 769 bp, Heterodera glycines
  misc_feature (142)..(142): n is a, c, g, or t
gggaaattttttgaaaatgagtataatttgttaagagaatttcgtccaaaaatcgtcaaatcttgtgattttcgagccaattattggtaaaaaaaaatttggagttttgggaggccggcggtgccgataggcgccgccgaanagttttcggaattttaggaatttttaattaattttattaagaaaattgtacaaatttaaaaattttcaagagtccccaattccccgagttagtttcggtgagtcggaggataaaaagtcggaggtagggggctcggggagcaaccctattataaacccccaaaataggtgctaaaaatggaaatgagataaatattttaaaaatcaaaaatgtagtcaagtaaataaataaataaattttgaatatgaatttttgataaaattttccatttttcaggggtgtatttttcgtttttattgcatttttgttaataattttttcaaaatagcagaaaatattttacaaaaaattcttcaaaatgaaaaagagcacaaaaaaagcaataaatttattattattaacaggttatatcgctccgatttgattcggttttttttcggtttttcataaaaatcggtcggttgtttcggttttttgattatttcggtcggtcggtttcggttaaaaaaaccgaaaaaaaccgaaccgaaaaaaaccgaaaaagtcaaaaatttctcggtcggtttttttcggtcaaaaaccgaaaccgaaaaccaaaaaataccgaaaaaacccgaaaaaaaaacc

SEQ ID NO: 42101 - DNA, 820 bp, Heterodera glycines
tgctcgtctcctcgcccctccccttaattaaaggggggggggcgaatgccaaagcgacaatttgccatttcttttgaccgtcccaccgtccctttgtgctcatttgtctctcttttcctttgtccatttgtctcttttgtccaataggctttacgtccttttgacaattttcgtcttcagatgctctcctccttttgtccatctctttccatcgcttcaattcaattccaatgagtggtccgagttttcagtttcagtccggaatggtccgggaacaaatcacgatggactgtctagaggaagtgtctctgcgcaggcttcgtcatgaagcagtacagttcatcaacaaacatgtcagtgggacggagaaagacagcgaggacaagagagggagagagtgagggagggagggaaggaaggaaagagagacaagagagagtaaaggataagggggagagagagacgagagagtgagggagggagggagagggggagagagagacgagagagtgagggagagagggaagagacagagagagacaacgaaggacagggagagagaaggagggaggaatggtgggatttaaaacagttttgtgtttcagcatcagcggcattcactgggcgatcggcttctcgaccacattttgctctacaggcacaatttccgatcagtgaacattctcgagttgatccaatcgactgaagaattgtcagagggctgtctgatcgaaattgtgatcagttgtaagtgtttctgatccaaggcatttacttaagcagagcttaagcgataatttaaattttactattgttcttc

SEQ ID NO: 42102 - DNA, 1313 bp, Heterodera glycines
  misc_feature (1290)..(1290): n is a, c, g, or t
agacaatgtcatgaaaagtgttaaaaccgcttttcccacctgttggtcgtacaaagcccagaagaacacgatgggaatgtacagcacaataatggccaacatgcttttgactccggcgatcagatgctcgtcgtactttggtcgcgcgtagtccaaccaatggtcgggcgatcgccgatggcttcggcttttgcttcccctgagacaattcatagggcaaattattgttatattaggcaatttcaaggtttagcaaatgccatcaatggctaaggatgggcggaaactatgagtttaagccctctaagtgacaaaaaatttgagcatcgattccgccgaatacgatgcgatggcattttctgatcactttgtcttatctctgtgctggatttgatcagtctcccctcccccaattattcaccagcatgtgttgcggattttgcgtcggagagcgaagaaaatgcagcggacgaccttccacagaatgttgcccttgttggccggcgtgattttgtagttgcgccagccaaacagaaaggtgaggaaggcgacgagcatcagaaggccggggatggcaaaagccaacggaaaacaatggtcggcaccaaggcattggacagtacggagccgaggggtgatgcccatggcgagcagggagccggcattgatggcgaagtagaagaactgaacggcggattgatcatttgggactattgccaattgtatggcaaacgaccactgatcaggaccaatactgatcagccttgggaaaaagtgacaaaattgatttgatttaaaggctactgatcaacaattggttgttggttcgttggcaccgataactgaccgagaagaactgcgttcgctgcctctgctggtcgtcgccgaattggtcggccgcaaatgccgacacacacggctttatcccgccggtggccaatgcgatcacggccaagccggaatagtccaatgttttgcggaccaaactgtccaagacgggaatggcaccgacggagagcagcacatggccaaacacatagacaagtgacacctgacgaaggcatcaacgaattaaatgacggaaaatgatgttaattataatgtgaagaatttaattgcttttttgttttggccatgaaaaaaactccgatgaaaaaagcgatggatttggaaaactaaaaaagggagatcaatttgatcagtttaagtttaaaatcattccgtttttgctcattttctgtatttatgagtataataaaaatttgaaaaataggatattttgcgcacccnaaagaatgacgcgaaaacggccg

SEQ ID NO: 42103 - DNA, 1198 bp, Heterodera glycines
ttttctttcttaaaattagcccaagatcgcaaattttccgttaaaatttttctaggcttaaaatctttttgttttttgttctgctagtagaggaatgttaagagctttcagaacttgttaacaaattgcattaaaatttcaaaattttttcccacctcctattggcaccgccggacctttccccctcgcccaatccccaaaagttttttagaaaaatgcgccacaaaaaaattgtctacgtgtcaaaatccctttaatttaaaatacgtacgtaattctcattaaccatttttattttttcaataaaaagtatttaccagatgatgatttttagtatgtgttgaaatgattgctgaaataattaatcaattgaacaaatattgataaatagaaaatttattttaaaaatttcctaactaactggcagaattaaaaaagtgtctttaaacttttctaagtataagcaattcataaaatttagcctaatttatatgctagagatatttcaagcaaaaacgaagtcaaaaaacacgaaattaaattttattttattaaataaatgacttttatattttattaaaatatagaagtgaatctcatatgaaaatctttatgtaatgaatttttcatttttcattttctatcaaaaatatcatttaattttgcttattaatttatgaattttttctctctaattgcctatttttggaaaattcatcgcttgatcaactatatcaaaaatatttttattttgtcttatggcaaataatttcgtttttttaaatttttttatccttttattcttaaaaaaattttattttataaaatatttcgtcaattatttatgttccgaacaaatttctatgcattattttatagagaattgatttaaattctttctagttcagtcgacatcgtaagctacagttctgtctgtccttatttattgccaagttgaatttagtcttaagaatttgattttaccatctttcattatacagtaatttaagaaaaattattgcactttttatgagtttattttatgttaatttgttattttaacaataaaaggtttattaacttttttaaaaagcacaatgtttaaaatttataaaataatttttaaaaattatttatttcattattttgtcaatctaagtttttaataatttttaataatatatggccctttattaat

SEQ ID NO: 42104 - DNA, 830 bp, Heterodera glycines
gtccgtttgggggtactcaaacaattatgggggagtaaaaatccaatgcagaattaaagtacaggctatagggaagctattcccgaaggattcgatctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaattttttggataaaaattatttaaatgaactgactagataatatttaaaataggttatttctcttcctttcagtatccctgcaaagtttggtgcgcttctgatcagtttctgaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcaaaacccctttctgaaaaaatatttaaagaattaattttgcaaaaaataaataaaaacgaaaaaactcaaaattttccgaaaatttttttgagccagct

SEQ ID NO: 42105 - DNA, 1135 bp, Heterodera glycines
aggtctgatgaaataattaacattgaattcgtattatcagcagacatcaaaaaaagagaaggaagcacaataatttttaaaattaaaaatgaattgaagctaaatgaaagagtataacgaaagcaaaaaaattgaatttttattgttttttaaaggcacatttatgtagaaaacctttcagcaagtcataaaaattttacacagaaaagtccatttataacaaaaaacttcaattttgaaatgaagaaaattaattaaacagaggaaaaataaattattttgaccattgtagatttatgttttatattttaaaaaatggaatttctattaatttaatttatcgatttttgtcacgaccaaaatatttcgctcttgaaattactaatttgacattttataacttgagcagaccaaactttgatggcgttctgaaaactttaagacacgatgaaaatcggagaaaatttcaggtttctaattgcacctagaaatgctgtctcttctttggaacaagatttttttccgccacaaaattttcatttcagcttccgttttcagtatctcaaattttcttgatagaatttcaaaaattttgcataataatatggcacatgttacaacaatccataggtgatttaactgaaacagaaatttgcatatgatatgacaccgcgtcatatctcagatataatccgatttggaacagcaggtccagagcagaagggatgggggcggacacacttaaaagcggcaatcgttattgatgaattttttaagaatttattcaaatttcaataattcggctttatttaaaatgttcttcagacaattattatttttctcaatgaagaaaaacaaaaagttttttttaattatattaataaatggggtattaatttaacccagttcctattaattactatgggataaagaattaaaatggttcattctatcaaaaaaataaataaattaaaaaaaaaaacgaatgactccactttaatatttacaacataattgtgatttgaaccgataacttttaatgtcaaaaccgttgaactaatcactgagccactaattactaaacactatcgaaattgtagaatttttttctatttttttttctttaaaaattcaa

SEQ ID NO: 42106 - DNA, 1256 bp, Heterodera glycines
  misc_feature (1251)..(1251): n is a, c, g, or t
aatttgttattaaaaaataaaattcatatcaatttttacaaattctcttgccactgttaataaatttcgatcagactctttaattcagtccaattctgatcataaattaaaaaaaaaaaacaattttgtcggcttttatataataaaattcgggttgaaaagcaaaaaatgtcatttgttaaaaataaatttttttatgggaataatttttcatcatataaattttttaaaaaacttttatttgatgcattttttgaaaaatgtagctgaactatcggatagttggatttgaaggaggacctgctgaagcatgagtatccatcagtcccgtcctgttccaccaggatttgtgcattgaataagcctaataattaattaaattttattttatggtttttctaaaagctctacgaaatttataaaactaaaaatttaggttgaaatttataaaacaaaaatttcggtttaaaaaaaatggttcccgaatccacctgtctgagtctctggccacaacagtacccggagagcaagcttcactcaagcagtaattttgacacgacttttgtgtggcaaaattattccgattacctttaatttttctttaattattaattaattttttaatcgattaaatttcacgttaaaaataattattgaattgtgtggtttttaccctcgcatccgttatactcaaatggttgacaagtttttgtgtcagcattgaaaaaatgtcgtgtgattcgggtactgctacatctaacaccttggtcctaaaatttttgtaagaattccagtaaaaaagttattttccttaacctttggttgtgagcaaacaaaatttttggatggacaacacagtgattttgtttggtatacggtgcccgaaaatacagtaacaggggtacagtagtgtgtggaagggcattgccgatttgttgtgcatgggcgcacagcgccgttgggctctttccaaacctggttttttttttaaattttaataatgtattttttcaatttttttttttgccaacttcgccaccgtccggacagctgaaaaggaaataatatttttaaagaattttttaacacattatctaattaatttaaatgcaaaaaaattcaaaaattaagtgtcccgacatttgcggtccgaaagtggattttttcgaggtcttggccataagtcagacttttgatttcgtttttcgttaactaattatcccgctcgacagtgaaacattttttcgccgnggata

SEQ ID NO: 42107 - DNA, 547 bp, Heterodera glycines
aaattttcaaaacaaaaacagcaatttttggcagaacccgcgctgttttcccgttggacccattggagtgccaaaaaaatgctaatgggcaaaggtttcgggaatagcaaaacattttgtcaattaaaatttgggtccgattaaaattggactgaaacttgccaggctcagaaaattttatatttggtttaacatttttcgtttctatgttttaaatgaaagaaaatgtttttttttgaaaaattggtaatttttttaattttactcaattttcttaataaatttgacgccaaattttctaatttttcccagcggcgcctaacggcaccgccggatcacaattttcctaagaatttgggttctaataaaattggactgaaacataccagactcacaaaaaaaaattaaatatatatatatataccggatttcctcgattataagccccggggcttctattgttcaacccccctccaaggggggcttatattcgagggggggcttccattcgagggggggcgtataatcgaggaaatacggtatatat

SEQ ID NO: 42108 - DNA, 255 bp, Heterodera glycines
  misc_feature (12)..(12): n is a, c, g, or t
tataataacgcntgcggacatctacacttttgaattgaccataattggtaattactctttctttttctccatattgaccatcttactcatactccccccacccttttcttcttccgccacccacctccctctcttgatagtttaaactgaaggcggttaaacgacaatctgatccccatcaagctagcttctgcaggtcctgctcgagcggccgcccggggatcgatccccgatctagtaacatagatgacaccg

SEQ ID NO: 42109 - DNA, 915 bp, Heterodera glycines
  misc_feature (15)..(15): n is a, c, g, or t
  misc_feature (31)..(31): n is a, c, g, or t
tgttaaggctttaantttggcaaatccacanttttttgtccacttcaagtgcttttcggtcctcacagtgaatgatgccggaagtgcggccatccaccgaacggacctcgaaggcattgctcctggcaaagatttttaaaaattttcgaatttttttggaaatacctaagcttgtccgtcgcccaaaggtagcgcgagacgaaggcgagcggaagcggaatccggatggccgttttccattcgtcgcccatctcaattaaaaaataataacagtcttctgaaaaatttcaacttattctgacaattaaataagaaatagagaatttttaaattttgtgaaagttatctccatagttttttcgaaccctactaattaatgtgttaattagggttaatttgtttttaattataaattgcacaacttcgtcatccaataatcgtcgttcttcattttgttcctccgctgggcttttcaaagcactctgaaaattaattatttcatttttaataatttaaatggaaattaattacagttaaaattaaataaaaatatattttttaaatgccttaaaaacggccaaatccatcagcgaaggcggcggatgctttgattgactgtctctgagcagaggactgacctgtgaagattaaacactttccatttcaaataatattaaaattaaatttgttgattttaattaaatttattagtctaattaaactctaatcattcggacaaaaaaacatttttcagaaaattcagaaatttccccggaaaatgaaatataaaataaaatttgctgattcttaattaaactttattagtgaattaaactctgaacacggacaaattttcaggaaaacgcattttaatttacctcataaaaatttgtccggataaaagttttaaaatta

SEQ ID NO: 42110 - DNA, 1026 bp, Heterodera glycines
aaaaaaaataataatagggttgggcttgccattttaatttgaattttttagaatgtgtcggttaaatgcaaaaactgtgtggaaaaaattgttataactccattcagagaagagatagaaaaaaaaaataaaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaaatgggataaccccattcagagacaagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgagggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactccattcagagaagagatagaaaaaaaaaataaaaataggtttagagagcccatgaacagctgcatcggatgcaagtgccgccgttgctgtacgcctaacagttggtgagcaatgacggaaaattgcttaaaaaagaaaccaaacaaactcatcaattgttagctcccg

SEQ ID NO: 42111 - DNA, 1604 bp, Heterodera glycines
  misc_feature (1306)..(1306): n is a, c, g, or t
tattttttgtatttttaatataaatattaaaaatccgttttattgatttttttgaaaattttgattaaattcattttcattcattatttagattaatttttggttaatattaattaaattttttaaattaaatttacaaaaaagaaataatatttacggcaataataaaagctaaaataacgtaaagcgaataaattcatattaatttcaaataaaaataattttgaagccggaatttcacttttttaattaaattattaaaaaattactcatattgcggaattattttgaaacatatttgttttcatttaatttttgtaataataaatctaaatttacatttatattttttgtcatttatattaaaaataaaaagattcttttattttaataaaatttattttatttttttaattatttagaatacaaaagaatgttaattaaattttaaatttcataaataaatattataattaactacatcaattaaattaaaaatggttgaaaaaatataaacaatattatcaaaattgaagtcaacaatatgcaaaatattctattatcaaataaaaatgaatcgaataatttttgccgttttttgtaaatggttgtcaattattgttaaattaaaaaaacaattcatattattctttttaaaaataataagtaaattgatagtaaaaatagtgaaaataatgataaaaattatatttaattatacaaacaattattaaaaataataagtgaaactttatttagaaaatcgaacttttaataaatttaccaaaattgtctttatatccctctaaacaaataaatatttgaaatgtaaaactttaataaacatagtgaattataaataatttatttttacttttatcaagcaattaaaattaattaaaaaaacaatttttaaattaataaataaaaatccaattttaatttattcaatatttaaaaatatttatttaaatacaaatagattatgtgtacgaagaaaaatgaaaaaaaacgtagacgacatgagataaaaaagaagcaaatccaaaaaacccagaggaaggaagaagggaaagtcaaggagattagccactaggccatccgcacaattctcgtcgttacttttaaagaatatattaatatatttttaaaattttttccttttaactccaattttcttcactaatttttcactcagaccccccattcttaccagtgcttgtttttcccggttcccggttgccctaccgggaccgggaccgggaccgggacctgagcttttcaaaatccgggaccgggacctctngaggaccgggacctcggatgaccggaacttcccggcccggtcccggtcccgctgcactctagtttatattattattaatatttttaaaaatatattttattattaataatttttattttattcttcggaagattttaaattaacaatttcaaatgttcattaaatgctttaattttctatatggaccggatttatttaatggttttaagtgatgttagtactataatttatggtctaattattaatgctataatttaagtaccaatattagtaataaatactttttcttaataacaca

SEQ ID NO: 42112 - DNA, 760 bp, Heterodera glycines
gtccgcctcgtgctgtcgcgttttgtccacatcccttgcaaaattcaattttatttttgctaaaagcacacaaaaaacagggaaaagcggagacaaaaataatggttattctcaagaaaaatcagcaaaatgtcagcagaggactgccaaagtcagtcccaccgatcgctgttttgcccaatttggtcaccgaaaaaagaatatttgaagcggggtaaagtctgtccatttgatgggcaatgtcagtcccgtccctttttgctgatcattggtgcctgtcccacaattggtgattggctctgaatgctgatcctccactcattcggtgccccttttatgacgtcgaattgcgctgccggcgccaaggtcgacctcgagattctctgcacgtgatggttgctgctgctgctgttccgccgttgcgaccaccgatcgccactttttgcactgatcagcagcaaaaggcaatttgtgggaggtgggggatgaccaagcagtagaaaatggaaaacgaaacaaacaacaaaaggggcgggagggacggaatggcggaacggcggcggaaagcgccgcgggggctaaaaatcaaattttgtgaatggaaaaggggacaaaaaaataaatttttattgtttgttgcttttaaatttctcatgccctttttgatgggccaatttattccgttggcacagcgatcggtcgcccctccccttttttcaattgcttttttcggacattttaatgcattaattgcatttgc

SEQ ID NO: 42113 - DNA, 1668 bp, Heterodera glycines
  misc_feature (820)..(820): n is a, c, g, or t
ttttcggggcagtccccctgaaccgatgcgcccagatttttggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttattctgcgtggatttttgctccccataattgtttgagtaccccaaacggacacttgaaaaaatcgatttttttatntcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaactttttttcagaaactgatcagaagcgccccaaactttgcagggatactgaaaggaaaagaattaacctgttttatcacattagcttgtcatcagtttttataaaaaattttcaaaattctgcgtctcctattattttatttttttttcaaaattttgaagggcggggggggggcgaaggcccaccacgaggccgcgaagaggccgagtgagtaccttcggtgcaggaaaattattaaattttaaaaattttttaattgttttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccagattttatttacatgttagtttaggcactctgatgctttttctatcaaaaagggagatgaataaaatttttaaaaatttttaattcctttttaaacaggccaaaaagtttaggcttaacttttttttcagaaacttatcagaagcgcaccaaactttgcagggatactgaaaggaaga

SEQ ID NO: 42114 - DNA, 786 bp, Heterodera glycines
  misc_feature (55)..(55): n is a, c, g, or t
atttttaaatttatcttatatccaagaaaaatgactatcttttatgtggagaaantttatacgggacaaaagcgctcgaccttgagagggagggcggtgcgcaatcgccatttaatttctcagagaatttttaaatttatcttatatccaagaaaaatgactatctcttcttttgagaaattttatacgttacaaaagcgctcgagcgtgagagggagggcggtgcgcaatcgccattttatttcttatagaatttttaaatttatcttatatccaagaaaaatgactatctcttcttttgagaaattttatacgttacaaaagcgctcgagcgtgagagggagggcggtgcgcaatcgcatcgctatttaatttctcagagaatttttaaatttatcttatatccaagaaaaatgactatctcttcttttgagaaattttatacgttacaaaagcgctcgagcgtgagagggagggcggtgcgcaatcgccatttaatttctcagagaatttttaaatttatcttatatccaagaaaaatgactatctcttcttttgagaaattttatacgttacaaaagcgctcgagcgtgagagggagggcggtgcgcaatcgccattttatttcttagagaatttttaaatttatcttatatccaagaaaaatgactatctcttcttttgagaattttatacgttacaatagcgctcgagcgtgagagggagtgcggtgcgcaatcgcatcgccatttaatttctcagagaatttttaaatttatcttatat

SEQ ID NO: 42115 - DNA, 731 bp, Heterodera glycines
aaaaagcgttctattgatttttaaatttggaatatattttaaaaaatgatttttgctttatgcttttaactattaaaaagttgtagaaaaaatttcgctttcgcatttcgcctttcgcattttcgcatattttagcttttcgcatttcgcttttttttcattttgcatttttcagtttcgcaaatttagcttttcgcatttcgctttttatttttcaatttggcccatccctggtgtaaaatgacaaaattttattcaaaaagcaacaaattattaggcgaaatccgtaaggggttcgtaacagtgatgccgcgggttgagaaaaatttcgggttcgggtttcggtcgggcactcaaaaaatttcgggtttcgggttgagaaaaacctcgggtttcgggtccgggttggcatcactgttcgggatcaaaaaatcagatttttaccaatatttttacggcgcatttttacaaaaaaacttttattgaatgggcgagggaagagaatccggcggtgccgataggcgccgccggaaaaattttgtaacttcgtcctgatttattaacagattttcaccaaaaaaggacaattttggcaacgaaaattctgatcaatttagaaaacgtgattttatgcaattttgagtctggaacctatgatggatatttaccggcactttggctttaaatcgaagttgatttttttgcggcgcattttttcaaaaaatttttgg

SEQ ID NO: 42116 - DNA, 1013 bp, Heterodera glycines
atatttttcatcttctgttctttatatgccatcattttccatcccttccggcgtaaaattgcaatttttaggtcaaattttgaaatcttagaggagaggaattttgtggttcggcacggcaccaataagatttttttgggattttaatgaattttgtaaagaaaatattcaatttcaataaatttttctcttttcaccttcgccggcgaccctcactccccgcaatagtcatccgtaacagcgaaaatttctcggtttaaagactaaaaacccgaggccgtgaaccgagcccaagaagcgaaaaactcgagaaatttcccggaccgataataggaatgagttaatagaaacattgttttgcacttttagttattaaaatatttatgccacatttttgggtttcgcaattacttacaaaaatgcgccaaaacatattccatcgaaccaaatgcaagtttaaaggttatctgatacaatttttatttattcctgtctatatttatgtattgtataaattaagttatttatttattttttgctataatttgttttatttatcctaattttttaaaattaatattattatattttttccaaacaatgttatttgaaaacaccgtcaaaatggagtgtttcaatgtaatttaattaaataatttaatgatttatttaatttaataaaataattagttcaataaaatatgaattttattgtctaatttatacggcattattattatctaattagttctcaatgtttttggaatgaaattcaaattatttgtttatctgaagatagtcggttaatgattcttaaatatcttttaattattgcttttagcaaaattactgaaattttaagtagttatgtgctttggttcatccctctttcagtaggcctcctttacatgatgagtaaaatatttaattttttatattactccttgactaacagcgtcaactttttttccttctttcacaaaatttttgtagtaactttatacaataaatta

SEQ ID NO: 42117 - DNA, 810 bp, Heterodera glycines
tccagcgtttctgtccgagctaacacaggtattctaaagtaggcatattagggcatatcgggggggggggcgaaggcccaccacgaggccgcgaagaggccgagtgagtaccttcggtgcaggaaaattattaaggaagagagttcattatttatttgttttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacagaccaaaaagtttaggcttgtgtggtaagtgtgaggaactgtgttcctccaggcaaaaaattctaagaaaatttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaattgtccgtttggggtactcaaacaattatggggagcaaaaatccaacgcaga

SEQ ID NO: 42118 - DNA, 766 bp, Heterodera glycines
gagagaaagagagaagacccagcactaaagacagatagagagaccacccagctctaaagagagaaagagagaagacccggcactatggagagagagagaatggtcgagagagagcataggcagcgcgcaaaagagagaaagaattcaacgatcttggtatcattcgatagctctatgtgtcctctattagccagcaaaatttcaaaaaaaattcgttaggtatcaaaaaagatatgtccaaaaatgttaagaaaaccagtttttcgaaatttatgaaaacatacagtcaggtgccaaagtaatgcccccaaaaatttttttttgaaaactgcgattttctcaaaattgaatgatgtgaaaaaggtctaatttatgacaaaataaacattaattagtgcgctaataaatacccaaaaactgcccgataactctctttgtcaatgagaaaattgctcatgaaccgaacaacccccctttttgggggtgcaaaagtaatgccccaacaagtttaatcgaccaaaactcaatttttatgttgagataaaattctgaaaaaattcatactaagctatcttttgatactgatcaaaaaagtcttttggaccaacttgatcagatcactccttcatggtgatttgaaaagccaaaaatggcttgaaaacgggaaatttttcgaaaaaatttcctagggggttgaaaatttttttctgggaaatttaagtaagcttatcagatagaggacaaaattctctaccgaattgccttt

SEQ ID NO: 42119 - DNA, 1001 bp, Heterodera glycines
atgaaattttcatgctaaatttatttcatcaaaggaaacattgccgtaaaattttcaactacaccaattaaaatgtgattcttcaatttataaataaaattactactactgtataccaactttaatttttttaatttcaccaactcagctacagtatactttccaccggtgtcaccaattttgaattcgtaatatgacatgaaaattttgccagcatttttaggtatatcagtccacgagcattgaaattgccaaagagatcgacagtatcaccaccgtaacaaacaaacagtacattcataaccatgacaatcaccagcaccaccaagaagaacagcacaaacaacacttctccagcgtgtcaacaagtgaccaaagtgaaaaggacaaaaaaggtacaaaattaaagtgattttttaggcttgtttttggtcacatttttgccaattttttgtgccaataatctctggcgtttgtttaattcgcacatattaaatccattttgttgatagaggtgaaatttgggaaaatgagttttagactttttgttcgaatatgggtttggtttcgaatgtgtcaaaattagattttccatctcaaaatccctaaaagagctttatctcattaaaaaaaataaaagttttgattaatcaccagcacctctcatctatttatgtatcatatttaaaattgaaaagaatattttaaaccatttttaagcataggagcaatttctcggccgcaattgtccggggcgaaatgcctgcagaaatattaccgaagtttctctaattaaaagtattatttctgatggcgtaattggcattttgtttttaggaggaatgcgcgactgggtgatgccgttggactttggccatgccgacgcagaagccaagcatttgattcacattgtggcaaattgtcaccgggaagaatactcacccattacgacacattgtgagcgggaataattaaaaaatcagaataattctgctcaaaat

SEQ ID NO: 42120 - DNA, 1152 bp, Heterodera glycines
  misc_feature (74)..(74): n is a, c, g, or t
ttttggagaaaatgccgccaatttcaccgccaagaatgccaaatttcgtttctggccaatcatttcgtgtactntcagcaagttgtccaatccgtcgccgtccaatcactgctcgagcttaaccaattgccgtccccgtcggatgccattcttgacgaggtgcagcagttgtgccaatcggaaacagtggcgggcagccaagcgctgaaacagagctgctggttggcattcggagcatggtcaacgaagtatgccagcatacgacggcacagaatgcgaaggaatgtgccggggagggcggcgccggtgccacggcaaaatgcgcacagtcgggattcgtggacaaggacaaatgcccggcggacaagaagcagaagtacaaagaggtgaaccgggcggtcggatgtcatcccaaaaattaaaaaaataattagttactaattggggtcatttcgccctgtacaagcagcagcaaccgcagtgcatctacgacaaggcggtgatggccatcgacgcggcgcatgcgcacgcaaatgccgcacagcgtgcgcgccatgttgctgccggtgttcctgaacacgggcgagcagccgcaggtgcgcatcactgcgttcgccaacattttgggcgcccaaccaacggccgaggtggtggaccagctgatgtacgcgattggcaaggagccgaaccgggaagtgcaggcgtactgctacagaacgatgaagaccatgtccaactcgcagaagccgggcgagacgcaaatgtgggaaaatttaaaatttggcactcacaattggccgaatttagtgccaaacacgtcaaatcgtcactgaaactgttggaaaatgccgtggacgagcagcaattgcgcaccagcggaaagtggcagttcgagcagttgtacaacaatgcgcaacgcgagggcgtgtgctttgcaaagtgaacggacagccgatcagcggggacgagcagtgtcaggacgagctgcagcaccagcagtgcgtgcagttcaacgacccacgccagacggacgtgaccattcgcacggggccaatcgcagtgcgattcaacggacgcaaggcgtggctgaaggtgtcccaggcgtacaagaacgcccagtgcgggctgtgcggacactacgacgacgcggac

SEQ ID NO: 42121 - DNA, 1229 bp, Heterodera glycines
  misc_feature (1221)..(1221): n is a, c, g, or t
atgaattatgattaaatttttgctgactctgccaatgctcctattgaccatttttaccactatttttctctcactcatcgtcttctcgtctctcctttattataagctattttcctaagccaacgcccttttctccctcttttctgttagtcatttctcattggtgttgacgatccaacattcagtgtaaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctgttagtcatttctcattggtgttgacgatccaacattcagtgtgcaaatttgttaaacctctcaacattttaaatcaaaatcctaataaaaatttagttgaatttctccgcctcttatttgtgcaaaattttcgaaaaagtaattttctatttaaaattaaaaaattcagaagcaaattcaagaatttttttatttttaaatgcattttttaccacatgaattatgattaaatttttgctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtaaaatttgttaaacctctcaacattttaaatcaaaatcctaataaaaatttcgttgaatttctccgccttctntatttgtg

SEQ ID NO: 42122 - DNA, 1188 bp, Heterodera glycines
tgccaaacggattttatttatttttaagaattaggaattggctgccgatatgcgttgtcgggagaaaatttgaaaaattaacgaaaataacctttttatggtacattaaattttgataaattcattgaactttttgttgtttggcggtgcttaagtcaccgccagggaaaaattattaaatttgtagattgttattaaaaacggtcattatgtgaaaatccatttcttatcaattaatttttattagccattcttagaaatttacggaaagcgggttaaggtgttccaaaatttttttcactttttctcggaaaaatatagttttcgattagatattttttttagctaattttcttaacatttttaataaatttttgtaaattatctttttataaagcaagcttatattttaaaaccaaatgcattttattattacatttttgtaacctaatttttgcaatacgaatattcattttggcgtactttagttcaaccttaaaagtgctttatggctttgctttattgggcatatggtctgggaaataaccaaattttgtaattttttgctgttttcatataccttttgcattctttaaaggcatatgatgctgcacttacgatgctagaagaggaccagccggtgcccgaagaaatcaaaattgttttaactgctctcgaacaaatttcacaaggggaagaagaagaagagtgacaaatttttaaaattgcttacagggatatgaaaaattttaaagaaaaaatgggaaattttttcatattttaccattatttcattaaatgtcttttaaatttttcccagcgggcttaacggaaccgcagtttaccttagtttttgaaaagattagcctcaaaattacaaaaatttgagatttttaggcgcaaaatcgctacaagtccctgttttttgcctcagcgcataagttttaaaataacactgaaaaaaaaatttttgacccgaaaagcaaaaaaaggtcttcgaattcccctctccgagatttttttttctggcttgggcttaatagattatacttatgtatgcctctttccaaactaaatccattttgtttccttgaattgttgaaaatattctccttttttcatatttttcgttgttcaactctccgggccgaaagttgtcgcatatttttaatgtattccttcttttcc

SEQ ID NO: 42123 - DNA, 914 bp, Heterodera glycines
gtatatttataattaaattcgcgccactagttgcagtttttataatttcgttaaaaaataatggaaggtgataaagagaccacggaattaccgaaaataattgacttattgtgacaaaaaattctgtaaactaaaaaggtgcctcccgcttgggtttcagtaaaattttaaagcaactgttgcaatgatctgcttcaaatgacttgtatttctcactcgatcatcaagcaatttgttggccgttagtttttgtgcagcaatgaaaatgccatcgggagctcgaattccaagacaagtcccagcctgaccaattgcttccattgcatattcaacttggtagagacggccttctggagagaagattgtcgtacgagtatcatagcgacgggccatcttaaaaagcttatacaattttaaaaattggattactaaaaataaccgggaagaataattaaattctcatccttttgtaaacttccttttgaaaaaacataacgccaaaatattataaaaaaagaaaagaacaaaacccggaatagacttttttgaggcactttcaaacaatgtcagatacaaacactcaactttattatataagataaaagcaacaatttatccaaaaatttcctcaaatgcatcgacgttacctcgcttacaatcctcgcgcaaaacaaacacataaataggagtccacatattttgaaaattgtttttcccttcaaaacaggaaagtaccaaaatgtttttgcgggacgagacccagtagcattaataggcatttaaaatttgcgggacccatgcaggattgctggattcttggaattttcgttaaaacaattcataaaattggggggttttattggtcacaatacttttttgcagccggcgcttatcaaaaaaaaaatttttttttt

SEQ ID NO: 42124 - DNA, 911 bp, Heterodera glycines
aaagtattttttataaataaaatactacaaaaatccgccattttttgctctattttataaattttattttagctttttatcacttttttgaaaaaagttatagaaataaaagtgattttggaatttgggaccacaggggtgtgtgtgaccatgatttttgagtggaaaatttttttcaccaaaaatcttccaaaaatatgattttaggggatatttgggccgctgatcacgaatatgcaatcatattttactttagacatggttaagagctcagaatccctgtgtgattggggattctgaggggtggggcggcatgttcggacccaggccgtgtttattattttttaatttattaaaaaacgggcgcgaagcgcccgtcctgaggccgcgaagcggccgaatttccccctaaaaattaaaagacgggcgcgaagcgccctcttgaggccgcgaagcggccgaatttccccctaaaaattaaaagacgggcgcgaagcgcccgtcttcgtcttgaggccgcgaagcggccgaattccccccaaaaattaaaaacctggcgcgaagcgcccgtttggccccacaaaattaaaaaacgggcgcgaagcgcccgtcttgaggccgcgaagcggccgaatgttcccccaaaaaattaaaaaacggacgcgaagcgcccgtcctgaggccgcgaagcggccgaattccccccaaaaaattaaaaaacggacgcgaagggcccgtcctgaggccgcgaagcggccgaattcccccaaaaaattaaaagacgggcgcgaagcgcccgtcctgaggccgcgaagcgggcgaattccccccaaaaaattaaaagacggacgccaagggcccgtcctgaggccgcgaagcggccgaatttcccccaaaaaattaaaaaacgg

SEQ ID NO: 42125 - DNA, 798 bp, Heterodera glycines
aatttatttaatctgtttttgaaaacttgaaaaaacatcggtcacttgaaaaaataaattctaaaattttgtccaggaaaatccaggttttttcctgttttgcctggacctggattttttttcacatttgacctggaccttgatttcctggacaaaaatccaggtccaggaaaaatccaggttgccgaaaaatggcttggacctggatccaggaaaaatccaggttgccgaaaaatggcttggacctggatccaggaaaaatccaggcctggatccaggtccaggtcgatctctacccctcatgctatccaaagtccatccccattgtgccagtatataagtccactcaatttccccctcgggggctgcgagatgtctgcggtgggtcagtctgtgccgttccttgcctttggcaatcctttcccaaataaccaattgcactgacccacccaaaatgctctgaggttgttgttgactcaactattcccggtttttaacatataattatttgtcaatgctttttccttaaataaattgctctctcttaaaatggtaatttgaaatggcttgaagccttaaacccggggacacaacacgttgcatatcggcatcgccagacccaaaaactcatttttttgtaataaatttgtataaaatcacaaaagatggacaatttttgggtaaattctggttacaaattacatttcaaattttcaaaattttcccaggaggcgcctatcggcaccgccggcctcccccttttcccaaagaattttgaaaaaattcgttgcaaaaaat

SEQ ID NO: 42126 - DNA, 994 bp, Heterodera glycines
tttagtaggcaaaatttgttattatattattttccgtgccaccatccattttttaaatttaaatatttatatattattttaattttaattccgggtaaaggtatatttctgtaaaattcaattttaaatttccaaattttatttgtttttaaatactaggaaacccaatattttaatactactttcttattaaattttttattttttactaaattatttgaaatttttatagaaacctcccgaatttattttttgctgggatttttaaaatttttacaggcctttctggctttttactaccctcgcggcttcattttaacacccaaaatttaaaaaaaaatttttaaatgctaaaaattatttttaattctaaaatagaaaaaaaatgtttcaattttcctcttaaactttcattgttctcatttccgaatttaatttgttatattgccccataaaattttacagcgcattaattgcccaattaacgcgctgcaaaattgcaagaaaattgatgagctgcgaatttgcgtgttgcgtgtgacttttattgacttcccactaattattaattaacaaattgactaattattattaatttgtttcgttgattggaatttttttttataaaatcatttcacttaacctaattaagggcattacgtcaattaaggagttggattatctctgttctttttaaaattgttcttcttattccgtcatgctccataaaaattgtcataattatgttttttttatgaaattagcaaagaaattaattactatttttcccaaggcattttcagtgtattttggtgccgtagggaaaaaataataatcattttcggcacttaattatatgttttaagaaaattttacctaaggccatttgggcgaaattgccccaggaaaaattgacaaattgaaggttcaaatttatgcttttccaaatgaaagaaattaaaaattaagactttggattttggattttttaaat

SEQ ID NO: 42127 - DNA, 927 bp, Heterodera glycines
cctgtactttaattctgcgttggatttttgctcccctcattgtttgagtaccccaaacggacacttgaaaaaatcgattcttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattgtattctctccttcggggatttttttccattaggtcgtccgatagcgttcgattgctctattcaatttttcaaaatttttgttgaaatatttgtctgctgggaccataatgcgggggcgggggcgaaggcccaccacgaggccgcgaagaggccgagtgagtaccttcggtgcaggaaaattattaagg

SEQ ID NO: 42128 - DNA, 829 bp, Heterodera glycines
gcatcgttatttttgcattttttaaatttaatttgctttcccttccttccctctaattgcttttttccctaattaattgcccctttttgccctcttcccttgcgcagttgtccatttggtcggcggtgtggcggggctcgccgccacgctttacctgcggccgcggcaggcgcggttcggcgagcgcggcaccgcgcacatgtcaaagtgaggcggacaaattttttttgaataaaatgaatttaaatttcaacgattttaatgcatttttgctatgcttttctttcagtccgaccaatgctttgctcggcactttcatgctctggtggggttggttggccttcaacaccggcaccacaatgggcgtggccaggggccgttggcgtctcgcggcgaggcaaaaaattaattcaaaaataataaatcactgaaaaatagagtgccacgggaccgggaccgggaccgcgccgggaattcccggtcatccgaggtcccggtcccgcgttccggtatggacgtgagtatgcactcccaatacacgaccacacgattcactcgggcccggatgtattccatccgctttgcgtcgcgctcccgaacctgccccgctgtctttccgtcgggcaacaacatgttatcgattggataacatttcttgcatccgtgccaaggacagccttaaaatattaattttttatggaataacaataataatcaataccgtgcacttcaattgcacgcccctctgcctcaatcccacccgtccagcgagtaggggccgatccgtttctctcctccgggagagaggccggcctgcactttccacacc

SEQ ID NO: 42129 - DNA, 942 bp, Heterodera glycines
tatatgcaaattagagccaaatccgacttttgtcggccatttatgcctccttttcgcattaatgtatatggccgcgatcctgtcaagtgagtcagaaggaataatacaaagacaatatgtgccaaattggcaatggcagcatttaaattataataaattttatattaaaaacgtttttatattttaatttttataaatgaatttgaaactaaatgaaaaagaacattgctaattttgtaaactgaaaaaaacattatttaaagcattcagagaaaaaaaaactaaaatttaaaattaaaaaaaaactgcctattttttaaacattaaaagcattaacggttcatttaatgagtttaaatcaaaaaactgctaattaaaataaaaattagaggcaattaatgttcgaattgcgtgaaatttttcaaaaattggtcggaaaatttaattgttttatgtaaatcaactttttttttcattttgaaaaaatctctgcctaaacaaacaaacgaaatgagaatgtatttgcagtattcattatgcttttgtgtttattaggctgccggcaccgctgctcttcattattagccccattaatgaaggacattaacactaatgaatggaaattttaccgtttttatgccattcatcccttttttttcttattctccctctcttctcatctcataatgcaacaaaaaaagaagcacgagcgaatgaaaaatgagcacttctcttcacccctcacacaaaaaagaagaagaagaaggaagaaaaagaagcacatcggattacaaaaaaggaaagcgcaaaaaaaaataatgagaaaaacaaacaaaacaaaaagaaaaaatcggaatttattttattttttcatctagctgaaaatgtaaaacaaaaacaaaaaaaaaaaattaaaaacaaaaaaattttcatgatgttttt

SEQ ID NO: 42130 - DNA, 1307 bp, Heterodera glycines
  misc_feature (1232)..(1232): n is a, c, g, or t
tcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactcctttcagagaagagatagaaaaatcaattgttagctcccgttggcaaaccgaagggtacattggggcaatggatgttgggctaccgtatcagttattaaaatttttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactcctttcagagaagagatagaaaaaaataaaaatagggttagagagcccgtgaacagctgcatcggatgcaagtgccgccgttgctgtacgcctaacagttggtgagcaatgacgngaaattgcttaaaaaagaaaccaaacaaactcatcaattgttagctcccgttgacaacccgaagggtacattggg

SEQ ID NO: 42131 - DNA, 1407 bp, Heterodera glycines
tttgaaaagaatgaataagaccaaaatgccataaaaaccccaccagaggcctagaataatgttttaatactttaatttaacctttagataacaaggtgacatttaaaaaaatattttttgaattttttatttaaaaaatatgtaaaaaaagtgggaaatatttaaaaatatgtaaataaaagaaccattcacaaacacctattcagagcacttagaaatcagaaaatataatatcttaatttacaacgcaaataattatttttcacaaaaagtttgttaaaaaaagcaaaattaataatttttttaaaaagttttaattggcttttacaaaaaattttagattattaaaaataatatttttaaaaattttattttacaatatttttcagaaaaaataattttaaatttagaatatattttaaaaaggtgatgttctcaggctgtttttttaataaaatatttgacttttttaaaaactttgttatttcacaaaataaatttttactttttttaaattttttattaaaataaaattttaacgtttgaaaattaaggaaattattttttcaaaacgatttttaggacaactttacagcacacatacgtataatccggtgaagtagccatccgagtcgcggaatgcgcggtacactttgtcccatccgcgcggtttgtatgccaacaattttccgagccgtttccatcgcgcaaattcttgcaatgtttgcaactagagaccggcgcgggacgggatcccgcgcgggattttgcgggatcccagtccgcaatcccgcattttttggaaaatgcgggatttgcgggatttgcgggattaatcccgcgggatcccgtcccccgcaaagaaattgagttccaatcccgcagcgggatccgcaaatttgattttttgtgcgggattatgcgggattttattgattttttgaaatttttctaagacagaatgccaaatatttttaaataaatttaattaaagttaactcatttttcatcgcaaatttcattcaaaatttgtgaaattttcccggcggcgcctatcggcaccgccggataggcttttacttaataatcctgtagaaattgagtcaaaaactgcgtcatttggtcaattttagacaaaatctgtaaacaaatcgcattaaatttcataaaattcctcgcagatgtcgataggcaccaggtatggcacggaaagacttccgatttccgacatttttggggtcggaattccgacttcccaaaatttttggggcctcggaatgccatccctgataaggaccgccggaccccctgttcctagttttttgaaaaattgcaccgcaaaaaagtgggttgaaaagaaaaaaatagataaatttatgaaccgttaataatttgatttccgatcaa

SEQ ID NO: 42132 - DNA, 808 bp, Heterodera glycines
caagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatctattttttcaagtgtccgtttggggtactcgatacatttatggggagcaaaaatccaacgcagaattaaagtaaaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctcaaaaaagagttaagcctaaactttttggcctgtttaaaaaggaat

SEQ ID NO: 42133 - DNA, 1181 bp, Heterodera glycines
  misc_feature (1022)..(1022): n is a, c, g, or t
agacaaaagaaaagacaaaaccagaaacatgaccagaaaaacaaccataaagttaccaatacaaaacaaatgagacgaaaccatgttcagttaatttctggttttccacagtcgttctgattagacaaaagaaaagagccaaaccagaaactgttcagtttaatttctggttttccaccgttgttctggttagaaaaataatgagcctaaccagaaactgttcagtttaatttctggttttccaccgttgttatgattagacaaaagaaatgagccaaaaccagaaacatgaccagaaaaacaaccataaagttaccaatactaaacaaatgagacgaaaccatgttcagtttaatttctggttttccacagttgttctgattagacaaaagaaatgagccaaaccagaaactgttcaatttaatttctggttttccaccgttgttctggttaacaaagaaatgagccgaaccagaaactgttcagtttaatttctggttttccaccgttgttctggttagaaaaataatgagcctaaccagaaactgttcagtttaatttctggttttccaccgttgttatgattagacaaaagaaatgagccaaaaccagaaacatgaccagaaaaacaaccataaagttaccaatacaaaacaaatgagacgaaaccatgttcagtttaatttctgggtttccacagttgttctgattagacaaaagaaatgagccaaaccagaaactgttcagtttaatttctggttttccaccgttgttctggttagaaaaataatgagcctaaccagaaactgttcagtttaatttctggttttccaccgttgttatgattagacaaaagaaatgagccaaaaccagaaacatgaccagaaaaacaaccataaagttaccaatacaaaacaaatgagacgaaaccatgttcagtttaatttctgggtttccacagttgttctgattagacaaaagaaatgagccaaaccagaaactgttcagtttaatttctggtntccaccgttgttctggttagacaaagaatgagcctaaaccagaaactgttcagttttaatttctggttttccacagttgttatgattagacaaaagaaaagacaaaaccagaaacatgaccagaaaaacaaccataaagttaccaatactaaacaaatg

SEQ ID NO: 42134 - DNA, 1630 bp, Heterodera glycines
  misc_feature (861)..(861): n is a, c, g, or t
ccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccacataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcngtggatttttgctccccataaatgtttgagtaccccaaacggacacttgaaaaatcgatttttttggtttcataaatatttttttcagaaagtcatgcgcacccgtccgatctggcaagttaagcaacgattgctgactagccaaaaggtttggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttttaa

SEQ ID NO: 42135 - DNA, 927 bp, Heterodera glycines
  misc_feature (889)..(889): n is a, c, g, or t
tctatgccagaaaaatggttatctcttttttgtgagaaaattttgtaccataaaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgtgagaaattttgtaccatacaaatgttcccagcatgggcagaggggcgcggagagcaatggccattctattctacagggaatttttatatttattctctatgccagaaaaatggttatctcttttttgtgagaaattttgtaccatacaaatgttcccagcatgggcagaggggcgcggagagcaatggccattctattctacagggaatttttanatttattctctatgccagaaaaatgggtatctcttttt

SEQ ID NO: 42136 - DNA, 1364 bp, Heterodera glycines
  misc_feature (762)..(762): n is a, c, g, or t
  misc_feature (797)..(797): n is a, c, g, or t
  misc_feature (820)..(820): n is a, c, g, or t
tttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttanatgaactgactagataatatttaaaataggttatntctcttcctttcagtatccctgncaagtttggtgcgcttctgatcagtttctgaaaaaaaagttaagcctaaactttttgggcctgttaaaaaggaattaaaaatttttaaaaattttatcatctccctttttgatagaaaaagcatcagagtgcctaaactaacatgtaaaataaatttggtgcgtttcagaccctttctgaaaaaattattaggaataattttgcaaaaattaaataaaacgaagactcagatgtcagaaaattttttgagccagctagctcgacgctcatttcagtgtaagttagtccttaaccggggagtatccctgcaaaagtttggtacgcttctgctcaattagcaaaaaatatgagtgatcgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtaaggagaaccctttctgaaaaaatatgtaagagggggtcgtagcg

SEQ ID NO: 42137 - DNA, 822 bp, Heterodera glycines
ctttcctatcgacaaaatatgattactcataggtttattttaattgtcacattttttttaaatgaaaatccgtacaaattgttgagcctattaatcccgaaaaccagccttttttgttgaaaatctgttaacaaattacactcaaattttcaaaattcctccggcggtgccgataggcgcagccggacccccttcttcaccaaaagttttttggaaaaagcgcgccgaaaaaatttatgtgaaacgtaaatctgaatttctaataatattcgatcacttagtccaaaaatgattaactcaataaattctgtccatcatttatggtcaaatttatttaagttataatttaattaacaatattagtaataaatattttttttatttaatagcacatttgaagagtgagttttttttctccctcatgattttgttaattttaaaaattatttttttttcattttttgtttgaaaacaattaaagctttcggtttttgggtttgcttatttttatctcatgtagtccacgtttttttcctttttcttcgtacacctaatctatttgtatttaaataaatatttttaaatattgaataaattaaaattggatttttatttattaatttaaaaattgtttttttccattaattttaattgcttgataaaagtaaaaataaattatttataattcactatgtttattaaagttttacatttcaaatatttatttgtttagagggatataaagacaattttggtaaatttattaaaagttcaattttctaaataaagtttcacttattatttttaataattgtttgtata

SEQ ID NO: 42138 - DNA, 1050 bp, Heterodera glycines
ttctgtactgtttgtgttgtggagggcgcattttgttgctttattgcctgggtgagcttttcgaaaatatcggcgagagttttgtccatcttgattgacgatttgaaattgttgacgaattaaaaccacagatagtggaaccgcaaccgcataggtatcttggttttttgatgattccgcgaaatttaaaaatcagcacgagatttctaaatttcccaaaacaagcaattcaacacgagaattgcttgaaaattgatgagttcgggcgtcgccaatgttgtgcgtttagggtcacaaataatttgaagtcgaacacaagatatttattaaaacaacaataaaataaaatgcagaatttggagaataatttggggtcaataaatttagcggagcacaatatttaggcgagtgcagaggagggtgtacggacatttcgcctactcgacatctcgcctaccgacatctcgcctaatagccaaaaacattcatttcgcctactaagccaaattgtacaagattggatagattttagctttttctacataaagaattttttctatgtttttttaaaatagaatttacaaaaattggcaaaaaacttagaaatccgtggcctgctaatggcttcagctgatgccaccccgtatttatgcagtccatctggcattgtacaagattggatagattttagctttttctacataaagaattttttctatgtttttttaaatagaatttacaaaaattggcaaaaaacttagaaatccgtggcctgctaatggcttcagctgatgccaccccgtatttatgcagtccatctggcattgtacaagattggatagattttagctttttctacataaagaattttttctatgtttttttaaatagaatttacaaaaattggcaaaaaacttagaaatccgtggcctgctaatggcttctgcttatgccaccccgtatttatgcagtccatctggcattgtttgacattcattttgacgttgattatgccaacccttagacacatgaggagtttatcttgctgaa

SEQ ID NO: 42139 - DNA, 1245 bp, Heterodera glycines
  misc_feature (60)..(60): n is a, c, g, or t
  misc_feature (1224)..(1224): n is a, c, g, or t
aaaataaaaatgataaatcatttgatcatttttagcgcactttaagcaccgcgtttagcnagcgcagttccaaaattatttccatgccacagatattatgggcaggacacgccaagtacctcaaacttgggtaattaaaccgaagaaagaagtgcagtggggaagaatgacgcctaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctgtcaacattttaaatcaaaatcctaataaaaatttcgttgaatttctccgcctcttatttgtgcaaaattttcgaaaaagtaattttctatttaaaattaaaaaattcagaagcaaattcaagaatttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagagtacaaatttgttaaacctctcaacattttaaagtcaaatcctaataaaaatttcgttgaatttctccgcctcttatttgtgcaaaattcttctagaaagtaattttctatttaacactaaaaaattcagaagcaaattcaagaattttttttattgttaaatgcattttttaccacatgaattatgattaaatttttgcgtgtcgaattcattttggaattatgnaaataaaaatgataatcattt

SEQ ID NO: 42140 - DNA, 1093 bp, Heterodera glycines
attttctggaaataagcttaatagggcctagttaagctgtaaaaaaaatttggagcgatttgaatgagaatagaaagagccaggttcgatgaagttttggtaagccaaaaaaaaatccaaacatttaaaaatctataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaatttataaaaaatttaaaaatgagaattcatgcgagattttctggaaataagcttaatagggcctagttaagctgtaaaaaaaatttggagcgatttgaatgagaatagaaagagccaggttcgatgaagttttggtaagccaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaagaagcttaatatggcctagttaagctgtaaaaaaaatttggggcgatttgaatgagaatagaaagagccaggttcgatgaagttttggaagccaaaaaaa

SEQ ID NO: 42141 - DNA, 1057 bp, Heterodera glycines
  misc_feature (957)..(957): n is a, c, g, or t
  misc_feature (974)..(974): n is a, c, g, or t
  misc_feature (1033)..(1033): n is a, c, g, or t
ttaaaaaactgaacaaaaaattgttcttatgcgggccggtccgggttccggatcaggcacttttggtgcctgaaagtggtgcgataggcttccggaaaatgaccaatcaattttttgtggatcgactgcgttttttgtggatcgcccacactgagttttttgtggatcgcccacactgagttttttgtggatcgcccacactgagttttttgtggatcgcccacactgagttttttgtggatcgcccacactgagttttttgtggatcgcccacactgagtttttttgtgcatcgactcagcacgtttttaattgacaatgccctccgtcgacgactttctttcctaatgattaactttatttaatgattttatttttttaataacaaaaatatttattttttccaattaaaagaaaacttttaatttttaatgtaactaaacgtggtggtaaaattgccgagtgcgggttatttagccaaaatgcaaataattaataaatcttggagagaatttttaagaaaaaattcatgtacaaactataattattttaataagaaaagttgttttattttactgtcgataaataatcattttaatattatttaccaaaacacatttcaaaaattactttattcttatttaaatttaatattgattaatcctttttttaggtttgcggtttttgaaatttataaaattctaggattattaagatgacaaatttaaatgtataagtgatacaataattctttattaaaagtttaattataaattgatattataggaaaatatcatagtaatccacttctttaggctttatttatgttgttttgatccccatcataagcattatgcaaataaataatacttcattcgtttctttttaattaaaataattatattgcaaagaattttatttttacatttataattttattgatatattgaattttanattattatttccttccngtcttaataaactacagtagcgtttgtttctttgatgaagaaacatagtattgtaattntttattgctacagatttctacctt

SEQ ID NO: 42142 - DNA, 1508 bp, Heterodera glycines
ggaggaggaaggaaaccctcgtcctggaggcctcgacgttctccaaacggatgacgcgcctcacttgacttgccccttctttattccggcatcggcacaacggagggggggaattaagtcgattgaccatcacttaccgaaaagcgaatttgctcttggaaacaaacaaatttcgaattaatatgtatacataaaagatatttataatttttaaaaaggactcgaaaatgaaccctttttagtgacaaaaacctaaacaaaaattttttgaactgggactcatgagtgtagatagatttaccagcatttatgggcttggccttttacatacataaatggttataaaagattgatgggaaagacattgatgaagcacaaaaactgctttcccgctaataaatttggttaaccaaaatttggacttaaaggacgacgaaggacacaccacagacaaagatggggcacaaattggatgatttgggggtgcgcaatggccaaattggcacataaattgcgttctctgtcctaaaattggttaagcaaaacaacgcgacttacaattagagggaccaaaaaggggaagggaggggagatgaaagaaatacataaataaatggtgggaatgagagagaacattggcaaaggacaaacaaaaaaggaattaacaaagtttgtcattaaaaacgaaaattaaataaagagaagaaaaagggcacagaattttgtttgtggcacatccatcacattcttccttttgtggtaaaaaaaaaagggaagaagcgacggacgggcagcaaagttaattaatttggctcaaaaagctatggaagcacagcaaaatgaaattgaaaatttactatttcaaacatccatcaatgtaaaaaataaaatcactgacattttcaagaaaaaaaaataataagaaaattttaaaaaacaaaatgccaaagatatataattggaaattaaaaaaaaagttgtttgtttaattttaccgtttatctgagcctggtcattgatgcggtaatttaggtaattaatttagaaaatattcgattgaaaagaatgagagagaaattccatttttgcattatttattcataaagggcgatttgatgaatcatttggcggatgatttgcatgtcattcacaatgcagcaggacagcgacaggaatcattttctgctgtccttttaattacatttgatatttgagaatgaaaatattggggaaggggtcggcggaaagaccgagggaggagggggggggggggtgcattacgcttcagcaagtcacgaattaattaatcattggttattagagctaaacaaagattggaaatatctttcaaaacttttctctctctaagatttggattaaaaggcaaagctttgccatttgaccaaaagtaaatccaatttttccattcatttatttcccaaacaaattctctcccattcccccaaatgttcgccttctccaccttcccctccctaatctgggccatt

SEQ ID NO: 42143 - DNA, 1146 bp, Heterodera glycines
ttttcgaaaatctgagtctttcgtttttatttatttttgcaaaattaattcttaaatatttttcagaaagggttctgaaacgcaccagattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataaatgtttgagtatcccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatgcagaaaaaattttttaaaaaatttttccttatatttttgttatatcgttttgc

SEQ ID NO: 42144 - DNA, 867 bp, Heterodera glycines
ggctttttaatgtttttagcttaaattctttccctggcaaaatgtgccaattaaacatttggtgatcaatggctgctgttttctctccacagatgaattggattacttcttttcttctcacgaatcggtcaatgaaatgaaaaagtgtgtattttgaataagaattcaaaataaattttaaaaaatcgaaggtaattaaaacacagaaaagttttttctagaaaaaattttgaatttaggtggaaacatttgtaattttgacgaattgtgttttcatttatataaaataaatagggttgtcaaaaaaaaaaaatttttttttaaattaaataatttaatttacaattgaaaaatagctaaaatttttttttttttgattaagttttttgttgttttgctacctaaaaaggttaataataataataaaaaaatttttgccttttttagtgcctattcgaggatttttgtgcctatttaatgcctattttgcgattttttgtgcctaaaaaacgcacccctaaaaataaaattaataaaattggccattttatttatgctcgaacatgaaaggtacgggctcgcatgcgttgacagcttaagagtgatcgagtcacgtttaaagccgcttaatttgtccgaacttgagctgagcgcattgaacggaattcaactatggaattgcagtaagtccggcacaaaaagctggcattttgccaaaaattttaattttctattgtttttttatttgttatttttgctacaatatttatcgtctttctttcattagttgagcgtttttgtgcattgtctgatcaacaaaaagcgcatcggaatacatttttttgtggaattacacgcaatggccgc

SEQ ID NO: 42145 - DNA, 942 bp, Heterodera glycines
ggtaaattagatataattaataaatagagtaccagcaagttttatcagaatatgtcaggcagcgtggaagatagtcttgttgtgtcttggccaatagaaggtgaaagaacaaactgtttttagcataaattgcaaaatccaggatgctgaacaccgcaactaatgagttggcacttaccattattgtcagacaatcttaaatatattttttaaattgattatataaatttaaattacattttttcaagtttgtcagcatgcatgtccatgtcttgtgcagtttttgtgcaataacagccacactcaaataatccataaccaatattttttttacagcatgagcatttaattatagtattttttttgcatctttggttggggcatcgtttaaactgtccaccagaaaccctgaatttaaatatattgtaaataataatttaatatttttaatatttttggtttatcattgtcaaaattactctattctttaattatataatttatatttttaccatttagcatattcttcttcccagtgacatttatgtccacagttaaggatggaataccccatttctttggacacgttatttttgcattttggcgctaagcagcataaatcgctcgtttcaattgttccatctttctttcgccgtagatttgagcgacctataattttttaataaaatgttttgaattattttgtaacgaataaatttagttatatcataaataaagattttttttcctatttttttattagatattttttattaaatatttttattacttcttatatctatgcctaaatcgttagcagtatcttgtgtcatttcatcaaatgcactcttttcagtagggtcataatcctcaggctcggataacaattcatcattaattggtgagagagcatcaactataaattattggattaattttaaa

SEQ ID NO: 42146 - DNA, 1042 bp, Heterodera glycines
taaatgaatttaatcttgttgccttttatgttagtaattttttatttgaactttttctttatacattaaacatatttaaaattaattgaaagctttcattctgattaccaaatattaatttttggttttactattattacaagccaaaattaatgcatgcccatcgctgtaaatgtgatgtagtgtataaattggaatgcctttgtgaaaaaagtggatcaacaaaaaatccattaggcataagttaatgagtgatccattgaaaaatcagtgtagctcatagaaattattaaataaataatgataagaaatttaataggttattttagcaatttttgagataaaaaaattatttttgcagctttggtatcaaggttattataacaaatattttgattaggttttatttttgttattgtgtagttttgaagttgcgtgcttgattagaaaaacagaattataataatatttgtataatgttaatgttatataaaatacttttttgatatttatatttccgatcaatttatgtttaattttctttaaattaaaaacttcaaatttgaatatatgcataaattcggttctaatttttttattaaatctaaaattaacttttcaatcaacaaacatttaatattaattttattatgatatatctatttatgctaatgttattttaaccatttaacatctattttaaatgatttattattattttttattaaatgaaaaatatttggtatttatttttttacccagaacagttgatataaatacttaagaggcatgatgaaaaaatattaaaaagaaataaaataatttactcccagaataaaacttgcagaaataattgtgattatgtaaacaaatattagcaaataatttaagaaagtcaaaatattaagtaaaaataataacaaaatataaacattaaaataaattctcataaaaatatatgatttgtttattgtggaattattttattctcaataaagaaaatattaaagaagatataaaattatatattaaaagagcagaa

SEQ ID NO: 42147 - DNA, 674 bp, Heterodera glycines
  misc_feature (576)..(576): n is a, c, g, or t
aacatgtaaataaaatttgggtgcgtttcagaacccttttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactanaaaagttaagcctacattttttggcatatttaaaaagcaattaaaaaattttaaaatttaataattttcctgcaccgaaggtactcactcggcctctt

SEQ ID NO: 42148 - DNA, 695 bp, Heterodera glycines
aaaacgaattctgactgagaattaattattttcatacctttggctgggctatttttattaaatttatttattttcgggcataaagaaggtttctatgccgctttgatggattttatagaaatcacccataaaaaagaattatgatgtggcaattttaaattttttctttagttgtatttttatcggtgttttttctaccagtagttttttctttattttttaaaattcaaatcgagggaatcatttcggtattttttgtttaaataaaacatacaatacgaaattcagcatttcagtcttaatctggtcgataatttcataattaatttattatttttattaatcttcagtttaatctttttaaaatggaataattcgtaattctcaagtaaaaacgaattctgactgagaattaattattttcatacctttggctgggctatttttattaaatttatttattttcgggcataaagaaggtttctatgccgctttgatggattttatagaaatcacccataaaaaagaattatgatgtggcaattttaaattttttctttagttgtatttttatcggtgtttttctaccagtagttttttctttatttttttaaatccaaatcgagggaatcatttcggtattttttgcttaaataaaacatacaatacgaaattcagcatttcagtcttaatct

SEQ ID NO: 42149 - DNA, 1211 bp, Heterodera glycines
tttagaggctcaaattgtttcgctaagcgagaaggtaacaaacttagaggaacaaagaaatgactggccttcggatgacgaaagtgtagactcaactgacttaggcggaaaaccaaaaaaaagtggcaataaccaaaacacctcactggtaatggttgaaccgtttgcggtaaatgatcctgttgaacaaatacgagagcgtctggtagaagagtttcttgaccgtttgaagcctaatattaattgtgtcatacatcaatctaaaaagatagaaaaatttaattatattttcaaaatgatgtacaagtattttatataatgaagaaattagtaaaatagtttgactattatgtttgaaataataagttaagaacaaaagacaaaaaaacatttaacatttatttaaaagatttgacaaaataaagctcaaagaattgactgcaaaagttaaattacataaatgtttgactcttttaaataaaaacctacgaaaaatgctttattaaaatgataattttgaaacgatttcaaatgagcacttaaactaaagaaataattaaattgtacatatctattcttttattaaaatgtctaataaagaatttaaattcaaagtcaaacaaaaaaactaaaataataaaattttatcaatcaatgaatatataaaaaccagttggtaaatgtagcaaaacattattttcatcaaaaaacttaaatcaaataaaaagttgacgaaagtaatttaaaaataaattaccacaaaatagaagctaagatatggcaaaaataattgcgtatcagttcaagggaagtaagtaattcagaagaaattttcaaaactctcaagaagaaatacgcaaaaagaaattctggtatttcttttccttatgctaatttttatgcaaaattagaagcagttcttataacaatgaacagagttacaaaccacacaacataatacaaattttttttctatttattcatagagataacttgattaagtttaaaaagtatatttttatcataataaaaattgctctcttaaaatgaaattaaatacaacgaaataaaagaataaagaagaaaatgaagaaccgtccgtctcgtgagatgttataataattttaaataattcatatatattaaccgtggttatcgttgggcacgcccggttcgaattttactcaaataatataaaatttacaatgaaa

SEQ ID NO: 42150 - DNA, 932 bp, Heterodera glycines
ttaatttttttattaccctaatgccatatttgttttgtcatttaaaaaataaaataaatgaaaatatttttaactaaattattttatagtagcaatgcaaatctctcaaaggactttttttacaattgaataaaattaaaatttaatcttttaattgtttaattttttaattatttactttttttttaataaaagcttgtttattataataaatttcatatttttcataattatttattattttatatttttaagagtgttttggttctatatttttctatatctcatgttcagatggtcattccgaactgatcattcaagcggaaattgctaaaattatatgatatattttataaatgcatttaatagtttattagtgaattaaataattttaataatttttttaatattgaccagtacatcttttgacgaccaactcagataccatgaagaaaaagtgcacaagcatctttattcctttcatttttattaatttgcgttttgttataataattttcaaaattgtctataaattcattcttatcattttatttttgagaattgattaataattttgttttaatgtatgaaattttatgtacaacataaacattgggttttaaaatcaatgaatgatttttttacaatattttaaataaaagtttcttttcttgtgttttcatgttcatatattttaaacacagcatttttttatttaaatttttgaatatttataaacgagaaatttataaaattataattgatagaccacaaatagtgtgaaagaaagagagagagagagagagaaaaaagaaagagagaaagggggaaatgggtgaatccccaacaaaaaaaactagggttcggaccccctggtcgggggtggcttttcgcggaggcgggggatggcgggggtcagagtctcgggggcg

SEQ ID NO: 42151 - DNA, 669 bp, Heterodera glycines
  misc_feature (617)..(617): n is a, c, g, or t
  misc_feature (626)..(626): n is a, c, g, or t
gacacatggcaaaatgactttaagggcaaattggcaaaatgtggggggggggggaagggaaagtgccaagggcaattggtggcacacggacccacctgcaatttgcactccaactcgttgagcattgtctcgcggaaatactgcgcaaccatttcgtatccctccgtcccatccgccaaattggctaccgtagcgatttccaccgtaatctgaaggaacgccgcgtcgcccacttcagtactgaattgggcagcggtcaaaaaggcggaatctttgggaattctgaacctttggaagaaagtcgtttcggtgaaatttccaccgacggccccaaaaagcgaaggcacacgcgcgaaaatgccatgtttgtgggggttggtgttgctgtgaagcatcacaaagggcgaaaagttgaaacggacccgcgggcgaaggcgccgttcccacgcgattttgcctaaacaccggcggattggccaaagcgaatacaatcaaagattaattagcaaagtggccaaaacgacaaagcagaggtccgttccttcgaattcgaatcgcaaagatggattttgtccccggcggaaaatgcgtcagtgaaagaaaattatttaaatatnaaataactntctacagcattaatttatagaggaactacgttttgaattcatc

SEQ ID NO: 42152 - DNA, 954 bp, Heterodera glycines
ttattccgtaaatggggttggaattgtctagagtgttgagctgaaaaagagataggcgtttttccaaaattttcacaatcaaactcgcccagaaagaaattccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcaaaatcaaactcgcccagaaagaaattccgttccggaaaaattagggttggcgctatcattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaattagggttggcgctattattccgtaaatggggttggaattgtctagagtgttgagcagaaaaagagataggcgtttttccaaaattttcacaatcaaactcgcccagaaagaaattccggaaaaatagggttggcgctatcattccgtacatgggggttggaattgtctagagtgttgagcagaaaaagagataagcgtttttccaaattttca

SEQ ID NO: 42153 - DNA, 936 bp, Heterodera glycines
acaattagtatcgtcgtaattattctgagaatgcagttggaatacctattactgtggagcagaaaaagagatagccaatattccaaatttttctcaaacaaccgcgcagagaagcaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcacaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagca

SEQ ID NO: 42154 - DNA, 956 bp, Heterodera glycines
acaaaaaggcgatagttaagcattgagatataaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccataccttgccagagagtggagatagaccctttgttgatacatttggaaatgtcgagcccgcctagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccataccttgccagagagtggagatagaccctttgttgatacatttggaaatgtcgagaccgcctagcgcattcgaataacacaaaatttgtttgcat

SEQ ID NO: 42155 - DNA, 1855 bp, Heterodera glycines
  misc_feature (54)..(54): n is a, c, g, or t
  misc_feature (152)..(152): n is a, c, g, or t
  misc_feature (1759)..(1759): n is a, c, g, or t
  misc_feature (1798)..(1798): n is a, c, g, or t
  misc_feature (1800)..(1800): n is a, c, g, or t
aaaatttaaaaatgagaattcatgcgagattttctgaaaataagcttaattggncctagttaagctgtaaaaaaaatttggggcgatttgaaagagaatagaaagaaccaggttcgatgaagttttggtaagccaaaaaaaatccaaacatntaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaatccaaacatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagttttggtaagccaaaaaaaatccaaatatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagtttcggtaagccaaaaaaatatccaaatatttaaaaatctgtaaaaaatttaaaaatgagaattcatgcgagattttctggaaataatcttaattgggccttgttaagctgtaagacacccaccacttttgcacttaaaaaaatttcaaaaaatttgatcgtccataaataatttgtaattgatcagcggctcaccaaattttgcagagatacgtatcggaacactacaaaagcttactaattttcctagatttattaaacccggtgaaaattttttgcagacacccaccacttttgcacttaaaaaatttcaaaaaatttgatcgtccataaataatttgtaattgatcaggggctcaccaaattttgcagagatacgtatcggaacactacaaaagattactaattttcctagatttattaaacccggtgaaaattttttgcacacacccaccactttttcacttaaaaaaatttcaaaaaatttgatcgtccataaataatttgtaattgatcagcggctcaccaaattttgcagagatacgtatcggagcactacaaaagcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaaaccttactaattttcctagatttattaaacccggtgaaaattttttgcagacacccaccactttttcacttaaaaaaatttcaaaaaatttgatcgtccataaataatttgtaattgatcagcggctcaccaaattttgcagggatacgtatcggaacactacaaatgcttactaattttcctagatttattaaacccggtgaaaattttttgcagacacccaccacttttgcacttaaaaaatttcnaaaaatttgatcgtcccataataatttgtaattgatcangngctcaccaaattttgcagagatacgtatcggaacactacaaaagcttactaattt

SEQ ID NO: 42156 - DNA, 886 bp, Heterodera glycines
acgcagattaataataaatttaaatataaatactttttaggtataaaatgattttaaatagaaagaattttttaatttaaaatgtatttttgagattcgatatttatctcacatattgacgcagattaataataaatttaaatataaataatttttaggtataaaatgattttaaatagaaagaattttttaatttaaaatgtatttttgtgattcgatatttatctcacatattgacgcagattaataataaatttaaatatatgatatgaattcgggagaattgagtcccagtgattaaaattctggtgaattgagtcccgttgattggaattttggtgggttgagtcccagtgattgaaatgctggagggttgagtcccagtgattaaaattctggtgaattgagtcccgttgattggaatgttggtgggttgagtcccagtgattgaaatacagaagaattgagtcccagtgattgaaatgcagaagaattgagtcccgttgattggaatgttggtgggttgagtcccagtgattgaaatgctgttgggttgagtgccagtgattgaaatgcaggagaattgagtcccagtgattgaaatgcaggagaattgagtcccagtgattggaatgctgttgggttgagtcccagtgattgaaatgctgttgggttgagtgccagtgattgaaatgcaggagaattgagtcccagtgattgaaatgcaggagaattgagtcccagtgattgaaatgcaggagaattgagtcccagtgattggaatgctgttgggttgagtcccgttgattggaatgttggtggattaagtcccagtgattgaaatgctggtggattgagtcccgttgatcggaatgttggtgggttg

SEQ ID NO: 42157 - DNA, 662 bp, Heterodera glycines
ttaacatattttttctgcgcatatgctatgaagaaaggggcttaaaaatagcatttctgcgttaaaattttttgatttggtgaaggtttttagtccatataaatccatattttgggggttttcgggaataaatccatatttcgccattttttggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgataaaacgaacaacaataaaaaatatgcatttttaagttttaaaccccattttttggttgtttattgtactttttaggtttatttaagcaaatattaaatatgcacaccttttttgggatatttggtgggtcacatcatatattctgggattttttatccatattttggtccatatttggccatttttggactttttagtccatatttcgggcttttttagtccatatttaatgcccatatttgtgtatctgtagtacat

SEQ ID NO: 42158 - DNA, 988 bp, Heterodera glycines
  misc_feature (692)..(692): n is a, c, g, or t
  misc_feature (831)..(831): n is a, c, g, or t
  misc_feature (851)..(851): n is a, c, g, or t
  misc_feature (934)..(934): n is a, c, g, or t
aaagtgggtcaatttgaataataagtgagtcaatcagagctttgctttttaatttgcatttttcagttggcacatagcggtggcatttattcccggccgatgtacggcacaacgaccgcagtgccggcacaaccgacccaatttgggcatcatcaacagcagcagtcccagcaaatgcagcagcagcattatgcggcgagtgcgggaccaatggggggacagtgccaatacggcgccggcggggggacggcgacacggcgattttaaaaaatgaaaacaaaaattaaaaaagtgtagcgtttaattgagcgatttcaaatgttagtgccatcagcaaaattaacatgaagaaaaaggggcagtgaaaaaaaagttaaggcatttggtcttaatgagaggactttttgcccattttctttgcattttcgaaatgccttttaaaccaaccgaaatcctcgtaaaatttgaaaatttgctcacttttcctttgctggggttgcgtcgaagttaactttttggactttaaatactcagaaatgaattttcattcattaaaattttggaaatttatcaataaacgaattgtaatcggaaacattttgacgcccctcagctcgcttcgtgcattcattcattcaaacactttgtttaaatttaattaattgttactttttaaatttcttttagtgccncaatttgtcttttgtgtttatctttggataattttttaactattaattggttatttgtgtattattaccgtattaattaccctacttaatttgttgttcaatggattcagaaatttctaatctcatcattcactctctntatgcctttgtgttctgtanatgtcaattgttttgtcattttccgtcttcccaccccctaattcacttttttgtacactttacacaacgaaaacaacatttanacagtaacaacaaacattttgaccatttagatcgggatttccaatgtgatttgc

SEQ ID NO: 42159 - DNA, 1129 bp, Heterodera glycines
atcactatcaatttgatagaatcactgatcagtccttccccccgaccgtctaatggtccaaaccaacaaaactacagcacacacgagaagtgccaacctgagcaccaaatggggctgcatcataaacggttttggcttgtccattaggtcgtctctgtttttcaaccgcactaattggccttcgcgcgtttgcgacatttcgtactgcagtggttcgcggaacaaatgcctcaccgtcgtttttgtgctcttactcttcttcctcttcttcctctccttctgctgttttggttgttcgacgggtgttgcctgaggcaaattcactttttttgttttatcatatttactgaaatagaacccacccctgaattagaagcccccccccccccagaaaagcccccattttgagggaggttgaaaaatagagtcccgagttttattccgtaagtacagtatctaattgtgttttttttaattttaaaattcgcataagctcgattgaatggatgccctccctaccatattcccgtcgctgttggtcaatgaggtggcggtggaggacagataggagcaatcgctggtgccgccggcgccgtcctccgccgcctttgcgctctgatcggcaccgccatcattttccttgggctgctggccctcagccgcccatttgtgcattccccacgagtacagcttgttgtccaatgttccggccattgtgaagccgtcgccacagaccaaatgctaattgtaaattataaaactgcaattaattaattaatcggtaattaatcagttaattatttgtctctaaccacgcaagcctttgacagaagcgccttgaccggacacgtgcaccctgcgggcatttcctggcaattgccgtgggccaattcggcggacaaattgcgcccaaacaaatggacgtgtccattctccaaaagcactgtaagaaaaatgattttgtgtggcggttttctgtcccgctgaaagatggaatgcctaattagacaatttgcaatggctaataagccaattaattgacattgatcagacagtctttgagccgtaccgccactgtgccaaaggacaagcgaggcgttgaccacgcgccgaggggaacggtttgaca

SEQ ID NO: 42160 - DNA, 814 bp, Heterodera glycines
  misc_feature (783)..(783): n is a, c, g, or t
caaacaatttgtaacaaattgaattaaaatgataacagtatggagtttgggactgcatttgccattcatgtcactgaatttggcaccatttgcccaattttaggtactgattgatggcaagacaaggccgaaaaaagtgattggaattaaattgcaggtttgataatcatgattcagtcgtaagtcgcaacaaatggtaagtgatcggcatattatagagacccagggattatgcgaaaggttccaacaattttgtctcaatgtcaatcataaataacataaaccgaatgatgtggataatgatatctctctaaggatttaggacttttggcatcgcttgccaataagtgctgatcagagacacaatgtcaaaagcgactgatcaggagaaagctgattagtgaatgagtgatcaaacgcattattagtgggaaatatggccgtgaatatgaaattaaaatataataaggcattcttatttaaatgtaagctgataaagggatgggatgggacgcgaattttccatctgggataaacttgtcatgcgaaatttgacaccaaaatcaaatttttataaaaaaatattaaatcaaattaattaaatcgcagtgaatgtgccgcgccatagtaaaaatcgcttttcttctgtgcctaaaacaaaacatcattttgtttataaaagtgggcggctggtttaagccagccgcttattgtgtgtgggtcggctggcagaaaggcggaaacgtgaagacaaaaatgaacacaaatccatcccatcccccngggggtggggttagcatttggccaaggcggg

SEQ ID NO: 42161 - DNA, 1700 bp, Heterodera glycines
gggatcagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgtcctccctctcatgatcgagagtatttgtattatagaaaattatccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattatccaaaaaagagatagccatttttttgggatacagatgcaatttaaaaattcattaaaaaataaaagggccattacgcaccgtcctccctctcatgatcgagagtatttgtattatagaaaattatccaaaaaagagaaagccatttttttgggatacagatgcaatttaaaaattcattaaaaaataaaagggccattacgcaccgccctccctctcatgatcgagagtatttgtttaaacaggcgcttgcgagaacgaaaaatatttcgtaaacgaaaataaaacaaaatattaatttctcacgaaaccaatttaatttttgaattgttattcatttatattatttaatagttttgattattttttatttttatatgattatttttcatttatattgttaaaaattttattttactaatataaatggtttttaaatcaattaattactttgtcatttacgtcatttcaagcgattatgatgctcaaaataacaattaaattggtgttatcccgcgcgatcccgatcccatacggtctatattctacgctaagttaagttaactaactataagcaggcaaaaacatgtgcaaatcggttcaccaaattaaaattttaaatatcaaaaaaaatcattagaaatcgaataaaagtgtaaaaaatggttcgttatttcgatttttcaaattcctacacaagttttgcaatttataaattctatttatatttattctttttcatttaaaatttgtttgattaatagtccaaatttaaaggttttaagttttattatagtgaatgcctttatgatgtgtttaatattcctttttaaagcgataaattaggttattttatggacattttttaatatatatttttgcaaaattcaggacaatctaaaaatcaggacacttgtgaacttttgtcaactaaaaagcaaaagtaattaattaatattttttaatgcaattcacttataaagcaataagaaaatgataagaaatataaaaaagaaaaattaaataaaggaagaaacaaaacaaaattaacattaaattattcaaaaatgaacaattaaaaatattatcttaattttataattattttagaagattaaggagaagatgttggtggagacgcgggaggcagttagatttaattataattcattaataataatagttataaagaataaataatgaaatatcaaacaaataataaaataca

SEQ ID NO: 42162 - DNA, 1458 bp, Heterodera glycines
cctaacttttggcctgttaaaaaggaataaaatttttaaaatttatcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaactaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaattttgcaaaaaataataaacagtgaaaaactcagaatttctaaaaaaatttaaaaccaattacaattgtcattttttcaggttaagttagtcctgttccggggagtatgcctataaaatttggtacgattttattgcttattgaaagagctagagccgaagaaaatttttttaatttaagcctaaactttttggcatgtttaaagcaattaaaaattttattcatctccctttttgatagtaaaagcatcagagagccttattcaacttgtaaataaatttggtgcgtttcagaaccctttctgaaaaaaatatttatgaattaattatgcaaaaaacaaataaataatgaactctcttccttaataattttcctgcaccgaaggtactcactcggcctcttcgcggactcgggctgggccttcctccacaggtcaaagcccatgtttggggcgatggtaatggacgaaccgctagggcggtaagaaatattgttttggagaaatgccaacagcaccaagtgtcgtttgaaaccgttccgcatgccgagtacatgcgagctgttggcgatgcgctggacggaaacccccaaaatttcgaaaatctgctggacgggttgttgcgcgctgctgaggacgcatatatgactgcggtacacgggaaaccagggccaagtgggcatcagaccggctgagggcagcgaatcaacagttcggaaaatgagcgaagcgaacgaatgggaaataaactgacaacgacctgaacttttggcgtgtgatgtttgacacccgacaaaatacatttttcaataaaaaaatgagcaaaatgttttttgtttagtgtttttgataaacaaatttttccatgcttcctggcaaagaatttcatttttgggataaatttaaaaattcttgtgaatatttttaacatttttccgtccaatttttggctttttggacccccaattttatacataaaa

SEQ ID NO: 42163 - DNA, 926 bp, Heterodera glycines
attagaatttataatgtatgaagtcaccatttggcagatgaggatcataaaagagcactctgaagccaaatgctttgcgcgaagagccttttcgacaattaaaaatgtagttaaatttgaattggccaaattcccaccacggcagtgccaactcggcccaggccaatcagtcctagcacactgccgttgatccttgctgagccggacatcaggtcacgtaactgctcgacactcccgggctaaaaaacaaaaataaattaggtacgtacgatcggccttttttgaattagcaacactaattatggcaaattaaacgcacctgttttcccgcttgaaccgttctcgcggcccaaaatgttcgcctgaacatgttcaaaatcagcgacattgtcgagtccgccgtttcctccacacattcggcgggcgaatggcaaatggcaatgcctgagggggggggggggggatgcatttaaaataaattaataacaaaaacaaaatttaattaccctatctttggcatacccccacccctcaccagggatttatcaatctctttgagaaaatcgtggcaatcctaacaagcattgtcacaaattcatattccgctgatccattagcgactgtcagaattcattagctttggcattatgccagattttactccaaagatgcttgccaaggtcagtcgctgcttgcatgtccacattgtgcacgcccgagccaattcggacaacaactttgagcgccttgaacttcaccaaatcctcgcggcccaaactgatcgaatggtaaagcagcgcagcagtggcctcgttcaaaacctttcattggaatttgaaaaaaagggaaaataaaacaaatttttaatttcattctgttggacagagaggggtaacttaacaaaaaatccaagggcgaaggcaggg

SEQ ID NO: 42164 - DNA, 810 bp, Heterodera glycines
  misc_feature (685)..(685): n is a, c, g, or t
  misc_feature (744)..(744): n is a, c, g, or t
cgatttgaattacccaaacggtaaatttgttcgtccattcaatgacatgaatgaagcggtggggttttcgaattcatcagagagtaatgggattactttcgcccaatatagaagaactcattgcatttacgtcttcaatatgactaacagcggggacgatcaggaggcattgtttgatctgataaagaatgggaccaccgcggtgagcatcaaatttaaccactcagtatctgatggaggaataatgttggtggtaatgggagagtgtgactctcaggtgatgttagacaaaaacagatcaataagcaccgacaccactatttaaaccaccccgcattgtcatttcattaaaataaatatgttatcaaaaaagtttcctctaattttacttttccttcgcatttcgattcccgtaactgcatatagagaagaggactcttcatattcagaatatttaagaagaaggacattatctaggtttactagcacaacaacaacaacaacaacaacaacaacaacaacaacaacaattactcccaataccacaccaaatgtgacaacgcctgtactaccaaagcaagaaaaactaattgatgaacatgtctctgctgttctcccaccacttattcgattgtgcaaggacacgccggaggaaagcagcatattccatcaagctatttgttgngcccttttcactctctatttaatgttgatcatcagtttggtgttgcatcaactctgttncattttttggctaaagtatggacagcgtacaaatcacaaagattttgagcgaaaatcgtcggacag

SEQ ID NO: 42165 - DNA, 1387 bp, Heterodera glycines
  misc_feature (11)..(11): n is a, c, g, or t
  misc_feature (1317)..(1318): n is a, c, g, or t
ttggacgaatntacgatggacctgtgttcggctttcacttcggcaaacattccatttttcaaattggaaaatcagaaatttcgaggtctgtttttgggatggcccatcaaaaaaatttatttaggctttctggaaaagtattgcaagcgtatggttctcatagggatgtgttgcagcaacgttatttgtcagcatgttttaagcaggtttatccactctacatattcaaaaacttggtcataattcagaaaatggctgaggttaaaaatgatttcaaaacccaaaaaatctgggcatcagtagacgagactactgattctaaaggtagatatgtcgcaaatttgatcattggcattttggatggaaaattgcacaacccgcatttggttgccgtcaaatttctggacaaaactaaccatgaaacagtcgctcgatttgtcaacgacaatctgagggagttgattttggctgatgacctttggttgcttgtcactgacgctgcgcgttacatggttaaggcagcacaggttaaataaaaaatttacagaaaagtggtacaaaaaacatttttaagggcctaaaaattttctacccaaacctcattcatctaacatgcctatttcacgggctcaatcgtgtgtgcgaggaaattcgtggcctctatccgagtgttgacaaattggttgcgagtaccaagaaaactttttcaaaagcgccgtcgcgtgtggccaaattccgcgaactttgtgatctccccctcccaccgcgtccaatcatcacgcgttgggggacttggctcaacgcagcggattattactgccaaaattttaaccaagtcggagcgattattcgagacttcaacccatccgattctgatgcaatacggcaatcacaaattgccttcgactctcctggtattcgcggagatttggccttcataaaatcacattttgatattttgcctggagcgattggaaaattggaataacgcaacctcacactcattgaaagttaataaaaaaaaactcgaaaattttttattcttattttctaggtttggacatagtaagcgatgtcggaaataaattgaaactggtaccgggcagtgtcggcaaattggttcaagaaaagtttaacaccgttttgcgaaacaatccgggatttgacagaaatttttggttgggtttagaaaaagttttaaactcatattttttctaggaaaatgggtatggttttgcgcggcgaacacgttcaaacgcattaaccctccggatgtcatcgcaatgttcaaatacgcacccattcaatcatgcgaanngtgagcgttcctttttcggcatacaaaaatatactggcagacaatcgggatgcgttttacgccggaaaa

SEQ ID NO: 42166 - DNA, 937 bp, Heterodera glycines
  misc_feature (838)..(838): n is a, c, g, or t
  misc_feature (894)..(894): n is a, c, g, or t
catttgtatggtacaaatttctcgcaaaaaagagatagtcatttttctcggatagagaataaatttaaaaattccctcgtagaatagaacggccatcgctctccgcgcccctccgcccacgccgggaacatttgtatggtacaaaatttctcgcaaaaaagagatagccatttttctggcatagagaataaatttaaaaattccccgtagaatagaatcggccatcgctctccgcgcccctccgcccatgctgggaacatttgtatggtacaaaatttctcgcaaaaaagagatagccatttttctggcatagagaataaatttaaaaattccctgtagaatagaatggccattgctctccgcgcccctatgcccatgctgggaacatttgtatggtacaaaatttctcgcaaaaaagagatagccatttttctggcatagagaataaatttaaaaattccctgtagaatagaatgcccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccatggctctccgcgcccctctgcccatgctgggaacatttgtatggtacaaaatttctcgcaaaaaagagatagccatttttctggcatagagaatagatttanaaattccctggtagatagaatgggcattgctctccgcgcccctctgcccatgctgngaacatttgtatggtacaaaatttctcgcaaaaaagagatagc

SEQ ID NO: 42167 - DNA, 1099 bp, Heterodera glycines
ttttttttttttcggggcagtcccccccgaaccgatgcgcccagattttttgggggagaccgattccttcgggaatagctttccctatagcctgtactttaattctgcggtgggattttgctccccataaaggttgagtaccccacacgcgcactcgaaaaaatcgattttttttgttttcggggcagtccccccgaaccgatacgcgcagatttatggggagagcgaatctttccggaatagcttccctatatcctgtgctctaattctgcgttggatttttgctctccacaatagtgtgagtgccccacacggacactcgaaaaaatagatttttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaaatcgatttttttgttttcggggcagtcccccccgagccgatgcgcccagattttatgggggagaccgaatccttccggaatagctttccctataggcctgtactttaattc

SEQ ID NO: 42168 - DNA, 762 bp, Heterodera glycines
tgatagaccgtctagcaggcacattcatttctttctcaccaaatgtaataaaaaacaatatttagctagttcgatatttttagcgtaaatttaacgaatcaaaaaaattgagaaattttattgtaatttggataatttaggtgaatatttttaacgttttatgtgtatttttcactcattattattttttagcaattaaattaaaaatgttttttgttttttccgttgttgaataaaaaatatttggtcatttctaaaatttttttaaagttattttgtggtaattttttgggttttttcacattctgtgccactttttttgcaccataaaacaatgaaattttcttccccgtcaaaaaaaatttttttgctttttctgttctctctggcgacataaaaatgggaaaatttttgcatttccatctcgctgatttcaatgcacaccaaaagttcacagacgtaacgctgggattcataaaagttaaagcttgaaaactcttaaacagggcattaatgccatttattagctcttaattaatgaaatggccttatttaatggtggcaaaacttaaagaaaatgattttgtctgttgcttggcaaccaatttcacactttttatgttaattaatcagacaaacagagcatagaatgaaagtcaaaagacttgccaatttatcctcggcactttttccacttttggcattatttttcctcttcttcgtcttctccaatttgaccaattcctctctgctcattagcat

SEQ ID NO: 42169 - DNA, 141 bp, Heterodera glycines
gatctggttcaaaccgactaccacgccgcgcaccagcggcagcaaggcatagagcaccagcgcaatcagtgcgggtgtcattccggttcctgctatgccgagcgtccccagccacggaaaggccgtaaccagcgcggcaag

SEQ ID NO: 42170 - DNA, 583 bp, Heterodera glycines
gcgcattactcaaattggtctcgtccccaaatggtgccatccgtttcccatggccttttttcagcgccaaaattcccgacgacgataatgatgattataatattgatgaagatgatggatacgtggatacctttcagcgaatacatacatcgttgaaccccttcacctcaccacaatttgtggcgcttgaacgggcctcggaaggggcgggggcgggggcgcgcgggcgggaggcggcggcgatggaatgaacggcgcgggcggtggcaaaatgaaaaaattgggggacggttcgcccgcggggggggggtggcgggcggacgcacaattacacgtgggggggggcgaggtgagaaaattaaagcaaaagcaaccaccaaattggggggggggacgacggacggaagcgaaatattgtgaagaaagggaatgaatggaatgtgcctggggggggaagggacggcaaaagaagtgccaaaaatggacgacaaaaagtggaaggttccgcagaggaaaagtaaaagcacagaaaaacaaataataattttatgtttttttggtgggcgaggggcaaaaaaaaata

SEQ ID NO: 42171 - DNA, 468 bp, Heterodera glycines
tgtgtggcgccgagtctgcttgagaaacttggtgggtgggacagagggaaagggaggggcgggggagttgaaccgctgctctcttcgacaatttcagtcccaaatttccaaattcccttcccttggcagatgacgtcgactctgtccgtcttgtgcccgaattggtcattttccttgtgcggcaggcgcccgcactgctcgacggctttctggaggatgggccccttctgttccatcacccccaccagcagttcgccccctcctccgcctcctccgtcggtccctctccgtcgtcgttgcatcagtccaccgattcgggcctttccgaagtcggagcaaacgcaagtgtagcaacgacgacgacggcacatgcgatgggctcaaaacgacgggtccacgggggagcagcagaagggagagaaaggggaggaggagggattttggtgagggatttggggggggggataa

SEQ ID NO: 42172 - DNA, 815 bp, Heterodera glycines
tattgttcaacccctcaaatctcggaaattttttttgcgggtcaaaaaggggtgaaaaccatttttctaaacagttttatagtgcagagcatgaatatgagtattatttaacgttacacaaatttttgaatttttaaaaaattttgaaaatttttcattttggccctcgggaatctggactcgtatttgaaaattcataactcatttcaaagtgggtcaatttaagtacaataaagctttaaaaataaagaaaaataaggggaattttatgaattttattttaaatttctatcatcaaaatgaaaaattttttccagaaattctggaaaaattcgaattttcagacaaaaaatcagaactcggttcttaaaggaggttttcgaaaattaatatactcaaaaaacccgcaattttttgctctatagaattgtatttatttcatatttctactatttttttggaaaagattataaaaataaattgatttgggaatttgggaccataggggggagggaccacatggtttctgagtgggaaaaattttttcacccaaatttagctgaaaaatactttttagtggtattttagggtgttgatataacgaatctgtaatcagatttcgctttcggcatcgtcaaagcccagaatccctgcggatatactcgatccctcctgctggaggggggcattttattggagaggggcattctacaagggaggggcattgtattgttcaacccctcccaaaacgggcatttaattggagggggcattctaccagagaggggcattcaaatagcggatttacggtatgt

SEQ ID NO: 42173 - DNA, 960 bp, Heterodera glycines
ccaaattcatttataaggaatgcatcggaaaaccaatttcattaacatcaattatttattgatttcattcccataaatttgagtcaagaaaattcgaaattgatgccattgaatgagttttaatcagctgtacagagtttaaagcatttaacagagtttaaagcatttacatctccataggaaacatgaaaatcttctgtaaaatttttgaattaaaatattttaggaaaataattattttttaccaggtccaattttccaatttgaccataaatttgctaatcatttgcgttgccgcctggaccatgagtcacgaaatccgaatcctttatacggcaattttcttgacccgccggcaaccctttgagcgaaataatgtcatgcaaaatggaaaaattaagtaaaatagaatcattcagtagcaatgattgttctcaattagaaaaacttaataatttttttggcgaaatgtcttttatttaaaattttgaagatggaatttgggatttgggatttttgaaaatttatacgatttaaattattaaaaagatcataaaatctacctaaaattattcaaaattaggtctaatatagcaatttttggtgaaaattacttaatatgaatgtaaaaaaatattaaaaaatttcccgccggcccataaaaatccttattctcttaaaaaaagacggaatgccaaaatttttgaataaatttataataaaatcaatcaaaataaattcaattttcatctcaaatttcacctagaatttacaaaaaaatttcccggcggcgcctatcgacaccactggatcgacattaatcctgtagaattgagtcaaaaggtgtgacatttggtcatttttttgttcaaatcaggtaattaattgataaaaattttcaaaaaaaatttcagacggcgcctatctgcatagaacggaccccattggttcctatttttt

SEQ ID NO: 42174 - DNA, 1085 bp, Heterodera glycines
  misc_feature (12)..(12): n is a, c, g, or t
  misc_feature (51)..(51): n is a, c, g, or t
  misc_feature (64)..(64): n is a, c, g, or t
tcagatgcttcnactatcaaaaagggagatgaataaaaaatctaaaaattnttaattgcttttnaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcacttttttatttttttagcaaaattaattcataaatattttttcagaaactgctctgaaacgcaccaaatgttaattaaaagttaaataaggctctctgatgctttttctatcaaaagggagatgaataaaaattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttcagaaagtgctctgaaacgcaccaaatgttaattaaaagttaaataaggctctctgatgctttcactatcaaaaagggagatgaataaaaaatctaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttt

SEQ ID NO: 42175 - DNA, 885 bp, Heterodera glycines
ccctccattcccaaatactgcattgcctgtgccagcggtgctggcaatatcacctgcacaattattgtgattgaaacataacagcaacaaatgaacacccacatttggttggccgaaattaagcctccccttaggaatgagaaaagtccatttgagacaatatttgtggccatatgatcactcttttcagaagtaaattcccatgcattcggtcgggtcaaccgaacaatttcttgtgctattttagcaacctcaattgtttccgcaaaattatccggtgagtacaactcggacaaatttgcgatcactttatttctgaaaaattggattggcatttctgggaaatcgatttttccttgacgtgagagataatgtatcgattccgaagaaatttctttaacatccccagttatttggtcatactgagaatgtatcccttttgtctgcacatataagtatcggaaatccttgcaactattttccctcgcatttgagtgtataattagcgtttttgggtctaaaaatccatgtttcgttttttcatagcttccaaaaagccgaaatgtaaccggaagtctctcaaaacatcttccattttgccaatgaaaatgcagttccctctcatttactgcaaaacatggtctgatttccaacatatcttttgtcaccaatcgggccgttaaataagggtttgctaggaaaaaccgggccaaaagtgttggatttgcctccgccaaagtcaacgtctgatcggcgaggaatcgcaggctagtgcatattttatgcactgtttcagcaaacaatttttgtgtatttgctgtaactttgacacttaacgctgtaagctgtgctgccagctgcgaggaatacaccagcccaaccttt

SEQ ID NO: 42176 - DNA, 1306 bp, Heterodera glycines
  misc_feature (143)..(143): n is a, c, g, or t
tgaaagtccgatgtcacctggaatttttttatgtttatgtggaatttgaacaaatcttttctaaaaaagaccaaatttactttatttgtttatcagtgccgctggcgaaagtgccattttcgaatattttgagtttcctttancccccccccccccccgttttcagttgaattgaacgtcgaagccgacgacccacttcaaagttacaaagagcgatttgagcggtcgtacatcgaagggactgaacaattttacaaatgtcgcacagcgcaacttttggagcacgacggtgttctgaattacatggtttacgtggacgggaaactggccgaagaggaggaaagggccaaaagatatttggactcttcgtcgccggaatccatcgcaaaggcaaacattggtcattttgtcgactcatttaaacgtttagttggtggaccaatgcgttcaagtgctggtgatcgaatatcaagaccaacttttggccgttggtccgactctgatcaaaaacaacgaggtaaacaggctgaagacgctctaccgactgatcaatcggacacccgacggaattcccaatttgctcaacgtcttgcacaaacacatcacggcagaaggactcgccgccatgcatgaacacgcggcggaaattgtgacggtacatttttggaattcgatttagaaaaaatattagaaaaaatcatcgaaatttgaatttaggacagcgaaaggtacgtggaacagttgctcaacattgtactcagtgttctccgaactcgtccgagatgctttttacaacgactcgcgctttttgaccgtcagagacaaagcatttcaagaagtggtgaacaacacggaagtgttcagattggagttggacccaaaccgaacgaaaaggttgaaaatgcgcaaaagcaattttaaaaataaatactaaacagtggacgcccagcgaacatcgagtcaaagtgcccggaattgctagcaaattattgcgatttgttgctcagaaagtcggcccttacgaaaaagttttcttctgaagagatcgacgagagactgaacaacgtggtgagttagggcagggcggtccaatggttattttacatttgaagtacaaaacggaaaagaaatttgacttctttttggtgttgttacgtattccgcatatttcgccacttcgttttttagcttttggtgctgaaatatgtcacagctaaagatgtgttcatgcgttatcataagacgcacttgagccgaagactggattctcgagttggtggccgaccaagaaaaggaggaaatgctc

SEQ ID NO: 42177 - DNA, 901 bp, Heterodera glycines
gtaaattcttttttcccccaataaacttgtcaaaccccattttttcgcaccgtgaatgttatttttattgaattctgaaccggtttgagtagattagactagaaaaaataaaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaatcatgtttcccactcccttctcccaggggtattattttgtaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttcccccaataaacttgtcaaaccccatttttcgcaccgtgaatgttatttatattgaattctgagccgttttgagtagattagactagaa

SEQ ID NO: 42178 - DNA, 740 bp, Heterodera glycines
tgttagacctgtcaaaaaaagtctaaaccgtttaaaacccctctttcctatgctccgaaccataaaaaagcaaaaaaaattcatatttcccaccaaaaaaaatttcgacattttgtcggacttgtcgacactttgtcccacccaccccgaacattgttagacctgttaaaaaaaagtctaaaccacttaaaaccccattttccctgctccccgcacccatttacccccaaaaccccgcactcccagccaaatccgccaattttgaccagttttccggacaaatgacctactcaacctggggctaggggtccaaatttttttttaaatgttcgcctcggcgagctctacaataatagccaatagcgccgggcctcccgattcattaaccccacacttcccccggttctaacttttttagaccccgacccaccccaggggctaaaaggggtccggcccttcaacttagtgctggcgcgccaatttttttttaaatgtgcacaacacatagacgcatcttttcataagcaacattcaaaccctgcggataacttaaacacacgcaaaaagcgaaaaagtgccaaaaaaaagtaaattcaaaaaatcgatcataattttttcattatggtgatcacgaaatttttccggccggtcagttttgaagagcttgagctcagctatctttttaaaaaaaacgacccgctagctcaacggcatccattagcacatggaccatttaggtt

SEQ ID NO: 42179 - DNA, 1117 bp, Heterodera glycines
  misc_feature (1099)..(1099): n is a, c, g, or t
gagatttcacaaaaaaattattagtaaaactgtgtccaatattagttataaataaattattatagatgtatttaaaaaaaaatattttttgaatctccttaattttattttcatccttaatacggatttggaagtttttgatgcatatttttttttttttaatttaaatttgtttttttttcaaaagtaacttttttggcacccaaattcttggtaaaatgttgaaaaaaaatttataagccaatttttaatttataaaaaagattctaaggttttttattgaaaataaaaatatttgtttgtgtgttattttgattatttatgctaaatagggtaaaaaattgaaaactttttttaatggaatgcaattttcatataattagtcctaaatcggccaatgatccctttcaaatatgggtcaattaattaaagacaacaaatttttttagctttttttggagccaattgttgcggcacaagactttgacgtgtttgtgccgatgatgatgcgtaaaaacattgaattgcaattacaagcactgaaaatgattgaggtagtaattcattaaatttaatcgttgattaattaaatgatactaattaattaattattgaagcatttgaacggacttttgcccaattcgctgaagcttggtcaggaggaagcggatatgtggaattcgttgactgatgaggatgatagtgaacgattcatcatgatctcagtgctcaagtaaaagatttattttaaaattaaaaaaaaaagtatataaatatttaattttgtaattaaataattatttaaaaatcatcatttgtatataattccacatcaaattcgcataattttcatgaaaatttttgcaaaaaaaaaaaaaaaaatcaaatttagaatcttactcagttatttgaaattttgtaggactttttaaaatcagtatcatatcccggaaaattttagggagggcgtggacgcctgtttaaacttatttatatcaaaaattgtccatttttaagaaaacaaagaaaaatttgtggtcaaacagatgcagaaaggagcccaacagaaaaatttgaaaatttaattgaaattattgantgcaaattgtttccattt

SEQ ID NO: 42180 - DNA, 799 bp, Heterodera glycines
agcaccccaaaagcatggatcggggaggcagccgccccgtaattgttgggcagcgtccacaagtcatctcgaacgacccgtgcccatcagcggacgggggcatttgggtggtgccaacgctagcccaacaggacagcaggtaggtgggtgaataggaatcacttggggtaatcgatccagcagcaggttcacctacagctaccttgttacgacttttgcccggttcaagccactcgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccaagacacggtgaggtttccccgtgttgagtcaaattaagccgcaggctc

SEQ ID NO: 42181 - DNA, 851 bp, Heterodera glycines
tttcaattcatagttgtgtattttctgaaatttttttggggtcatttcttaggagtgtatttttccaatttattgcatttttaatggaatttttcggaaaaaacgccaaattttatttacaaatgatcatttttttgatatgatccgcaccttttttattttccttttttttcgtccgtcggataatcgaagagcggacaaagagtgagtgaggtgagcgatggaatccttttctaatttatatttataatcgaaaataaaaatatttaggtatatatttatttattgcttctcgggaatttcctcatacactataaattaatcgcgcgatattaggattccgattttggggaggccattcgtccaatgctcggaccattggtttttaaattttatggcataatgtaaatctttttttatctaaaaattttaattaatgcaaatttcatcatgttttgagataaaaatttgataaaaaaattagccaaagttcaaagaaaaattcggcgactcctttcggcaccgccggaccataaaaatccatttttgatcccaattgcactgaaatataccatttgctaatgtacgccccaaaaattgattgttcaaatccataatgtgagatgaaaatattatttttgatttattttggtacaaaaattgtaaaaataactgatttgcagcaattccaaaaaaaattctgtttttttaaccccaatcctgttttttaagcctgatgactacttttagaaaaatttcggtagaagccctgtttttatccattttccccctaaattaaatcccttctctcttcgtccatcgtcatcatctggtggggctggactttcatc

SEQ ID NO: 42182 - DNA, 911 bp, Heterodera glycines
ggactcaatccaccagcattcaatctctgggactcaattcttttgcatttcaattactggggactcaatccaccaacatttcaataactgggactcaacccaccaacattccaatcaacgggactcaatccaccaacatttcaatcactgggactcaacccaccaacattccaatcactgggactcaacccaccagcatttcaatcaacgggactcaatccaccagcatttcaatcactgggactcaacccaccaacattccaatcaacgggactcaatccaccagcatttcaatcactgggactcaatccaccaacatttcaatcactgggactcaacccaccaacatttcaatcaatgggactcaacccaccagcatttcaatcaacgggactcaatccaccagcattcaatcactgggactcaattcttctgcatttcaattactgggactcaattctccgacatttcaatcactgggactcaacccaccaacattccaatcactgggactcaacccaccagcatttcaatcaacgggactcaatccaccagcattcaatcactgggactcaattcttctgcatttcaattactgggactcaattctccgacattccaatcaacgggactcaatccaccagcatttcaatcactgggactcaatccaccaacatttcaatcactgggactcaacccaccaacatttcaatcactgggactcaacccaccagcatttcaatcaacgggactcaatccaccagcattcaatcactgggactcaattcttcagcatttcaattactgggactcaatccaccaacatttcaatcactgggactcaacccaccaacatttcaatcactgggactcaaccaccaacattccatcactgggactcacccaccagc

SEQ ID NO: 42183 - DNA, 935 bp, Heterodera glycines
tatatctctgcgaaattccagatccaaaaaaatcagctatccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcact

SEQ ID NO: 42184 - DNA, 110 bp, Heterodera glycines
gataaccagagcggttttccctcctgggaatgcttcccttcgtggcggcttcttcctggttccgaaccctggccggcttaaccgggataacctcggtccggccttttctt

SEQ ID NO: 42185 - DNA, 705 bp, Heterodera glycines
aatttattgaaccgacaaatgaatataagcaaaaaagaaaatattcaacaaaagaacggaaacaaaattataccgaaatttgtaagaaaatcggagttaacgaaagaacaattaacagatggaagaagcaatttggcattcgcggtaaaataacggatgaagaaaaaatgggaaagatgaaaatttattggaaaataaaaaaagaaaatccaaaaatgagtgaaaaggaaattgcaaaaatgatgaatatccatcaaaataccattttaaaatggaaaaaacaatttggagaagaaatgtttcagaaaacaggagaataagaagaaaagtgatttgcttgtgctttttcaatttaaaataataattttgttcttttttcattattaattatgctaattataacaaatgaagcaaaaatttgccattcactgtaaaataacggataaagaaaaaaaatgtaactaattatgctaatttcctaaattcttgataaaaagtctgaaattttcggaaatttctattttggagttttattttttgaattacgtaaatgttttagcaattcaaaaagattcactaaggggagccaatcagggatgggcgaaacttcgagcttcgagctttgaaaacttcgccttttttgggctttgaacttcgagcttcgggtaatttacgcgaagtttcgggaaaaatacaccccctaaa

SEQ ID NO: 42186 - DNA, 1744 bp, Heterodera glycines
ttctccatgattctgcttgaaattaatttccgtcccatcatttgaattgctgaacagtgtttgaattgtaacattagtggactatgaatagagaatagggatgaataaatttattggaaaaaatgaacgaaatttaacaatgttaaaaaccccaaaaaggaaaagaatcaatcgattttaatcaaatttaaattttcagtcaaataaaccacccgcaaaacaacggttgtcattcgctcgttgttggcccttaagcaagccaagataaaaaaatgattgcaaaaattaagcagaaccattggagaaaaaattaagttgaatggaaatatattatgtatagatttttgaaattattaatattaatttaaaaaaatattgctttaaaattaaatatttttactttaaaatatttaaatttaaatatttttattcacactaattgtaagaatattttcggttcgcccacactgagaccattttcggttcgtctcagcacgctctccttacactgcaatattgaggacttttttgacagattttatcaaaaaatgctttaaatttttaaacgtaaatattttttttccacgcagctaaggcaatgggttgagctgtcgttggatgagcaggtgccgccctcactggttgttgttgacccgtgccatgtacttccctgaggacgtggacttcactgctcgcattcgttccattgttggctcgctgcccaaggaaattggtgacttcaaagcgatcactctcaaagagtgggagggcggctctgacccgcaggtaaagaaaaaaaaattcaaaactttcgtataaaacaggcccccatcatccagaaaaaactgaaaaatttaatggctgtaactatgatgcaaatttttgcattgccaaaaatggcgccaatttgtgcattttttagtcgcatttttaaacgacgtccattttgcaggcaaaaatcgaactgttgcgcagcattgaggcggacctgaaggcggagcgcaagctgcgcgaggagcgcaatgaaataaaaaagaaatcaaaggggaaatgatcttttcgggttgaatattttttttgtcaaaaattgcaaaaacaaaatacctacggtttcgctttcctgaaacaaatccattcctaaatccctactagcccaaaattcgaaaaaaaaaatttgatctgttccttaaggttatgatgacaggtcaaacaaacacggccatgaatggcttaaaaaatgaaattttttttatttgccttacggtttgcccttcatttacagtatttgctttaattatccccagtctacgaggcgtttgaaaaataatccataatccctctgtcttaatcccccagtctacgaggaggttgaaaaataatcccccatggggaataattagagctaatacggtaggtatactaatttttataaattttaatcaacaaaaattgttaaaaaaaagttttgcataaaaccgcaacaataattcgtcatcattttgttgttgccgcctttcccggcctcttccatttgttgtttcctgcaccggtctttgttctttttgccattccgacacctttctttttcgtccttttctgcttcggctgatcattgttttcgtccaattgagcgggaaagaatggcggcaaattctgttgctgatcacttcgctgttggctgcacacaatgagaaattgtttaccgtatttattgaaataaagccaccgggggctgtaattcagg

SEQ ID NO: 42187 - DNA, 698 bp, Heterodera glycines
  misc_feature (640)..(640): n is a, c, g, or t
  misc_feature (681)..(682): n is a, c, g, or t
atttaaaattcagaccaaaattgtttttccccccctggcgacttttttaattgttaaaattatttgactatccccttttcatataaatttttcgtaatttatttttaattaataaaataatatttaacattttgtaggccaataaaaatttttgaatttaaattctttaagcttttctctttgtttttttaagaatttaacaattttttcatcgaaatttggtaaaagttcttttaaaaattgctttcttggcattttgtctaccgcctctttcaggcccactcgaacgcgatcaccaagctggacaagacgggcaatgacatgatccaacatgatcactacgaaaaggaaaccattcgaaaacggttggaccgtcttcatgacctgtgggaccgactgttcgccatgctggagaacaagggcatcaagctgcagcagactctgaaactgctccaatttgtgcgaaaatgtgacgagatgctctactggatcaaggataaggtgagggcgaaaggggggatttgaccaatccaaggagcttgatcaggcagaactgatcagattaaggctgtgatgcctgaaggaacggagtgtgggagaaagtgggataaaggacctgagagaacctctaaaagaggcngcccgtagctcagttggttagagcacggcacggattgctgnnggtcgtgggttcgagt

SEQ ID NO: 42188 - DNA, 1033 bp, Heterodera glycines
gccttttttgcattggtgggcacttgcaaaaaaatatctaaatttgtttttttatattaactaatatttcaaaataattatcaaacttttttggcattcgtcgtttgaaactttttgcccggtcgcaaaatgaattagagcaataaacagaaacggacagatggattttagcattgttaaaggcattggtatacgaatagtaaataccgtaaatatttttataataaattgaaaaaaaaattggaatatgcaatagatttattatattatatttttatgaatgttaaaattttggagtattgaagtaaaaatcgattaaataatgttggcatttatttctataatttacatagcatatctaaaaatttaatacccagcagaaagtttttgatgctgactaaatacatttatataacttataaaatattaaatatgcgaaatctctaatttgatattattctcagttaaataaattcaacattttaaaattctttctacattttacagtttcattcgttaaaataacaatttgaagaaaaaatgttagcaaattttccttaaaataaataattaaaatgacttaaataaaataaattaatgatattattaaattttatatttttcccaaaatttccgatttccggcttccgacatttttggggtcggaattccgatttccaaaaattttgggcctcagaattccgatttccaaaaattttgggtctcggaatgccatccctaatctccactgataataggataactcattgcttcaatatgtgtaaaaacgagacgacttaataaataaatatattattataacaaatatttaaaaaaaaatgcaaaagatcaggaaaaattaatcaataggtttaaaaaattagttgcctattttttgtgcctatttaatgcttattttgcgatttttcatacaactttagccgatttaaatcatttaaaccaataggctaattatcagttttatttaagagaagtttacatttaaaaaattggtgcgataaaaattaaagaa

SEQ ID NO: 42189 - DNA, 979 bp, Heterodera glycines
  misc_feature (36)..(36): n is a, c, g, or t
  misc_feature (936)..(936): n is a, c, g, or t
  misc_feature (960)..(960): n is a, c, g, or t
aaaataagtcaaatcagtatttgcgttacattattnttttttctatttcaaaaaattgtccaaaaaaatttttaaagacgatttttgataaaattttcattgcttaggcgatttattttcagaaatttttgaatcctctgcttaggggtgtatttttaaattccaaaaaaatcgattcttaggggtgtatttttttgtttttattgcatttttgttaacaaattttcggcaaaacgccaaaataggcaaaaataggctttttcaaaattttttaggctttttaggcgctaaaaataaaagcctagaaaataggcactaataactcgaaaagtagcttaacaacagcccaaaaaagcatgtttttcgtacgtttaaggccacggggagctcaggaaaaaatagccttttgcctaaaaattggagccctaataataatataactaactctattcaactgactttgcttcgaattgtgtgcccatcgaatgcgttgtgcaaaattcggccgttcgactggtcaccgatcagtgagccgtaaatgcccatttcgctcacaacatcctccaactcagccggctttgcttctcgcatcaaataattctttaaaataaaaataaactaataatgggtcgtttcataattatttttcaacctataaaaagtatgccaaattttaaaagtaaaaacaaattatttgtatttggtatcattcggtgcagaataccgaatttgaatcaaatgaagctaattttaactcaaatagttaaaatttaaaaaagttattgccaaagaaataataaaaccaaagattgacataatcaccgttttttaggatgcaaataattatgagataaactaataatagctttatttaacttaattttttttcttaaattatttaacagattccgattttttaaaattattttcaatttnaaaatcacaaatttatatctttgntcaccttgaccactaacgg

SEQ ID NO: 42190 - DNA, 1099 bp, Heterodera glycines
tcggtctaatggtttcggttaaaaaccgaaaaaatcgaaaaactcaaaaatttctcggtcgaacggtttcggtataaaaaccgaaatcggtaaaccaaagaaaaattttcgatttatttcggttttttgaatttgtttatttatttttccaaaagtgcaagaaactatttttataaacagaaacggctaaaaatcaactctgagcaaatagtagagctattgaagctctatcgaattgattgtttactataagtataagttggaaaaattttaaaaaatttcgagctaggtcccttagaaaatttttaattttttggccccttgggattttagtaattgaaattttgcatacatttgtagcttgggacggcgcatccgggaaaattataatttttgatccatgggccaactgatcgccagtgactgaattcgcatttttgcttgcagtttaggacccgtaactctttttcaaatacacgaatcaaaaaggggaacctcacagttcagcgccaacactttcggcaccgttgctaatatattttattttattaaccaaattaaatatttttggtagtattcgatagctcttaatgttttctatcaacctgcaaaatttaaaatttttttgtcagtttacaaaaaagttatggacaaaaaagctcaaaaaataacattttcacattaaaatttatatttcaataagaaaagaatttattaacaaacaaaaaatggttgcattaaattaccgctttcaaaaaaaaatatgaatgttaatcaaacaaaaaatagattttaaaggttttaaaaaaagacgaaagagacctggaatgcaaggagttgctatgatggtcaagttggattgatttagaaacgaaagctaaaattgtaagaaaattttttaaatgtaaaaagaaatgcaaaattaaattactaaaaaattattttattttaaattttataaaggaatgatgatatatgatttatatactgagtttgaaattaaaattttatattttatttaatttcgattaaattaaagagatctaaaaattaatataaagaacttaattactattttaaaagtgaatttcaaaattag

SEQ ID NO: 42191 - DNA, 1064 bp, Heterodera glycines
aaaaatggcgagcgatgcaatgaccagacgacggaccatttcgggtctcgaatacgaggatttttcgcagaacgaggggaaaatgctcctggaagaggaggacgagggtggtgaaggaggaggcgaactgcttggaggagtagtgggccgaagaaatgtggtccaagtcgaacacgagcatcatctgctcgaagggtcggcccgtctgaagggacagagaaaagggaaaagcgacggacggagcaccgatggccaatggcaccgattgccaattcgttacctgcagggcgcgttccctgcacaatgtgatgcctttctcaattgccgcgagcgaaaatttgatgtaatccttcgattggacagatcgcaacatcccttgacaaagtcgggatgatcactcagccattgttctcccgtggtgcatcgatttgtctctaatgcacttttaagcccaaacatcgctacgttctaaaagcatcccatcattgccctccccaaccattcgcttttccatcaaagtttttgtgctttgcggatagaagtgaagaagagagtggggggggggggagaagccaaaggaaaagcgaatccatcgcaatgcccaaaaagcaatgataaagaaagcattgatttggaataatgggaccaattaagcatgttaggcttccttttcggcattgtgcaccttctacgtcagtatttccgagcagagacatcagaatgggattgccgtcgtggtcagagaggaagccgtagccgcagtatttttccaaaatctgcgtaagattgtccaaatgcattttgactgagtgtgtatcggcactcacttccggcgcttcccaatttacaattttgtccagtccccatgcttttcggaacaccaaatccttccgaatgccctgaataaagatcttttaagcgttttcccccctaagccctcacatcggccgcctcgtcaaatttgccttcctttgacctcagccatctgagaagataagcttcgtccacctcttgcttcagaagctgatgtccaaaatttggcgtaagtcgtttatctgatgttg

SEQ ID NO: 42192 - DNA, 931 bp, Heterodera glycines
  misc_feature (608)..(608): n is a, c, g, or t
ataaatctgggcacatcgattgggggggcctgcccagaaaaaaaaaaaatcgattttttcaagtgtctgttgggggtactcaaacaattagggggagcaaaaatccaacgcagaattaaagtacagtatatagggaagattctccggaaggattcggtctccccataaatcggggcgcatcggttcggggggtctgccccgaaagacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaataaatcgattttttcaagtgtccgtttggggtactcaaacaattatggggagcaaaaatccaacccagaattatagttcagaatagagggaagctattgcggaaggattcgacaaaaacagagagaagaaaacatagggggggggtttctgttttggggggaaagaaaaaaaaaaaaaaaaaccttaaggggaaaaaaaaaaaaagtttggggggcgaaaatttttcccaangaattaaagtacaggctatagggaagctattcccgaaggattcggtctccccataaatctgggcgcatcggttcggggggactgccccgaaaacaaaaaaatcgattttttcgagtgtccgtttggggtactcaagcaattaataaaaatttttagatttttattcatctccctttttgatagtgaaagcatctgagtgcctaaaataacttgtaaataaaatttggttcgtttcagagcagttttgaaaaaatagttatgaattaagtgggctaaaaaaatagaatagtaaagggataaaatttaataaaaaattttaaatt

SEQ ID NO: 42193 - DNA, 937 bp, Heterodera glycines
  misc_feature (595)..(598): n is a, c, g, or t
  misc_feature (600)..(600): n is a, c, g, or t
  misc_feature (606)..(606): n is a, c, g, or t
  misc_feature (608)..(609): n is a, c, g, or t
  misc_feature (612)..(612): n is a, c, g, or t
  misc_feature (621)..(621): n is a, c, g, or t
  misc_feature (624)..(626): n is a, c, g, or t
  misc_feature (628)..(629): n is a, c, g, or t
  misc_feature (632)..(632): n is a, c, g, or t
  misc_feature (637)..(637): n is a, c, g, or t
  misc_feature (645)..(646): n is a, c, g, or t
  misc_feature (649)..(649): n is a, c, g, or t
  misc_feature (654)..(655): n is a, c, g, or t
  misc_feature (657)..(658): n is a, c, g, or t
  misc_feature (661)..(661): n is a, c, g, or t
  misc_feature (667)..(668): n is a, c, g, or t
  misc_feature (675)..(675): n is a, c, g, or t
  misc_feature (678)..(678): n is a, c, g, or t
  misc_feature (683)..(683): n is a, c, g, or t
  misc_feature (691)..(691): n is a, c, g, or t
  misc_feature (695)..(695): n is a, c, g, or t
  misc_feature (697)..(697): n is a, c, g, or t
  misc_feature (701)..(701): n is a, c, g, or t
  misc_feature (703)..(705): n is a, c, g, or t
  misc_feature (708)..(708): n is a, c, g, or t
  misc_feature (710)..(710): n is a, c, g, or t
  misc_feature (713)..(713): n is a, c, g, or t
  misc_feature (739)..(739): n is a, c, g, or t
  misc_feature (750)..(750): n is a, c, g, or t
  misc_feature (766)..(768): n is a, c, g, or t
  misc_feature (797)..(797): n is a, c, g, or t
  misc_feature (810)..(810): n is a, c, g, or t
  misc_feature (818)..(819): n is a, c, g, or t
  misc_feature (828)..(829): n is a, c, g, or t
  misc_feature (872)..(872): n is a, c, g, or t
  misc_feature (875)..(875): n is a, c, g, or t
  misc_feature (883)..(883): n is a, c, g, or t
  misc_feature (887)..(887): n is a, c, g, or t
aatattatacttgttaattataatttctaaaatttttcttaatgaataaaattttatttgcttcgaggttattctttaatcaggaagattagagaattgaataaatcatggtttacacggcttgcttaaggcctaacaagcagattcgacaaggttaaaattgaatttacaaaatataatcccttatacaaatgttgactttttatattattctttttaaatttatatttaaaatattaatcgtattaaattcatggacatcaattcattaattaatttaattattttatcaatcattaagttttttcgcatcgtctcagcacgggcaaatctatcattgagctaccgaggcacatccactctttatttaattggccttagcaaccctcgtttccgagttataaacgcccagacagcttcttccttgcattaccttttgggcacagttggacagactcttccgtcgagaatacctccgaccccgtccattccgctaccattttgacatttaattttttttgcccattcaatccattaaaaatctcaattaaaggaacttcttcggaaatatttctcacaatgctaaattttcccnnnncnaaaacncnnctnttaaaactnatnnncnncantaaanaaatattnnacnaattnnannacnaacatnnccaattnaanaacanattttatnaaananactntnnnaananaantcaaaataattaaacaaatttaaatntaaaatcaaanaaattaattaattaannnatcttttaaatacaaattaatcaattttnatcaaattaaaantcaattannaaaatatcnntcataaaatcaaaactcaaaattccacaaagcactcacaatcnatntaaaaatnttcnaaatggctggtaagtgaattaggggcgcgcttgcccttattcaggctgag

SEQ ID NO: 42194 - DNA, 932 bp, Heterodera glycines
  misc_feature (904)..(904): n is a, c, g, or t
cgacaagattaagtgcaacgcactgtaattggtgatgtccttcaactgaacacgtgctgcaatatttattccttttattgtatggatatattggaatagaactatacgaccgttggaatatcacttttctatctttattagtttcacctaattcttttatttacacagcacactcgctttcatacattaagcacgctcgtaattagataaacgttcatatacaatagttgagtcggttaccttcacgcacacgccgcaatcaatcgttccacctcgtttccacggagtggttctcgtgtcgggtgtggctcgacttcgtcggggacgctcgagcaaccgaaggaaagggaccaacttccacccataaccatatgtaaaccaaaactagccactcgaaggacggcgaatctcaaacgaagggggcgcaatactcacaatcaacttgtggtgtggccaacaaccgatgggatgttgaaggggaccggaataccctcgctcacttctctcataactcggaagagcatcgaatttcatttcaattttccatttcttacctaatatggttgtccattgcgagagtcgtctgcttgacttatgctggccagtctgcactcattttggaaataggtaaacaaaaataaattacaaaaatgtttttttttaatttaggtttaaggcgttttgctttgtttggtggtgaccacctgcagctcactaaaagcgtaaaattttaaaaactggaaaggtcagcttttcaagctcggctcattcgcagcacaaccgaattcttcttaatttcctataaaggttcgtatcttttatcgtaaaatacttaaaaaatgtttttagctttctcaaatcattcagcgacattatttcgaaatgactgcaaatttggcatggncattggacgaatcatcaaaacccaggtc

SEQ ID NO: 42195 - DNA, 1193 bp, Heterodera glycines
  misc_feature (1059)..(1059): n is a, c, g, or t
  misc_feature (1160)..(1161): n is a, c, g, or t
atagaaaaagtggcggaggaggggcagcaggggaaaatggccaatgattgatcaggtaaagagaaaaagcggatgcttcagggtattcagatgtttgtaatttttatttgattattttcgacgtcatggttttgatgtgccgttttttgattgtgccacgtggcacaaaataataaaatacctttttattaaattgagattatagagagtttaatagattaattaatttcttcaaaagtaatttaaaaaaagaacagactcagaaagagagtcaaagaaaatacgtactcaaatatcgtccaaaaaaaaaaaaattaatttggcccaaaaacggaaaaaaacaaaacaaacaaaattataattactaatagagtaaatgtgcagtgtatgcactaaaaaagccaatgaaagatgtcctaaaaattgccaaaatggattccataaaaatgtaaaaacgtttatgtaaaaatatgaagatgacaaaaatagaagcaagacaatggctaaataacatatttaaaaaatcataaaaattttttacgaatgttctatgtactttagagtttttaatttaattatctgacaaatgcaaatattgaaaaaatatttgcaaaatttcctcccataaaactaaaaattatcttaacgcagaaatgccctttttgagccccgttttatgcgtaggagcagaaaaaaaatgcaaaatcatatatttagaaccttagttacctaattaatatctttattgcttttaattgattttttattgttagagaataaaaaactgataaaatttagaggaaaaaccaattaacgatcagagagagcaattgacattatcaaaaatttgccactttttatggattttcaaagcgaaaagctcacgtgaaaagggcaaaaaataaatcggagaaaaatatgttaaaaattcatgaattggatgaggttgttatggattgtggaagaagcaaattgcggagcgagaagaaggcggtaatattttttgttggaatttggcgcaacgaaagggaaagtgcggcgattgatcgcccccgcggngtgcacttggaggaaaagccaccaccaccagcagcacaagcagtaaagtaaaagcagcgatttggtggatgtttgtgctctcacagcacacccattgatgnngctgattaatcattggcgtcagttacagaaaa

SEQ ID NO: 42196 - DNA, 1335 bp, Heterodera glycines
acctatatgaaatgtttttacgacttttaaaaacttactttttttttgtcaaaaaggtgtggcaccatctaaactattacccaaaatccgacataatttctccatttcgcccgtccagtaagctccactttactcggggatagcactcgcacatcgatcgaatacttaatcgctttttaagaatcgttccgtcggacgtcaaccctcttacaacgggcatcgaaaccgtcggtggagtgatcgacaaaaccgatcactcgcaacaccgtcattccgaccaaaaagtctcagatattttctaccgcggcggacaatcagccaaccgtgactattcaggtattacaactacgataattattacaacgctgactatagtcgccagaaaaaagaacatttacattcgatcgagttttaatatttcccacgggttgtccaagcattggcttcgtccctatttaagcaatttttcgtagcattttgtgcttccaaagagaaggaaaaatgggcggaaatctaagcataatagtagttaagacgcatttagtacaaagtgttttaaatgactggattgccaatttgtatctatattaaaatcccttttaaggttttaatttaaaaataattctcattaaaatgaaaaaattaacaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccaggtgaaacggttgtcctttgctagagttcattacgacaatttagctcggagacagtgaaaagttgggaggaaaactcagtgcggaggacaaaacgaccatcgaaggggctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaacgccgccgactgaggagaaggacgagctgtgaacggtggaatcaccaagtgctaactgtgacaactttccctggtctatcccccttccttccccactat

SEQ ID NO: 42197 - DNA, 985 bp, Heterodera glycines
ctaaaaattgggttattatcaatgatggattagtgtgcacctttattctttgtacttatttttaaacttaaacaagaagagtcttaaagctcataattaaaatattattatttcgtttttaatttgctatttttatccaacagatccggacagaaaaggacgttatcggtggcaccgccgactttcattatttcggcaacaaaagcgaagcggtggataatagcaaatcgcattcgtcggcttagcgtcacaaaacggattaagcaccaattccgaggttaccaactttagtaagtcctaaaaagaaatccattattgagaaataaaataaaatttcatttattcttaatccaaatttaaaagaaataatcagaacaaatgagaatggtcaccagaaaaattgagagagcatttcttgaaactgaaaaacgaaatccgaaacatttttaatcaaaattttggctgaaagcctgggcattaaagcgagagttggggtacaactttggccttgagcctcggactatttgggctttaatagtgagtaatgacacacaataaatggtttaattgccctaaaaatgtttaaaaatatattaaattgcgcattttcagttattttgctgacgaattcactgagcacaaccattgcagaaacattgacctgaccatttacacgccgaacccgaagctgtccaacgcaagtgcgcacctttttcttggctacgacgagcaaattgcgaaggggccgtggtgctatgtggagaaggtatacggtagcaatttattcggtaggtaaccttgacttcgggtaggtactgtatgcatcgtaatgggaatttgactctattcttaacagaatttacaaaaaaattgaccatttgtgattggaccaatttaataatttatgaaaaaatagtaaacgggcaaagccacaaaacagagggaaatgcccgagtttcagcccatagaaaaattttcattataa

SEQ ID NO: 42198 - DNA, 636 bp, Heterodera glycines
taacctaagtaattggagttgcctctgtacaacagtgtacttgttgccttttgtgcaagttgtcatgatacctctaaatcacaattgctgttttactgtctgtacggcaggggtggggcacgcacagaaaaatcccgcggtcacggatcgctcatttaaaaactcaaaattttccaactttttaaacatacatttttttaaacttttttaaaatttccttattataaaaaaaattaattaaatcccggtgcatataagatttgcgacgggactgaaaaagggggggagggagggacaaaatgacctattttgtgatttagagccaatttttttaaagaaaaattaaaggttttgtcagctctgacgaggaaaaattggaattttgaaacgaattttttaagaaaaataatccaagttttcaaaactttttcattaaaattttgaatattcaaaaaagacaatcgcttcaaaaaaatttctttataaaaattttgccccaaaaaaatgagcggcgcgcaaaaaaaaaatcccgcagtcgcggattcaaattgccgcggtcgcggtccgcgcaaaaaaaaatgccgcgaatcgcagtcgcgtcccagccctgctgtacggtaatattctgttatgaaa

SEQ ID NO: 42199 - DNA, 1232 bp, Heterodera glycines
ttttatgtaagaaaaatctcgaaatatgtataaaaaatgctaaaatatgtacgaaatatgaccccaaatatgtactaaaatatgtaaataaaattttttaaaggcctattttttggataaaattcttcgtaaaaagtgaaaaggcataaaatgccataaaaatgaccaaaataggttagaatcacattttagtatttaaaaaattaaatttttgatatatcattttttaaaaaatctattttgaagggatacattttataaaaaatttttaaatttttcaaaaaaattctattaattctccaaaatcctccaaatatgggaaaaaaatgaaaatatgtacgaaaaattgcgaaatatgtacgaaaaagtccaaaatatgtacatatgtaatatgtagaaaaaccccgaaatatgtaaaaacatatgtaaataaaagtcccaatttttgtttgcaaacccaaaaaaagaaagtgtttttcctactaattaggctatggagaatccaggaaaaaatgtgttttacataaaattgacatccctactgattacaaatattttaaagttgaaaccacttttcttaaaaacccaggggtgctctatctacctataaaatttgattccgatttttccattttttctataatttggttcacttttaaattttagcaccaattgtaatggacttttaaattaaaaatatttaaaaaattcaaagctatgattctatttaatattaagttaatcttaattatttttattcgagatataaaaactaatagaagaatgttcatttgagcattaatatacataattaaattttaatatattataattttaaaaatttgataaaaattataggaaaaacttgatttttgatttttgcacgtttctaggaatcgcccatttttgcacttttagcaacgacataacaccctcccccgagtcgcaggatttcatgttggggagggggttgaaagtggcgcgtggtcggggatatcccgaaaaaggctaaaaatgtcggattttcacaaccctaccacgaaacaataaattaatagaaatatcattttaagcgaaacaacacttacgagggcaaacaatcgttcaccttcgaaccggcgttggcatttgacgacgatttcaccctgaaaagttcgttcaaaaaccattttgaatacaatttatacaccaacgattccaacatatttgtgtacgaaaataacaaaatgcct

SEQ ID NO: 42200 - DNA, 776 bp, Heterodera glycines
  misc_feature (11)..(11): n is a, c, g, or t
  misc_feature (13)..(13): n is a, c, g, or t
  misc_feature (31)..(31): n is a, c, g, or t
  misc_feature (55)..(55): n is a, c, g, or t
  misc_feature (65)..(65): n is a, c, g, or t
  misc_feature (127)..(127): n is a, c, g, or t
  misc_feature (145)..(145): n is a, c, g, or t
  misc_feature (156)..(156): n is a, c, g, or t
  misc_feature (162)..(162): n is a, c, g, or t
  misc_feature (169)..(169): n is a, c, g, or t
  misc_feature (184)..(184): n is a, c, g, or t
  misc_feature (187)..(187): n is a, c, g, or t
  misc_feature (205)..(205): n is a, c, g, or t
  misc_feature (234)..(234): n is a, c, g, or t
attttgatagngntaaaattttagaaaattngaattttttttttgtaatgaattnaagatgtttnagattatattgagaaatttttttgtgaaaattttggatgaggtggaatagatatttgtgaanttgattagaattgattanattttattatntgtaanattaaanataaaataaagtganttntaattgatgataagtatngaattattgaaaatattttttgtattgtngaaatatattagaaagatttttagaaaatttttggtaaggaaatgaaataaataagttggtaaggagtgaggaaaatgagggaagagggagggccgttggggctcgggtttgggtttttgcagggtttggttcacttagtcaattggcgatggacttggagaataattatttatttgggaacaagtaggaaataatatatatttatttggaggagggacggattgggaaaggagagaacatggagaaaataataaaacaattacgaatgaatatgggaaacgggcgggggaatatgttgactgggtcaaaggttaaatcgataaatgggatatgaatggacaatgaacatcagacggaacgccaaatttaaatcaaatcccttcttctcacatgcccccgtccattcaagaatcggcccccaattctgatcagtctcccccgggcccacagatgcgacgtcccggcgcatggcgatgaaagatggcgatcagttgacgtccggcttgaatttctgaaaaaatggcaaaaacgggagggaaat

SEQ ID NO: 42201 - DNA, 419 bp, Heterodera glycines
  misc_feature (23)..(23): n is a, c, g, or t
cggtaacaaactcaaaatttaanttgccacaaacaaatgtctttgtagtttttaatttgtatagataagacttgagagaagcttttatgacagggtaattttggtaacagatcatttaaaagcataagaaacctaaatacgccgaaggcggattatttgcgtgagcatggcaaaagcatgaattcttggaggaggggggggggtgtttctaatgctgcttaaaaaagctgaaattgtatttcgcctcgggcgtcattccccgcgaatctctgctacgggaatttgtgaaggcggaaggagagaaatagcgggagaactttcatatcgcccgcagcaaaatacgtaaaagggctaaaagcttgaaaatgataggagaataagtgaaggaagaaacgattggaaagccaagcgcaaaaaac

SEQ ID NO: 42202 - DNA, 925 bp, Heterodera glycines
tgggcatgcgtggcacccgtgctcagttggaacccgagggcttggcgaatgggcatgcgtggcacccgtgagcagttggaatggacatgtgtgacacccgtaagcagttggaatgggcatgcgtgcacccgtgaacagttggaacccgaggccttggcgaatggcatgcgtggcacccgtgaacagttggaatgggtatgcgtgccacccgtgagcagtcggaaagcgagggcttggcgaatgggcatgcgtggcacccgtgctcagttggaatgggcatgcgtggcacccgtgctcagttggaacccgcgggcttggcgaatgggcatgcgtggcacccgtgagcagttggaatgggcatgcgtggcacccgtgctcagttggaatgggcatgcgtggcacccgtgctcagttggaacccgagggcttggcgaatgggcatgcatggcgcccgtgagcagttggaacccaagggcttggcgaatgggcatgcgtggcacccgtgagcagttggaatgggcatgcgtggcacccgtgagcagttggaatgggcatgcgtggcacccgtgctcagttggaatgggcatgcgtgcacccgtgaacagttggaacccgagggcttggcgaatgggcatgcgtggcacccgtgaacagttggaacatgcgaggcttggcagtgaatgggcatgcgtggcacccgtgaacagttggaacccgagggcttggcgaatgggcatgcgtggcacccgtgagcagttggaatgggtatgcgtggcacccgtgagcagtcggaaagcgagggcttggcgaatgggcatgcgtggcacccgtgctcagttggaatgggcatgcgtggcacccgtgctcagttggaacccgagggattggcgaatgggcatgcgtggcacccgtgagcagttggaat

SEQ ID NO: 42203 - DNA, 843 bp, Heterodera glycines
tgactttaattttcatcactaatttttcactcagactcccattcttaccagtgcttgtttttcccggttccggttgccctaccgggaccgggacctgagcttttcaaaatccggggccgggaattcccggcccggtcccgcttcactctattaaaaagttaaatctgattttaagataggtaccatccaaaaataaaataccttcatacataaatcattcttttattcttttttgttatctgtttttcctttgcatttattaactctttttcagccagccatgcttagcaactttttttgcggcgaaattaaaaagttacctgttccgactgccgccagtctgattctgctccttgtccttctttccgtcattgcattagttgtcatcgtcacactggtgatttgttttatacaagaaaatgaattgcgtttcgccccttttagggagtgcttttctacaaaaaatataaacagacgcgccgcacaaaggctgtctcttcaaacaaaagtgaaactccggaagtgccttcggacttggctgacgaagcggcggagtcttcggactctgatgaaggccgtggtggagtttcgacggcccctcccgacatggaatcagtagtggctgacgaagcggcggagtttttggactttgatgagggccgtggtggagtttcgacggcccctcccgacttggaatcaggacgcaaataatgccatgatggaatttaggcagtcaatattgtattgttgtatatattaagtggaagtggaaactatctataactgtctgtgactgttcctagcatcataattctgactgtatcgcccgaataaaatgctttt

SEQ ID NO: 42204 - DNA, 99 bp, Heterodera glycines
cccaggcggaggcgagcggtctgatcgtgccgatgaccagcctgctgatggaggaggtggctcgcgagctgagcatggagcgtgacctggtgcccgacg

SEQ ID NO: 42205 - DNA, 1035 bp, Heterodera glycines
gtcatcagttgttatgctttaaaaatgattttcgggccggttgagttatatgtgaggtatgagcggtccaaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaa

SEQ ID NO: 42206 - DNA, 1217 bp, Heterodera glycines
tgctttcaaattaaatctgatcagatctgaatgaattccttttttgaatttattttttcaaaattaaatctgatcagatccttttgaattgctaatttcaatttattttttcaaaattaaatctgatcagatatgaattaattgctactttctatttatgctttcacaattaaatctggatctgatctgtatatgttttgataattaattaaagctaatcttaattaattgctaatttaaatttatgccaaattaaatctgatctgaattaattgctcatttcaattatgctttcaaaattaaatctgatcagatctgaatgaaatgctaatttcaatttattttttcaaaattaaatctgatcagatatgaattaattgctaatttcaatttatgctttcacaattaaatctggatctgatctgtatatgttttgataattaattaaagctaatcttaattaattgctaatctcaatttatgctaaataaatctgatctgaatgaattgctaatttaaatttatgccaaattaaatcttatctgaattaattgcttatttaaatattcaaatctgatctgatctgaatttgctaatttcaaattttttcgtaataaatttcaattttgctttcaaaaaataaaattttactgcccaaatgtctgccaacaacggaacattatttgacaatcagctgaccattcaaaaggtggtaatggaaaaataaaaatattattttaaattaatttattttcctaaaatttagaacgattcctccgcctccacgtttgtaagcacattaaataatataaatttttatattttaaatttccataaatttcacagctgattattggactctccgtggttggcattgtgatattgattgccattgccgttttattatgctggctgattttgatcattcgccggaaatgtaggatattaaattaattaaaatttcatgacatttttgggcaattgggcagaaatattcccattcggaacggattccgatgtcgggatcccgaatttaatcactcgggatcacgattccgaccggtttctattgggtataagggatgagtcgatcatcactcagttttaggactatgtaaaaaaaaatttttagtttcaactgaatcaaataatttttttttaatttttaaaaaattagtttatattccattagtagtgtacccccccccccccctccg

SEQ ID NO: 42207 - DNA, 486 bp, Heterodera glycines
  misc_feature (48)..(52): n is a, c, g, or t
  misc_feature (55)..(55): n is a, c, g, or t
  misc_feature (57)..(60): n is a, c, g, or t
  misc_feature (63)..(69): n is a, c, g, or t
  misc_feature (73)..(75): n is a, c, g, or t
  misc_feature (90)..(90): n is a, c, g, or t
  misc_feature (93)..(93): n is a, c, g, or t
  misc_feature (104)..(104): n is a, c, g, or t
  misc_feature (106)..(106): n is a, c, g, or t
ttcgcttctgtagtgcatgccgaatgataactctcccttaagggcccnnnnnacncnnnnaannnnnnngaannncctttctcggcagcnacnacgaacggacncngacggcgagagccggacagagaaaggagagagagggcaaaatttcttcgaaggctgatgactcacccaaactttatcccattcgccgctgccaatcccatcgccaattgtccctgtcgacgattttttatgatttgctgacagacggaagcgtaaggaaatactacaaggggacaaacacccgatgctttcgatggtgtacacattttgctgttgagtgtcgtccgattaatgggaaaagcaacggaaaaaagcaaagaaaagggttaataatcgtcggagggaatcacttttcgtctgaccccccccccccagggcattaaatttgttttgctccttaaaattataatgttttgttggattggtaattttaaacttcgg

SEQ ID NO: 42208 - DNA, 855 bp, Heterodera glycines
atgcaaaattgtataacttccgtctcgaaaaaacggaatggtttgcccttcaacgatgcacaagtaattttgtgtttgtagtctgccttaaattaccaaaaaatttgaattagcggggtttttggtccgaggtcccggttccgggttttgaaaagctcaggtcccggtcccggtagggcaaccgggaaaaacgcactggtaagaatggggtctgagtgaaaaattagtgaagaaaattggagtcaaagggaaaaataaaaaataataattaatatattctttaaaagtaacactgcccaactgtgcaaatggcctaatggctagtctccttgactttaccttcttctttcccctggttcaatccctctacagaaattagattattttcaatttttttttttttgtatactcgtgggtttcctataaagaaaatatgattcctcatagttgttttttaaattgatacatattttatcattttttaaatgaaaatcctaccaattgagcttaataatcgcaaaaaccaaccttttttgttgaaaatgtgttaacaaattgcacccaaatttttaaaatttcccccggcggcgcctatcggcaccgccggaccccttctttcccaaaagttttttgaaaaagcgctccgaaaaaaagtgatgtgaaaatcaaaatctgaatttctattaatattcgatgatttagtccaaaaatgattaattgtttgaaataattgaagaaaatttgtttgaaaattttcatttaatttaatttattttaaaaaaccaaataattttgtattattttcccttgatataaattaaaatttgaattttttttaaaatttgtaaatttttt

SEQ ID NO: 42209 - DNA, 296 bp, Heterodera glycines
aaaaatcacgcattccgtttgcttttacttatgttttcgttttttaaaatttttgtgtgttacctatattgtttgtatagtataacattgcgtttttagatcttgaattgtttgagaatgtttttgtcactgtaaatgcggcggacggtgcgcatttgttggtgttcgacgacatcgaacggtcgggtggtagtcgggcggaacaccgattgcacattggtgaccattacaccaccgccgatgcacactcaccagcggatgaacagcgaaaacatcacggaatacggaggacctct

SEQ ID NO: 42210 - DNA, 861 bp, Heterodera glycines
gagtcccagagattgaaatgctggtgggttgagtcctagagattgaatgtcatgaaaagttgggggttgagtcccagtgtttagaatgccgcagatttgagtcccagtgtttggaatgccggagatttgagtcgcagtgtttggaatgccggagatttgagtcccagtgattggaatgccggagatttgagtcccagtgtttggaatgccggagaattgagtcccagagattgaaatgctggtgggttgagtcccaatgtttagaatgccgcagatttgagtcccagtgtttggaatgccggagatttgagtcccagtgtttggaatgccgcagatttgagtcccagtgtttagaatgccgcagatttgagtcccagtgtttggaatgccggagatttgagtcccagtgtttggaatgccggagatttgagtcccagtgtttggaatgccggagatttgagtcccagtgtttggaatgccgcagatttgagtcccagtgtttagaatgccgcagatttgagtcccagtgtttggaatgccggagatttgagtcccagtgtttggaatgccgcagatttgagtcccagtgtttagaatgccgcagatttgagtcccagtgtttggaatgccggagatttgagtcccagtgtttggaatgccggagatttgagtcccagtgtttggaatgccggagatttgagtcccagtgtttggaatgccgcagatttgagtcccagtgtttagaatgccgcagatttgagtcccagtgtttggaatgccggagatttgagtcccagtgtttggaatgccgcagatttgagtcccagtgtttagaatgccgcacatttgagtcccagtgtt

SEQ ID NO: 42211 - DNA, 351 bp, Heterodera glycines
attataattagagtgctcaattttcagcacaataaatcaccgattaagcactggaaacagcaccaaatttttccaaaataagcatgaaaatagcacaaaaaaggcaaatcagcataaaaaattggaaaaaagcataaaaattaagagattaaaggcatcaataatttaaaaaagtcgtcaaaaaaggtttatttgctccctgattataaaaaacctccaaaatagaagctaagaatggttatgaggtacctaattttaaaaaatcaaaattttatctaaaaaataaattaaataattttggagatgaattatttttgataaaatttttcatttcttagggatatatttttc

SEQ ID NO: 42212 - DNA, 947 bp, Heterodera glycines
  misc_feature (889)..(889): n is a, c, g, or t
  misc_feature (934)..(934): n is a, c, g, or t
aatccgggaacaaattttcagctacctatgcccctgtttatcctcttttaaagattaaaaaaacacaaattttgtatccaattttaaacatagaaagcaaatgtcgggtggtaaatgtccatgagcggcattttttggcattaaaatttaatttccgtatgttgattctacctattgttgagagatttttgtacggatttggagtgcgccccaataccattgaaattgggtttgaattggaattaggaaattttggctcaaattccttgaaacacatcgaatggcacacacctttttcttcaccatcattatttatgttcatctttagacctgtttcaattgcggcaaggttggccatgagctgtccaagtgtccggagccgcgcgatgcgcgccgtatttcacagaatcggaacagtttcggcagccggcgacgagaaaggtgcgggggagggggaggggaggcggcactttgaactgagacaggaacacgaccgacaaatcattttctaattatgttccggcattttaaaaaatccggacactaactttaaattaatacattttctacgggttttcggaaagtcactcgcaaccgattttggcaaaaaaagggggagagggtcgaaacacaattttaaaaaatgcagtcctagaggcttgccttttttcggagcaccacctttagaaacaaataaaaacaaaaatttttgttattggtaccatttgtctcgaactttttgcgaaaatgaatgtccgtccccacttttgagtcagtttgaaccaaaaaaaaaatcaccaaaatctcagggtgtgcggtataaggttgctccaatttttccaaaattgccttttttaacctctaaggagtgccatttgaaagctcactntttcctctgaggtttccgccatattttccactacccattctatgncaaaatgttttcg

SEQ ID NO: 42213 - DNA, 977 bp, Heterodera glycines
  misc_feature (903)..(904): n is a, c, g, or t
  misc_feature (909)..(909): n is a, c, g, or t
  misc_feature (915)..(915): n is a, c, g, or t
  misc_feature (932)..(932): n is a, c, g, or t
  misc_feature (957)..(957): n is a, c, g, or t
  misc_feature (968)..(968): n is a, c, g, or t
aatttttcagttacattctcgcaatcctgacgcgtataaggttggaaaacatttaaattcgaaacatatttttgcataaggtggagtttcgctatgcgcaacacttcgccaatatgccaatcattggcgccgctttctccaacacacgcggcagtggctatctgatcacctcctatgagaacttcaatctgttgcactacaaaattacgcgccggccgagcccaaacccggcaggcggtgagggccaacagaaggaggcaggtgaagcggaaaaggaagtgccgatgttgggttgatcagcaacagtgggcgaaaaagcggcgccggcatgtgatcagtcaatttgaaagaaaacagtgatcagagaatctttagtatacaaaggaaatcgcacaataaggaaacgtataaaacatagagatagttgaatatagaccggcttgaaaccaatgatatctgttaaacagcattaaacctatcagaaaagtaacatttttttttgccaatcaaaagggttctccataaatatgaattactctcctcgttatttataaattcattttagccgttatttttattattatttcatttttaattttttatgtttttttgaaattaaattttgtgtctttattttgaaattttaaacgcagatttccaagcacaatctttgatagctatttatttgctatttctctgtcgaaccacttatcaccggtttctacagactttgaatccaatgaagaatctgatcccttaaataagggtaattattattttttttttgctgtgatattgtaatattaagcaattagttgacaaaagagtgattttaggttaattatagctaagaaattatgtttaataattttggcctttggtaaacttttcatcggtgaattnngttgntattanggtgaaattttcgttgntgcaaatgcttttactcgccaattnctttcatcttnttcttgaca

SEQ ID NO: 42214 - DNA, 808 bp, Heterodera glycines
  misc_feature (522)..(522): n is a, c, g, or t
cccccccttccgccccctggctacgggcctgcctcacattcctaactcagaataatccaaaagtaaccattttcactgttatttatgtctttctcattaatcacattctacctttccgttttacttttgcttttaaataaactttccaaaaaaaatcgctgttctgcgtgatccagtgaaaatcataattttattaaccaaatgcacaaatctcaaaagtaaattaatgccttttggtgggtgcatttctcgcgaaaaaacagcagaaaatattcattctaaggccttaccgataaataaccttttgaattatctcgaagaaagtaaagaaaaatgataaacattaatgttttttgaccattattaatttattacgataaaaaaatttcttccgctcattatctccaaatataatataaaaaatgatgggacggggcgagcgctgggggaggggcgaggttgcaaaatatgcatcaaatatgcacaaaaaaacttgaaaattaggggtgcaaatttattttnaaaaattttcttcactagtgcacttgccaatgagctgctacatttcttttataaaattctctttagcaaataatgacattttttaaatcaaaattttctcatgaaaaaaaaaatttgggggaagattttttgaaaaattttccaattctttaatggggtttttaaaatttttcggccgattccttaggggggattttttttgatttttttagggccgattcttaggggggttccggttttttttgaatttttttttaaaaaatttttccaaaaaattgcaaaaaat

SEQ ID NO: 42215 - DNA, 120 bp, Heterodera glycines
agtggaagtgcccgacgttgaagcagcagcattcaaagtgatgttaagcttcatctatgctgatgatttgagcgaattgagccgggacaacgcaatggcagtgctttacgctggtcggaa

SEQ ID NO: 42216 - DNA, 940 bp, Heterodera glycines
gttgaatgccaaaaaataatagttttttggggcatgaccagcagatttgtgatcagaataataattgctatgctgatcaatgcataaaatgccttggcaaattgtttggtgccattccattcaaagcatttcagtccaaattggtttttctgatgattatcattggagttgtgatgatcaagtaatattttgtagtgcaaacctaatttataaaataaattattaatgaaaatttattatttattttagttttaaaaaaaaataaataaacatttaaatgccaattaaatttaaatttttatatcattttcggtgaactcgtctatcatttttcagtttttaaatgataatttaaaataaaaaatttttacccgaacgtataactgccggcataaatatatttaatccgctaaaaaaaaaaaaaaaaataatttattaaaattaattatacaattcaagatgaactgaacggttaatatatatgaatgaatttgaatggttttgaaattgtgcaattagtgaaggaactttttttcttaattgtactattaaatgttgaatatttgaactatatttgcgccaaaaaagcacactagcgaagattcaattgtgcaatttaaaagatttctaataccgataaactcaattcaattaaatttgatgtatttacaagtaaataaattttgaaatattttttaagggcaaataaaaaagaaaaggcattctttaaaattagaaaaaaattttgaaaaaatttccaacaggttaggggttagagatttaaaatttaaagtaaattaaaaaaatatatttattcttctattaattattgccataatgtgtcattaaactaatgaaaaatcgacaaattaattcgtctaaatacacattgacatctttcaattttgcccagcccaattagccctctgtcattcttttt

SEQ ID NO: 42217 - DNA, 774 bp, Heterodera glycines
taattttttttctttgtcatccaaatccaacattattggagtcattcgaaaacttaatatgtttagaagctttttctaagccattacttcgcgattagacaattaccaaaaaaaggtatacacgaaaatcgaaaaaaagttcaaaaattttgaaattttttcataaaaacttttttatatgcacgaaagttgtttgttttataaggataatagagcatgctaaaagcttttcaatgataccaagatttttggatttggacaacaaaaaaaaactatagtggatcttacatatccattttatttaaatatcatgaaaattttattgacaataatattttattgttaacattcaaaaatgtgattagccaaattaaacctgaaaaaataaagcaagaaaaaagttttgataaaaatatttggccaaagatgaaacgatggaaaagaagaaaatctttgccaaattggtcaaataattcatggagaaacagttgatcagaataaccaacttgaacaaaatgggcaacaatttaaaaaaatttttgatgagaatttgggagtgaaagaagggaaagaaagtgaagaaatgtcaacaaattgtggtgatgaattggaacaattggcagaaaatagtggacaaatttgtgaaactttagatgataagaagaaaagagaaattattaaaaaattgcataaaattaaagaaaaaattaagcaaatgggaaagaaacattcagaaaaagaacggaagaaaattgaaagaaaaattgcaaaaaa

SEQ ID NO: 42218 - DNA, 871 bp, Heterodera glycines
tgggttgagtcccacgattggaaagcctgagaattgagtctcagagattggaatgctggtggcttgattttcagtgattgaaatgttggtgggttgagtgccagtgattgaaatgctggtgggttgagtcccagagattggagaaaaagccaagaaaatgatgcgaggccgcgaagcggccgagccagtcgattttatcattcataattctataacacaatcgtactgcctagcgggggatgcgccgaaggcgctgaccccgctagtgtaaggatattttcgactaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaatattcattcgtgctttgcttcggattagtctaaaaatttctggacgccaattttacatattagccaatttttattttatttgtgaccgcaaatttttacatactagccattttttattttattgtgaccaagcatatctttcctcgtatttctgggatttttttcagaatgtggtcatagaataggtgggttgaattatttgtattttttatgagtatcatgtaagcatattttcgactaaacataaccaattccgagtttcatgagtcggattagtctaaaaatttctggacgccaattttacatattaggcaatttttattttatttgtgaccgcatattttacatactagccattttttattttattgtgacccagcatatctttcctcgtatttctgggattttt

SEQ ID NO: 42219 - DNA, 985 bp, Heterodera glycines
  misc_feature (107)..(107): n is a, c, g, or t
ggtccaacatttcgccataaaattttggcactatccccctacccttttaagggggatagacaccaataatttttggaacatggcctttgtatccatcctttaccggngactatggggatggtactcatcctcttattggaaaaaaaccggctgatgctttttaaattacgtcctcgcgtgttcaaacgttttcactggcggccgacattctgctggggctagaaaaaagaattatatatatacaacatggtttttcacgttttataaacgaaatttttttcaaaaaggggtcgtgccatagccagtagaatcgcaggaaaatattctttttgtcggagtttcggtcggcggagtttcggcgacggaatttcggcggtggatttgtcctgttccgctatagcccccccccccccccccccgaaaccgaaaatttttaaaacaaaaacgagaaaaattctgaaaagttataccatttcttaagaaatttcattaaaaatcccagttttcaaaattttgtcctaaaaatagtcgccattttttggaaaaacctgtttaaaaactggtcaaacatttgccacgtgatcattgccccctcccctccgtcctcaccacctgctgatgttcaatttgctggtgcggcctaagccgagctctgcagctgcgggtgccgctgctccctccggattgcttttgtcgggctcttgttcatctgacgaattggtgggtttggcgcgacggccactgaaagagacggtcaaagatgtatttttagggcaaacaattttcgttatatagaaaattaattaatttcttttaaaattgttccaggaatttaaataaggaatattattgaaaaaaattccgcttaatcattttaaaaaattgaataaatttttttcgaatttttttttcaatttatatatttttttaatttttagtttacttcttgcagcagcagcaataaataatcaacgcaataattgca

SEQ ID NO: 42220 - DNA, 1515 bp, Heterodera glycines
  misc_feature (1464)..(1464): n is a, c, g, or t
tttggctttctgtgttgtgaccaacatcgtcgtttggttgcgcaaggtttgtgttttcattttttgtttgttccacgttatgaacataagtgttttgtcttcctgtgtcattttttgtttgttccacgttatgaacatttgtgttttgtcttcctgtgttttgaccaacatcgtcgtttggttgcgtattagtgatttggctttctgtgttttgaccaacatcgtcgtttggttgtgtattagtgatttggctttctgtgttgtgaccaacatcgtcgtttggttgcgcaaggtttgtgttttcattttttgtttgttccacgttatgaacataagtgttttgtcttcctgtgtcattttttgtttgttccacgttatgaacatttgtgttttgtcttcctgtgttttgaccaacatcgtcgtttggttgcgtattagtgttttgtcttcctgtgttttgaccaacatcgtcgttttgttgcgcaacatttatgtttccggtttttttctcttcccttttatgaacgtttatatttccaatttgcgatacttccccgttatgaacatctttattaaaatttgtttttttgctttcaattggcgattttaaattaaattttgtattttcctgttgcgtttgattgttgctctttcgtccttcaaatatttctgtttttattttctctgcattataaatgagggaaaagggtgtgggtgtaggtaggaagcaatttgctgataaggaaattagtcggcaatgaagtgggaaagcatttttgaaaaaaaaattgaattttgataattgttcgaatccgggttcggagttcgaaatgggccaaaacggacataatattcgggttctacgaccccgaaagcccatagaaacgactttttattaatttaaaatcaatttaacaaagagaaaaattttgttgacacaaaacccgaaagtaccattaatttttatcaataattttgaaaaaacctattttgacattttttatgaacaaaaaaatatttttttttgataaagaaagtgacttaattggaccgtaatgcatgccattgagtgatgaaaacttgcgcaagttaaaatttatttgctgtccgattctgctgtttgttgctaatgtttgctgttgttccattcgctaacaaaaatatttccaatttttctctccataatattttaattcatttacctgctgctgttttgaaattcgttctcgtccggtgtttgtatcattttcagaaataacatcgtttgtcgctttgttcattaaattcgcttctttaaataattagggcatcgtttacgtcttaattaacccattaatattgtcacaaaccttcaaaattttcttgctgattgttttgattaaaattttcacttttactttttttgaacttcactataagactttttaatttttggtagttttttcctgttttatcttttggctnttttggcaccaactccgacgccaattgcattgatgtattgtcatcactctc

SEQ ID NO: 42221 - DNA, 1039 bp, Heterodera glycines
aaaatccatcccaaaaaaagtaaatttttttgaaatttttattcaacagcaagaagacaatgtcccaaaaaagaaccatggacatatttacaaataaatgtatatatcacaagacagagacacaatctatcctcttttaaattggcagtcaatgttatcacggcggtctcgagaattcaatcctcctctcattgctgcgcagcagcagcaccgccaccctcctgacttccgctcgcgctcccttccgtactttcttcatcggagtcggactcgccacttccttccgatgattgctccacatccgattcgagctccggcagcacgcacacctcggcaagagagacgccagagaacagctgaaatgccaataattttgatgtgccgctgtctgtccttgtgccgcaaaacctctgccactcaatcactgaccttcctcaactcgtcgttatcgcgcgctgcagttcggatgtgaaatgcactgagacgcttcatgccttcggcctgcgtgatctcgccaattttcttgagcagctcgcccgtgatgtgttccagcacagcagtcatgtagaccggcactccgttcgcgagacgtttggcatacggacctgtggatgtgaacaggaaagggaatgtatgattcgattgtgaatgaaacaaaattgttgtcccaatttccgtcttcccaatgaaccgccgctgtctctccaattttgcatcgtttcattatccatcggttgtcccatccctttgctttggccaatgtcagcttttcctttgtccattcgttcaccaattcgaatggcaccattggcattgacggcgtacgaacataaaaatgaatttcgtaactgacggaagaaatggcattggcacggagaaaatgctaaacaatttggaaaacaaaaatcacaaaaatgttgggccacacctccttgaaattgttgatccaatcgaagttcgtttgttcgttgtaattatcgcaatgcaatcgcttgggttggccatcttttctcggagagtgcaaccatttggacaatgc

SEQ ID NO: 42222 - DNA, 1011 bp, Heterodera glycines
tcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaaggtgataaggcagacacttgaaagacacgtcgccggtacagaacgtgcgatcagcttagttgttctgagtcacactggacgccc

SEQ ID NO: 42223 - DNA, 829 bp, Heterodera glycines
gctatttctgcttttcgttgtgtcgaaatgctacggaggaaatagcgggaacaattgctaataatcatatttttgtttgtgccttagaaatgtttcggcgcttttcccttcgccggcactttcttgttttgctggcggccccaccgcgaacattagcgacatcgccggagggaaatgaccgaaatttgtggccaattgatggggggagggatgggcgagcggcgggggaggcaatggcaattggagaaggatgggaaagtgcgaagggatgagtgggtggaagagaagagggatgaatgccgaggcgggagaagaagccgggcccatcgcttcgctttctctggggtggctaaggggaaagtgctcttccccccacccccagcgaattcttctctctccctcatctcatctcttctctctctatctctccctctttctttctctgtcctactccctctcttcctctttcccttggtgtttttccttccttcttctgcttcttctctctctgcccattgcttctccgtctcccctcgagggtcaaatgcttttcctctcattatcacatccttttcgcttctccccacttattgattttgaccatctctctgttggtcctttgggtgatgagctttaccccccccccccccctattattcgtctgtccgttttaccaccccatcaattattattttaaagggtgacaaatgggctccaaaattggcttccttctgctggtggagaaggtgatgatggaaaaattaggaaagaatgtcaattttgagttatttacgaaggttggcaaaaatatgcacacacataccaggaa

SEQ ID NO: 42224 - DNA, 994 bp, Heterodera glycines
  misc_feature (859)..(859): n is a, c, g, or t
  misc_feature (919)..(919): n is a, c, g, or t
  misc_feature (961)..(961): n is a, c, g, or t
attcatctccctttttgatagaaaaagcatcaaagtgcctaatctaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaactccccataaatctgggcgcatcggttcggggggactgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccctaaaacaaaaaaatcgattttttcaagtgtccgtttggggtactcaaacatttatggggaacaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcanacaattatgggcagcaaaaatccaacgcagaattaaagtacaggctatagggaagctacntccgaaaggattcggtctccccataaatctgggcgcatcggnttcggggggactgccccgaaaacaaaaaatcga

SEQ ID NO: 42225 - DNA, 1522 bp, Heterodera glycines
  misc_feature (65)..(65): n is a, c, g, or t
  misc_feature (69)..(70): n is a, c, g, or t
  misc_feature (74)..(74): n is a, c, g, or t
  misc_feature (79)..(79): n is a, c, g, or t
  misc_feature (82)..(82): n is a, c, g, or t
  misc_feature (116)..(116): n is a, c, g, or t
  misc_feature (1443)..(1443): n is a, c, g, or t
  misc_feature (1475)..(1475): n is a, c, g, or t
aggtcaaactaggcattaaattcgatggggtatatttgaaagtaaatccttaaaaatgccggctnaagnngctnagccnggngcatattctttgaaaccgtaattaatttaaaagntaattaattttcaattaaataatattaattcttaagacattttatattttcttgatatcgctgtccaatgtgataattgtttgccgctgctttctcaatttgatgattatatattctccgattataataaccaattatgacaatcatctaaaaattcgatttgaaattgtctaatatatttttttaccaaatattccaacaagcttaaaattgtcgaaattgatgagctgatcaaattaaattgcgtaaatgtccccgaccactgctttattattgtgtttgtcaaagcgattgataattaaaaaattttaggctaattagtacgtactgtatttatttatcaattagagttccattaccgtaatactcaaccatgtacaaatgaatacgcattttggaactgtttcgtatgaatttgagcgcattgttgcaataaatcgttcaatgataagcacatgaccaataagtagccgaaaaaaaccgacaaaagccataatatccttgagaaaaacagagtataattgtatgaaaaaaggtttcaacacctaattaaagccaataaaaaattgaattttcgaaaatgagaaatattgtccagaaagaaaattacattattttacttttgtaattgtttattctatcctacaatttttaatttatactaattcctctttttattagttaaataaacaaaatttaattttaatgattttttatgagaaatttaaaataaaattactttttttgacataaaaaacaacaataatttttcagaccttaaggacgacatttgtcgatacaaattgattatttgataggaatttttcggcaataattcctgctcggccaaagaggtaaacgataagcgcaacactatgactgatcagaatgcttttcatgttgatatgtaaaattttggttggacaaataactgccaaattcaaaaaagcaatggccaacacaatgccataggtgaacagttcaaaaaaggaaaatatataagcaaaaacgtcgactgtgacggatgggaatgtcatttgaacaaaatctgttaaaagattttcacaatttattaatttctttgaattatacctacaatttgaattaaaaaataaatttggttaaaaaaagcaattaaaatttttgatggcactaatagagagagggatggatggcaggggtgttgctagagcataatcaaataccaaattcgataaaagcatttaaaacgctaccaaattaaaatacaagaaccagaatgcaagaacgagaagtccaaaaaaaatagcaagtaagcgataagcgagacttgcaacatccctggtgngtggcatattttttaatcatctaacatttgcngtggcattatagagggatgggtggaatattttttattgcattaaaat

SEQ ID NO: 42226 - DNA, 1349 bp, Heterodera glycines
  misc_feature (45)..(46): n is a, c, g, or t
aaaaaatcgattttttcaagtgtccgtttggggtactcaacattnnatgggagcaaaaatccaacgcagaattaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcacctccctttttgatagaaaaagcatcagagagcctaaactaacatgtaaataaaatttggtgcgtttcagaaccctttctgaaaaaatatttaagaattaattttgcaaaaaataaataaaaacgaaagactcagattttcgaaaattttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttt

SEQ ID NO: 42227 - DNA, 1404 bp, Heterodera glycines
  misc_feature (45)..(45): n is a, c, g, or t
  misc_feature (99)..(99): n is a, c, g, or t
aaacataataaatgtacacttaattgaattaaaataaaaaaagcnaaatttgttagacaaggcctcaaaaatttcatttttcaatttataaagaaaatnttaggaaagcaaaactttcagaattatacaaaaaaaaaataaataatttattttttgttcactaaaagccaatctttagggatgcaaaaaagtctcagtctgaaagaccgaaatcgaaaaaacacgagacttttctcgaggtccgagactctcgataaataaactttaatatttgtttaataatttatgttttttgttcattcaattttttgaatacttttaattacttttcatttttactggaattttaacattctttgttgttttttaaaacaataaattctttttaatttatttaaatgttcactttatttactatgaacgcggagattttcagataataataaatgaattctttaaataatcaatgttaataaataataataaaaaatttcaatgtttccaatttatttagtttttcttttgtacggtggcgggttaacggctgggcgaaattaaattattttaaattttctctgcttctttataaattgctattaaaaagaacttaattttataaacctttataatttggtttgtttttttgcagtggtgtgtttatggtaaggaccaaaacaaacatttgaaattattaaaaatcattttatcacaagaatcgtactgataaggcccgctatcttttcttaaaattgcacttttcgcgagacgccatttttgctattttcgcgcaatgacctagcaccatttaaaccggtcggcttcgcatttttcaatcatgcctccgtaggagtcagggatgtgacgagcatgccaacatctgattcggatcacatgcaggtttccgctttagtccaagcatcagattagaaagaatagcgactaggctcgggcagataccgaccaggttccacaatcagatgattgcgatgccgatagagatcaatattttgcagaagtttggaatgtaaccatccgcattaactttactgacacaataatatcgcatagataaagaagaccttggagttaattattggatctcggtacgatcagacagtgcgctttcaataatctatctcacatatctagggaaataaaagagatcaagagtcttctcagagaataatctgtagcggtcagagaagacatacattcttatatgggcggggacctggtcccggcgaaaacccccgggcgcagcgaagatgtttccgagatcaaccaagtggttggccgtgggttttcatgttcggcagggtgaacaccgcttttcccaacccccccccccccaattagtgttcctaattgggcaattatagcatagtttacctcaaattttcttag

SEQ ID NO: 42228 - DNA, 1215 bp, Heterodera glycines
  misc_feature (1130)..(1130): n is a, c, g, or t
agaaagaagtccaaaactttttttttaatttttaaaaacctgtcgccgcacttccgctgtgccgtcggtcgccggctttgcttcctccagcagcgggggacccagatatttgggtgccaatgtgctggtccgttcgtccacaaaggcgggcaacgcgtacagcccggtctgtgccgactcgcccacgtagagggtggggaacagccggtcgggcagcttggccgggatgtgcagcagcgtgtcgacaccccgggggatgacggcattctgcaaaagttttaaaatttaataaaaattattctatagtttaaatttggtccatttttataaaataatattaaatatattttttaatttaaaattgcataataatttttgtgaaaatgtaattaattttaatttatcaaatttggacaatttctgtaaatgaatattaaaatattttgtagatttaaaataaaatattttaaaagttttaatgaaaatgctttaattttatcaattttgaagagaatcaaataaatttttgttatgagtttgttattttaaaatctttataaatatcacagatgtatcttttaattttgttaattttttcgtagaattttgacaataaatttttattttttattggcacatataattaatttatatttgttctatttttatttgtttttcttgcctcattcccattttatttaagattttgctaataaaattttccaatttcacaggaattgttgtttttttttggaaatttattaatcagtcctaattaatgaatgtggtgaatgtcaaataattatctttttttaacatttttttctcttttccacgaattaattcatttcttttttttaaagaatgccgctttttaatgcatcaattaattagcaccagtttttttttattacatattattccataggtaattaatccttttgattgattttctggcttttattttttatactatatatccaaaatgctgaaggaaggtgatgacgatgatgaattttttcttcaaaaattcctccattcaaccgacgacggcggacgacaaaacgccccgtcggcggaggggggcaacaaagcgggcggcggtgggggataacaattgtttgtgccgnccttaaaattgtttttgcccgggggatggagggccaaatgaaaaatgataatgtgatatgatgaagccgacctggataaatgact

SEQ ID NO: 42229 - DNA, 735 bp, Heterodera glycines
tgtattgggggtgtttgagtcgagagtcgagaaatctttagaatattatgcctaatgagtagtacaaaatttgatgaatttgaattttttgaattttgttcgaatccgagtttgaaatgggtcgaaatggatgttagaattggggtattcaaaacttcattgaaaaatcttataagaaatttcaggaaaaaaaatttatgaaaattttatgatgaattattgttttttcaaaattccccaaaaatcgctgaaaaatttttaatttttccataatgggtacttacttagttccttttccaatcaaatttttggaaaaaatggtaaaataatgcccgttttcatactgttcagcaacaacagtcttcccgtgaactgttggccttctggctgtccaatgcagccgagctgttgaacatgggccgtgccgacgcgcacctggcgcgtgccgtcggcaccgcactgctccacgaactgtcccgcactgttcaacgcctgttcacgctgttggtcgaccgatgcaagcagcaattgctcgcccacggcatacaaccgcttgtccaccatttgctttcggcacaacagacgaatggcaccattggtgccgtgccgtcgtcgtcgccaccggcgttgatcgccgtgctggacgagtgcctgcgcatggtgcgctgggcactgctcaatccggcactgaccatccaactgttctccccactcttccacttcgtcagcgccacg

SEQ ID NO: 42230 - DNA, 638 bp, Heterodera glycines
tagataaaaatcaatgattttcaaatctgagttcagattcgtgatcagcgcattttttaagcctagaaaaaatagatgcgaaatttttaacatttttttcgtcgggacatcaattcttgaccattgccaaaaatcttattgggatcgagagtccgagttacttttttgaaaacaatcaaactttctctgaacttgtttcttttactttaatcatttccgatttacaggttccatccaatgcgacaaacgatgcctttctgtgcctagaccagccgtcgtcattgttgaccgacttggacgacgtttcgtgcgaccctcagcagcagtgcccctcgctcactcccccccccattagcctgttttagcgttggcggagatcgctgctccgtccgtcgctgtccctcctccatccatccaacaggactggttgttgttgggcgaagaggaagagaggaggaggaggactaaatgaagaatgaatgtgaatgggtggtggtgctgtgtgagcgggggatggtcggacgttttggatgggtgtggttgagaagcgaaaagggaaagacgaatggatcgatgcgactctccaccaattgccaactctctcgccatcgtcgttcccttgccccccccccccatca

SEQ ID NO: 42231 - DNA, 1181 bp, Heterodera glycines
gaggcatcattttgaggggggggggcaggttcgaatccggacggtgtaacattatttttttgtgcatttttacgttattttcaatgattttaattaataaaatattttgttgagttaataaataaaaaattatatttaatttaatttttttttgataaataaattttataagtttaaattaattatttttttaattgatagaatttcatgtatttttttaattaaatttgttaaaaatattttcattttaatttaatgaatttactaatcactgttgtatcaatttatatttaaagatttgttgtaaattaataataaaagaatttatgtaaaaaataataattatcttttaataaagaatttcatattttttttaattgtttataaaaattaatttcatattaatttaaatattcaattattgtacatttcaaaattctctttttaattaataaaaggaataattaatttattttttaaaatttataataaattgcattcaatttttgtacctcttctaatcaatcacagttgtacctcttctaaacacttttgtacctcttctaacaattttgtacctcttctgatcacagttgtacctcttttgatcacagttgtacctcttctgatcactgttgtacctcttttaatcacagttgtacctcttcaatcacagttgtacctcttttaatcacagttgtacctcttctgatcactgtagtacctcttttaatcactgttgcacttcttctaatcattgttgcacctcttctgatcactgttgtacctcttttaatcacagttgtacctcttctgatcacagttgtacctcttttgatcacagttgtacctcttctgatcactgttgtacctcttttaatcacagttgtacctcttctgatcactgttgtacctcttttaatcactgttgcacttcttctgatcattgttgcacctcttttaatcactgttgcacttcttctgatcattgttgcacctcttctgatcactgttgtacctcttttaatcacgagttgtacctctttaatcacggttgtacctcttttatcacttttgtacctcttatcaaatttgtacctcttcaatctctgttgtacctcttctaatcactgttgcacctcttctaatcacttttgtatcactttgatcccttttgtacc

SEQ ID NO: 42232 - DNA, 860 bp, Heterodera glycines
agggagggcggtgcgcaatagaccttttatttttgcggtcatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagggcttgcggaaagacgggggggtgggcgcaatcgacattttatttcacagaggaattttatatttagaggctatcccccaaaaaagggtatctctttttttgataaaatttatacacataccaatgctctctagcatgataaggagggcggtgggccatacaccatttatttttgaaggaatttttaaatttattctctatcccacaaaaatggctatctctcttttttgaaaaattttata

SEQ ID NO: 42233 - DNA, 1497 bp, Heterodera glycines
cgcagtcggttaagcgcctttcccagtgcatccatcagtttaaggtttgaacccatgaaactgcacctctatttttttccatatacaatataattcaatttttattttttgcatcaaattccaaaaaggaaaatgcgacacaaaattatttatgcgtctctaacttgaaagttaaaaaaatctgttaacaaattcactaaagtaaaatttcaaaattttcacggcggcgccaatcgacgccgccgccgtccccccccccccccggcgtttccccaaaagattttggcaatggtgcgccgtaaaaaagcgattttcgattttttaaatgcaaaaaaaaaagattttttcaattggttatcccataggcttcctaaaatttttggattttccaatttttatatatttccctttttgaaaaaatttagcccaaatactttttcgaataatgatcagaagctcatcaaactttgcaggatactgcagggtgacaaccgattttgtcggatgattttgtttagcagagaaaagtggcggggatggataaactgtgaaaaaagtgtagaaatcccatcccgttgatggaaaaagagaaaaaaaaataaaatgaataaattaattttataaataaataaacgaacgaaaatatttattaatttagaaagatattatacaaatgaattaaaatcaaatcaaaattgaaggtgttaaagtggacgagttatgtgtagggatatcaaaaatatgtacaaaaagtgctcaaaatatgtatttaatggttatttttttggaaaaaaattcttcggaagagggtgaactaggcacaaaatgccataaaaatgatcgaaatattttaattaatttttttttcttatgaaacgtgaattttgtcactgtgtggcattttagtgcccaaacgaaatttcgaaagaaaaactgataaccaaaggacaaagatcgcaacaaaatttcgggattttttgccggtgaaaatctcgaaacagaaccaaatgtgaagtacactaacatgatcgactatgaaacaatgccagaaaagccgatcaaataggaggggagagaaaggcaatattcttaccgtatttcttatcgaacaattacagtacatccacccaatactttcaaagccaaaaaggcacagattttcaattcaggtagcctttaacttaatcacttacacctactgtatttccttcacacatttcacaatacttcttcattttacttcaatcaaatgaatttcaagtccaaaaaaaaatatattactattttaattataatttgtctacaaatatttgcacaaataaaaaggaattgtacatccaaatcatccatcccgtgctgggcttttatcgctattagcgatcggttttcctctcgccaccgcggctaatttgaattggaatttttttttgtttttctggcctttctcccccgggggatctgcttccaattgtcgccaaatgatcatcataaacatca

SEQ ID NO: 42234 - DNA, 1036 bp, Heterodera glycines
ggatacaacccctacagtaatggatataacggtggatacaatccaatgaacaacggatataaccagtacagtaatggatacaacccctacagcaatggatataacggtggatacaatccaatgaacaacgcatataaccagtacagtaatggctacaacccctacagtaatggatacctgaacaacaacggatacaatcaaaacagcaacggtataaaaataaatgctaatatatttcaattaatatgtttttcaaattgatgacttctcctggttaacaaagcaattaagcttatattggattttcagattgcttcaccgcgtcaatggtacaggaccaaagagcatgcagcgcaatgcaaggacaatgctcaaacccggtgggtaattaattaattaacgaaacacaaaaaattgggttcattttcactatttttgcattttattaacacatttatatttgcacttttatggccgaaaaacaacgaagaattttgactttttgtgatagtttttggcgccgcgcgccataactttttacaattggagataaaaaaatatttaaaaaaagagattattacatttttaaatttggtggctctaaatgtcccattgtataattatatcgacccatttagtaattagcgcaaatttagaagacaataattgtcaaatttatattcgcaatttccagttgatcgcccaaacatgtcgccaaacgtgctgcaacatgcaattcgcgagtggtgttgcttttcctcaattcggcggctgatgatcaaatttatttatgttatttggtatttatttcgagcaaaaaagcatttaactttcgcttcctctttttctttctattcccctcctgtttctctttctgttcgtcttttgcttctcttcctcttcgctcccctcctcctatcttctcctcctgttcctcttttcctttctcttcctcttctgtccatccttctcctttcccccttcccctttttccccttcaatccccctccatggttcttttttctctttggatttt

SEQ ID NO: 42235 - DNA, 1366 bp, Heterodera glycines
  misc_feature (46)..(46): n is a, c, g, or t
  misc_feature (1313)..(1313): n is a, c, g, or t
tttgggagattcaataacagattttcaagcaaaaactttttcttgnttgggccatcaaaattataaaaaaaactaattctttgtaaaaaaatagacaatattaagaaaatctaagggaaaacacttaagggggaaggccaaacgttaaaataaattttattaaaaaattaaaaaaataaataaataatgtaaaatttgaactaaaaaaaatctagtcgtgaattcggtgagtgttgaatgagaaaaataaacaattcaacaaatggaatatatatatttactttgataaataataagaaaattttacacataaaaattatcagtttaaacgatttgaaataaaaattaatgattaattgttaatgctttgtcacatcatcgaacgaagccaatgcaatcactcattataaataatgcttaaaatttctgctagattatacttgatttattaaatattagtacaaataaaattacaaaatgtccaagattaataacttcataaaaatattgaataaaataaataaagattaaaattaactgtatttttaaaaaagaaagagctaatgctaaaatagttaaatttttactaccaaatgtccaaagttaatattttcataaaaatattgaataagtggaaataaattatttaatttaacttttattttttcagaaacaggcgaattttaaatgaacattcattataaagtaaattattttatgaaaaattcaaataaaaagctggctttatattttataaatttgcggaatttttaaattcacgaaaatattggtattaattttgatttaaaataatgaattgtttttttgaggttttacttttcgactaaaatttaatcaaatataaaatttttgggggtgggggagggattgcaaaaaagcactcactcatggcccaatttttggaaagaccgacaacttttagtaaggacacaagattcaaattaatggaaaattaatttcgatgctagtataaaaataacaaattaaaataataaaatgttttaatgaattaatttaatatatatttaatttcaaattactacaaaaattggatgtaaaataaagaaaagttcgacattaaagaaaccaaaaaaaataaagaaaataagaaagaattattaagataaaaaaaccaaaacaaataaataatgtttaaaataattaccttaataaaaatatcatagaaatctaatactttattttattttagaaataattgaaaagaattttttttttgagaaatgaaattaaaaataaataaaacaaaacaattcaatggaaaatgaaaatancaaaatccaataaaaacgacactaaacgatgttgaaaaaccattagtcgtagg

SEQ ID NO: 42236 - DNA, 1716 bp, Heterodera glycines
  misc_feature (1571)..(1572): n is a, c, g, or t
tgcgttggatttttgctccccataattgcgtgagtaccccaaacggacacttgaataaatcgatttttttatttcataaatattttttcagaaagtgctctaaagcgcaccaaattttatttacaagttaattttagcactctgatgctttagtatcaaaaaggaagatggagaaaaatttttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtagtgctctgaagggcgtggggggggggggcgggggcccaccacgaggccgcgaagcggccgagtgagtaccttcggtgcaggaaaattattaaggaagagagttcattatttattttttttttgcataattaattcataaatatttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttgtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtgctaagtgtgaagaactgtgttcttccaggcaaaaaattctaagaaaatttataagcatttgtagggttctcagcagtttccctgcaaaatttggtgagcttctgatcagtctagaacgttgggtgataaaatgaaaaaaataattaaaaaaaataatgctggtgtgctaagtgtgaagaactgtgttcttccaggcaaaaaattctaagaaaatttataagcatttgtagggttctcagcagtttccctgcaaaatttggtgagcttccgatcagtctagaatgttgggtgatcaaatgaaaaaaataattttcgaaaaataatacttgtgtggtattaattcataaatatttttttcagaaaatgctctgaaacgcaccaaattttatttacatgttagtttaggcactctgatgctttttctatcaaaaagggagatgaataaattttaaaaaatttttaattcctttttaaacaggccaaaaagtttaggcttgtgtggtaagtgtgaagaactgtgttcctccaggcaaaaaattctaagaaaatttataagcatttgtagggttctcagcagtttccctgcaaaatttggtgagcttctgatcagtctagaacgttgggtgatannatgaaaaaaataattaaaaaaaataatgctggtgtgctaagtgtgaagaactgtgttcttccaggcaaaaaatctaagaaaatttatagcatttgtagggttctcagcagtttcctgcaaaatttggtgagctccgatcagtct

SEQ ID NO: 42237 - DNA, 757 bp, Heterodera glycines
tatcattgaaaaaaaagacggaatttgtacttttcacgtaacccccccccccccgaatagtctcgcccccccccccgcccaatagttgggcaacaagcagagtaaaagcggctggcacaaccgcggcccctttggctccgtacccccactcttaggccaattcatggccaacttaccccgccccccccccaggggacacgccgaccccaaccacggcatgttaattggaaattgggccccccgcaagcacggcacataaacagagggggaaaagcagcgaaggctgggcacaaacagacagaaacacaaaccaccgacggacgagacgacacacagtgccaattctgctgtcccccgaagtgcctgccatttcggggacagagcgggggggggggcattttcggccaatgaatttgcttggcttaatgccgcaaatggcatgccatttccgcccaatttcgacgagtcaaattggatttattgcaacgcatttttggacatttttttttgttaatttgtgagtgtgcccgactgaagatcacataaatgacatataataaaagtgagccacaggcgcaattaaggtgcacatttttggtcctcgaaattttcttttccttttataggccacagtaagccgttaaaaaattaaaaattttcttaattaaaacgaaaaatgccatattcctcgcccaattttgccagggctcacctaatggttatgattattttataaccatgtccatatgtaactgga

SEQ ID NO: 42238 - DNA, 710 bp, Heterodera glycines
tcgtttcttcctaattcagcttttaccatttttatcattttttatgcaaaacttgttcgtccacgaaaggttcgaccatttgtacaactgttccttctatgactatgagtcggtgccgagggaaatgcgcaaaaatgttctcgtcggcaccattcttttgctgttgtacggcatttttgaggcgagaggggggcagcactttttggaaaatcttgaagcattgaagcgattaaattatttaaaattggattttccttcccagattctgtacatcccttgtttgctggtctttgcgcggaaagagaacctccgcgagtcgtgctacaagctgatgctgttcatgggcattctcagcatggttaacatccattcgagtggactcgtcattggcatttacgccgtccgtggcgatgtgctttgtgaccgaccgctcgttaattatgttctcggaatgcccgcttttggtgtccaatttaatttaaaaaaataatttcttaatgtttttcaattccattccattttatgcctttactgtgccgaatcgctgacttccgtccttttggcattcaaccgatgcattgaaatgtgggacaacgtaacggcgcataaactgttcgaaggccgcaaagcgacctggtggatggtcggcattttgctgtacggattcgccttgtgcacttttacaattccgccgattcccaacggaatgt

SEQ ID NO: 42239 - DNA, 550 bp, Heterodera glycines
ttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggagttttgctccccataaatgtttgagtaccccaaacggacacttgaaaaaatcgatttttttgttttcggggcagtccccccgaaccgatgcgcccagatttataaggagtccgaatccttcgggaatagcttcgatatacctctactttatttttaccttggatttttgctccccataattgtttgagtaccccaaacggacacttgaaaaaatcgatttttttgttttcggggcagtccccccgaaccgatgcgcccaaatttatggggagaccgaatccttccggaatagcttccctatagcctgtactttaattctgcgttggatttttgctccccataattgtttgaggaccccaaacggacacttgaaaaaatcgatttatt

SEQ ID NO: 42240 - DNA, 876 bp, Heterodera glycines
acaataaaatagtttcaacaatttcggaaaatttcatccaaaaaagacaaatattcaaagcatttttgttgaaattaaataaatttgatttttaatatttatataaaatttatacatttattatttttgcttacagtctgcttttccgattataaattgctgtaatgagtacatactgtagttttgattttgtttgttctggtgcaaaatcgtttccatgtggaggcaaattgttggacataaattgaaaaatgataaaaaacaatgccaacaagaaaataacattatattttgttttccttgtcctaaaataataataattattattatttacgatttaaaaatgtggaattaaatttaaaatataaataaaaattaccatttaaacattttcctgtaaattatacggaatatttgatgataaatgttgttcaaattatgaacagattgaaaataattcgaatagaacatctaaaaaatttagtttttaacgaaataaaatatattttttccataaattttttattttaatttatttaaatcatttaaaataaatggaagaattattaaatattgaaacttttaaaaccataaactaaaatagcatttacatgtggataaagaggaatattaaaacaaaattagcttaattaattggggaaacaggttttatctcacacattgatcaattaattattgcacttcagcacaacattttttactcattattatttgtaatctcttattggataaatttttggcgtgacgtaaagcatgtaagcttagaaaagttaaaaagaaaattgaaaaatgaatttcaaggcgtgcttatcttttacaaatttttaaaaaaaatttatgaaatatttctttaat

SEQ ID NO: 42241 - DNA, 991 bp, Heterodera glycines
cgtgattatggtggcgaactcattccacaagggtctttcatatttagagcacaaatatgaccataaaattgttgccattaaaactgcttactcgcatttgggaatttctaaaaaggacacaggattgctcgtgattatgtggcgaactcattccacaagggtctttcatatttagagcacaaatattaccataaacttggtgcctttaaaactgcttactcgcatttgggaatttctaaaaaggacacgggattgctcgtgattatgtggcgaactcattccacaagggtctttcatatttagagcacaaatttgaccataaacttgttgccattaaaactgcttactcgcatttgggaatttctaaaaaggacatgggattgctcgtgattatgtggcggcctcattccacaagggtctttcatatttagagcacaaatttgaccataaacttgttgccattaaaactgcttactcgcatttgggaatttctaaaaaggacacgggattgctcgtgattatgtggcgaactcattccacaagggtctttcatatttagagcacaaatatgaccataaacttgttgcctttaaaactgcttactcgcatttgggaatttctaaaaaggacacgggattgctcgtgattatgtggcgaactcattccacaagggtctttcatatttagagcacaaatttgaccataaacttgttgccattaaaactgcttactcgcatttgggaatttctaaaaaggacacgggattgctcgtgattatgtggcgaactcattccacaagggtctttcatatttagagcacaaatattaccataagcttggtgccttaaaactgcttactcgcatttgggaatttctaaaagacacgggattgctcgtgattatgtggcgaactcattcccacaaggtctttcatatttagagcacaaatattaccataagcttggtgcctttaaaactgctaactcgcatt

SEQ ID NO: 42242 - DNA, 679 bp, Heterodera glycines
cccccccccccccccgcccattgcccaaaagttttttggaaaaaaacgccgcaaaaagtggggaaaaaaagtgaatcatcagaggaatttttgaggcgttttttccaatttcgtaaaaatttccgcctctgagggggggtatttcgtacttcgtaaaggcaaatttctgcggagcaggacaaaacgtcgtcgtccgccacgaggtcgcgaggagtttgagagcgcacctttgtttctttattattcaaaattaacattaatggtattattcgaaagcttatgaaaaatgatattagcctgcaaattttcaaaatttattattcacgctcaaaaaatccgagagcaagacaaagttcgaaatacttaggtttttgagttccttctgtacacataacttttttgcaacttaacgaaaatttttgaaactgaatccaaaaattcgatttttaggggtgtatttttcgttttttgaaatcctgaattagggggtgtattttacaaaattttttcgccaaaaaattcctattttttgccattttgccctccatttttcaaaaatatggtaaaatggggggtccggcggtgccgataggcgccgccgggaaaatttttgagtattttaacgctaattttgttcttaaaatgtcaaaaaaatttactgaaaatttttacttttttg

SEQ ID NO: 42243 - DNA, 1058 bp, Heterodera glycines
taaaattcagcacctgaccaagacagcaccgttgggctgactttccaccacaatcagctcagttgactaaaaatatatttatttaattttaagtcaaattaaattttggcttacgacgaggcgaatgccaatgcctaaaataaattttaaatttgaattatttttatttaattatttttttaccaatccaaaagcgtgagtaaggtgaaaagtcggaaagcccattggcaaatggaacttttgggcgtggaaaattgaaggcattgatcacaaaactgacgagaccgcttcagagaaaagtttaaaaaattaatgttcgattttaaaaaactaaaaattttcaattttcaatttataagacgaatttaaaaattagaatttaaaaaaatgataaaacaattaggactggactttgccctaatcactttctagtaatttcagctccatctcggaaaattgggatgacccctaattaaaatgccaaatttcaaatttaatgaatgccatcgttcaacccaaaatgccaaagtgcatggcattcgttcacctgcaatttgtgtgccaacttgcgtaaaaattggacatttcatccgtgaaagaacattgccgaaccaatttttgtgatgggcgaacgacggaactcgtgaaaataactgaaaaataatgaaaattattaaatgaaaaatattttaatttttgaatttaccaccaaatataagcagagtaatgagttgtgccaaatgcatttttaatgggcctaaaaataattcaaattattcttttaaattcaactttttttggcatttttaaataaattcatttcctttcaattaaatttttaacgcccctcgaaaaatttaaagaatttagtaatattttttcttctcttaaatcataaaatacctaacattcaaaataaaataaattaatactttttaagattaggccttttaaaagaaaaaaaattcatgaaaaaaaaataaagacaaatttatataatgaaaaaaaaataataaaatactaataaaacgccacataactatatttatagcattttt

SEQ ID NO: 42244 - DNA, 874 bp, Heterodera glycines
cttctcccaggggtattattttgtaaagtcttcttttcccctaataaacttttcaaaccccatttttcgcaccgtgaatgttatttttatcgaattccgaaccgttttgagtagattagactagaaaaaattgaaaattttgaaatcatgtttcccactcccttctcccaggggtattattttgtaaagtctttttttccaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttcccctaataaacttttcataccccttttttcgcaccgtgaa

SEQ ID NO: 42245 - DNA, 1078 bp, Heterodera glycines
gtgtgagaaatgtattagtattgaaggtacacaaacaaatattttttgaatagagcgacgaagagggggaacatttccaattaaattaaggttttcctcatttctaatgaaatagcatcatgttcataaaattcatcatttccattctatttctcgtgccgtgagtccagactctgcccacagcaaagttgtcggggggttcagttactgcaagtcttcctgtactgtcataaataaatatattatgcgcaattatggggtcaaaaatctagagagtcgatatgtcaaaaaagaaataaagtcacgaggagaatgatatgataagtgctcgcgcaaacaaacaagtaaaaaattatgaagaaactttgacagcaagtcaaacaaatgctatcacttcttctgttgaagaatcgcaagagagtatgtttcaaaataatgataactaaaaaattattcaaaatctgcctaaatataaatgatcctaagttgaacatgttcgcacaatggcgcgttctacaatgagatttaaattcaatccacttaatgaagaccagcgtgaagaactgtgtgaaacatggttttacacatcagtaaaattttaaactaaaaagtagagtgccacgggaccgggaatttttgccaaaaccgggaccgggacttgccgggacctgagaagccgggaccgggacctcgattttttttcgggaccgggaccgcaagaaaaaccgggaaccgggaccaaccgggaaattttaaaaattcaaaaaaatttaaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaatttttaaaaatttgggtgcaatttgttaacagatt

SEQ ID NO: 42246 - DNA, 964 bp, Heterodera glycines
  misc_feature (955)..(956): n is a, c, g, or t
tgcggtggggtcgattgggccccgccgattgggccccgccgattgggccccgccggttgggccccgccgattgggcctccgcccccactgggcctcgtcgtcgtcgttgccgctccgtttggtcgggcggttctcggcggcggcaggtctcgactcagttaaccatcgccgccgctgccgacgcactctctccccacgcccatcgatcgcagcgccaccaataaattcccccgagagttcgatgaatgaatgagtgagcgggcctgtgcttgcggcgcctgctgctggcctctggccccgcgtcttttttgcctgacaatgcaaattttgtccctttgtgaaaaatcgttcgtcaaaatttttgccattgccatcgccgactccctcggggcggttcaactttttggcccaatccatccatcgatctcataaaaatagtctcaaataattggaaaaaaacaagcattctaaagttttggctccatccagcgaatgatcgaatggcactttcgagtcgagagtctcgaccttgcccaaagtgccaccggccgctgttcaaatttacaattggctacaactatttacccaaacccttttctcccatttccctaaattggccatataacacgtgatttgctcattcgtccgcccttgcccctttccccgtcggctatcaccaatcaattaatccccctaattatccgttttgtcccccctaattttccccctattttcatcgtcttctcaccgtttcgccttccattattgtcacactttacattttgctgcagcaaaatatgctgctgtgtgtgtgctctcttttctcttttgtgccccgtcctttccttcccccccccatttttcttatttcttatcactctttttcttcctctcttttattaatccccccccccaatttcaattttgttttgttgccaactttctgacctgcagnngcatgcaa

SEQ ID NO: 42247 - DNA, 429 bp, Heterodera glycines
gccttgcatggcctggcaggtccccctggatcaattacaaattatttatgggacgatcaaattttttcgaaatttttttttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggggggggg

SEQ ID NO: 42248 - DNA, 1035 bp, Heterodera glycines
ttggattccaagacgaagctaatctttggacttctaaaattcagagttttcgaggcaagaagccctaaggccatggtccaaaaaagtgacactttctttggttgtatccataatgtcaaaattaacatcatcaaaaaacaacgcaaaattaccaattgaatgccttcgtatgctctgttgtacacgagtaagcccattgacagctaagagccactgaaaagggggagggaaatcgaaaatcgtattttaaaatatttatttaattaattttggataatataattaatatttattcaagtttccttttttggtgctaaccataaaaatggtgatgccaattccgcattttatgccttccctttcgtatttccccacaaaaatcgtcgctcgaacgcgttcgaccttaaaaaaagaattaaaattaattatatttatccttttgaatattattttaccataattccaaaatggaaaagcggtgaagcgaccaaataaacgtaaacgggcatccgaagcaaaaaggcgagccaaattggggtcaaacattggcacgggtcggaaaaattggcgaaaatgaacttaaaagggcaccgaaggaattgtggcatgagttaaacagaaattaccaaatagcgaacggaagtgatcagataggacaaagcaaaaatagcatacagaaaaagcatatttagcaaaagcaactaaataaagtcaatcggaaatttaggggaattaattattatttttaatatatttcacttttaaatttacatgcaatggcaaattaggtttcttggcaataaacacagaaatgttgagaagcaacagaaggatcaccgacccggtgatcagatgggcccagcggacgaaaaaaatagccaaaatcggtcacgtaccttgggcattggcacaatcagtcaaattgggcgcggacccatttggcgggatggaggacgaattcacggacataattaagggataattacaaaatggtaatttggtagtctgtaattggcctaatttaagaattttaat

SEQ ID NO: 42249 - DNA, 1145 bp, Heterodera glycines
gaatgcgtgaaaatggtctttgggtgagaggtttgccggcgcagcagaattatcgcacaaaatttcgagtaagttgaggaaccagggacggttcctgccctggggtggaggtgtaagccggggctcgggtctcggctaccgattgggattgaaggggagaggctcctccccattggaacgcccaccgggattccccttttaagcgatggctctcccagccgtcgaggccagtcagtcagtcaattccccagtcatcactcccactactggccctccccctaagccgaccgatgggacggagcctttccgcgggggctacggcccagtccaacaatccgtcggtggacggaggagatcgatctcaggggtcggaactaagcaggccgaatcctgaaacccggcacggcttaactatatatttgcgtaatagtggaccattttactagttgttctgatttatggggcaccgaaacaaattcattcggaccgtggaagagaatttttgaactcagtgttggaagaaattagcaaaactctaggaataaaagtctttcactgccggatatgatcttcagggcaacggacttgccgagcgagttaaccgaattttaattggtgccggagcccaccgaccgacgcagccgagatgccagagaatgcccaaagaattaagtgccagaaacagaagagacggaggaaataatttttgaacaaatttgcatttattatttattaatttaaatttcattctccattttattattatcatccatatctttcatcctttgcctttgcgatcactttatttattgatggaaaagtcggagacaagaagaaaaagagcgatagggaatttctcagagtttaacaaaaagcggaaaatgtccatgagagaggaaaaagggggaaaagatggaaaattaaaatctgttattcattcgcttaacttttttaaaaattctgttcaacgttcttgctctccgatttaaaaaatattatttgtcaatttggtattttcgcaccgtaataaatacttgtcaccgggacattatttgaaggttacggtaggggaaaatttggtgctaaaatttgtttcaccgggaaacgagagattggtccaccggggacttttcaaaacaaaatct

SEQ ID NO: 42250 - DNA, 1045 bp, Heterodera glycines
ggccaattaaaattgttggtgttccagtttatgtttcgtcggcactgcgctttggccaaatggttgtcgctcaatccgtccgtgcagtacgcgttgtttttggacgcggacatgggcgtgatcaatccggaccatttgttggagcattttttggcaaaatttgacaccgaattgccacacggaggaacaattgacatggttttctatgagcgcattttcaacggcgaaataatggccggaagttattgggcacggaacacacgttttgccattgaaatgttgcatttttgggccaatttcactgtgccgtcgcgcaccccttttcgcggaggcaccgacaacggggcaatccatgtaattttgttgggggatcgcaattagggattttttatgggcgcaaaatagggaaaaaatgccaaattgcagcaaaagttgtttttgggccggatatcccggctctattgcagttcacacaccataaaagaaacgacaatacattttttttgtaactttaatgcaccataactttttctaaaaggatccaaattaaactttcttggtatcattcaatagtccaacgaattctttataagtctgctaaatttcaaaaaatttcattgtgtttcaataaagctatggccaagaatgtttagaaaaccaaatttttgaaattttctggccataaattttttgaaacaacgaatttttttttttgaaattttgcaggataatagaggatattaaatgctaccgtatgataatcaaaaaagtttaatttggatgcttctagaaaaagttatgatgcattaaatttgcaaaaaaatttatgtcgtgtcttttttttatcgtcgtatgaactgcaatagagccgatatccctccatctattaaatggttagcgaataaataagaaattttgtgaagaaaaatggcacttttccggtttagggcgcccgaaataaaggggagtccctttttggattgaaaacttttttgtgataattaatcttttcaaatttggtcttccgccggggggttttttgggg

SEQ ID NO: 42251 - DNA, 1359 bp, Heterodera glycines
  misc_feature (27)..(27): n is a, c, g, or t
  misc_feature (53)..(53): n is a, c, g, or t
  misc_feature (56)..(57): n is a, c, g, or t
  misc_feature (60)..(60): n is a, c, g, or t
  misc_feature (98)..(98): n is a, c, g, or t
caaaaaaaattgggtggctttaaaatncgggaatgatcagagcatttaaatgnggnnggnaatgaaacagaagagctgctgcatcctcttcaacagancgatcctcagctcggctgcgctagtggccattcaaaaatgtccaaatcgatgaccgtttcatctatttctttgcgaaaagcggcttttgaaatttaacccataagccacgcattctcatttaattacgaaagtggaacaaattctttatcaaactttgtataagcggcgcccaatcactcgttattacagaatttattggttattaaaatttacagtatttgttttgaaaaagaatgataatttggcgttccgctggctgctattccgattttgcttgggctgctaaagtagagcccggagcaggaccggatcctgcgcaggattttgtaggatcccagtccgcaatcctgcattttttggaaaaatgcaggatttgcaggattaatccggccggatccggtccggcaaaaaattttgaattccaatcctgcaacaggatccgcaaatttgatttttgtgcgggatccgacaggatttcattgattttttgaaattttaaagaacagaatgccaaaatttttgaataaatttataataaaatcaatcaaaataaattcaattttcatctcaaatttcacctagaatttgcaaaaaaaatttcccggcggcgcctatcggcaccactggatcgacattaatcctgtagaattgagtcaaaaggtgtgacatttggtcattttttggtcaaaatcagttaattaattgataaatttcaaaaaaaaaatttcagacggcgcctatctgcatagacggacccctttgttccaagtttttgaaaaaattgcgccgaaaaaagcatttttgaaaagcaaaaaatagtcaaatttattgaccattaacagatttgatttccgatctctttttaccatctgacccattcgaaaaatctttgtcgcccttttaatgcatcccgccagcccctaaaatttcttgtcaggtattttttttttggaaatttcattgacattttttcaaaatttctaagaatccgcaatcctgcgcgggatcctgcaaatttaaaatttccgggctctaattctgaaaggaaacgtgggaaatttttttttcattgcgaaaaacacaaaactaaaattttgtactgatttttacaacaattcaattcaattccttttcataatttttttttgtgacgtcattttgatcagttcgtcaattaattaccgtacttgctcgattatagcccccgggggctctattgttcaaccctcctcagaaggggggctttattcgagagggggt

SEQ ID NO: 42252 - DNA, 922 bp, Heterodera glycines
gtgtagaaaaaaagagatagccatttttctgagatccttattcttctgagaaagcaattttcaacccgacattttgtagggctcaaccgcagatagtaatgcgtttttggggaaaccccacatgtacaacggtgtagaaaaaaagagatagccattttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaacccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaacccgacattttgtagggctcaaccgcagatagtaatgcgttttttgggaacccacatgtacaacggtgt

SEQ ID NO: 42253 - DNA, 1822 bp, Heterodera glycines
  misc_feature (1145)..(1145): n is a, c, g, or t
  misc_feature (1150)..(1151): n is a, c, g, or t
  misc_feature (1155)..(1157): n is a, c, g, or t
  misc_feature (1163)..(1165): n is a, c, g, or t
  misc_feature (1173)..(1173): n is a, c, g, or t
  misc_feature (1179)..(1184): n is a, c, g, or t
  misc_feature (1190)..(1190): n is a, c, g, or t
  misc_feature (1193)..(1194): n is a, c, g, or t
  misc_feature (1198)..(1198): n is a, c, g, or t
  misc_feature (1202)..(1202): n is a, c, g, or t
  misc_feature (1208)..(1208): n is a, c, g, or t
  misc_feature (1211)..(1212): n is a, c, g, or t
  misc_feature (1215)..(1216): n is a, c, g, or t
  misc_feature (1219)..(1220): n is a, c, g, or t
  misc_feature (1223)..(1223): n is a, c, g, or t
  misc_feature (1226)..(1228): n is a, c, g, or t
  misc_feature (1230)..(1232): n is a, c, g, or t
  misc_feature (1237)..(1243): n is a, c, g, or t
  misc_feature (1248)..(1250): n is a, c, g, or t
  misc_feature (1254)..(1255): n is a, c, g, or t
  misc_feature (1262)..(1262): n is a, c, g, or t
  misc_feature (1268)..(1269): n is a, c, g, or t
  misc_feature (1271)..(1275): n is a, c, g, or t
  misc_feature (1285)..(1285): n is a, c, g, or t
  misc_feature (1297)..(1297): n is a, c, g, or t
  misc_feature (1306)..(1306): n is a, c, g, or t
  misc_feature (1308)..(1310): n is a, c, g, or t
  misc_feature (1313)..(1313): n is a, c, g, or t
  misc_feature (1316)..(1316): n is a, c, g, or t
  misc_feature (1322)..(1322): n is a, c, g, or t
  misc_feature (1324)..(1324): n is a, c, g, or t
  misc_feature (1333)..(1333): n is a, c, g, or t
  misc_feature (1335)..(1335): n is a, c, g, or t
  misc_feature (1340)..(1340): n is a, c, g, or t
  misc_feature (1342)..(1342): n is a, c, g, or t
  misc_feature (1349)..(1351): n is a, c, g, or t
  misc_feature (1353)..(1353): n is a, c, g, or t
  misc_feature (1355)..(1355): n is a, c, g, or t
  misc_feature (1358)..(1358): n is a, c, g, or t
  misc_feature (1360)..(1360): n is a, c, g, or t
  misc_feature (1364)..(1364): n is a, c, g, or t
  misc_feature (1366)..(1366): n is a, c, g, or t
  misc_feature (1375)..(1375): n is a, c, g, or t
  misc_feature (1377)..(1377): n is a, c, g, or t
  misc_feature (1382)..(1382): n is a, c, g, or t
  misc_feature (1384)..(1384): n is a, c, g, or t
  misc_feature (1391)..(1393): n is a, c, g, or t
  misc_feature (1395)..(1395): n is a, c, g, or t
  misc_feature (1397)..(1397): n is a, c, g, or t
  misc_feature (1400)..(1400): n is a, c, g, or t
  misc_feature (1402)..(1402): n is a, c, g, or t
  misc_feature (1406)..(1406): n is a, c, g, or t
  misc_feature (1408)..(1408): n is a, c, g, or t
  misc_feature (1417)..(1417): n is a, c, g, or t
  misc_feature (1419)..(1419): n is a, c, g, or t
  misc_feature (1424)..(1424): n is a, c, g, or t
  misc_feature (1426)..(1426): n is a, c, g, or t
  misc_feature (1433)..(1437): n is a, c, g, or t
  misc_feature (1439)..(1439): n is a, c, g, or t
  misc_feature (1442)..(1442): n is a, c, g, or t
  misc_feature (1444)..(1444): n is a, c, g, or t
  misc_feature (1448)..(1448): n is a, c, g, or t
  misc_feature (1450)..(1450): n is a, c, g, or t
  misc_feature (1459)..(1459): n is a, c, g, or t
  misc_feature (1461)..(1461): n is a, c, g, or t
  misc_feature (1466)..(1466): n is a, c, g, or t
  misc_feature (1468)..(1468): n is a, c, g, or t
  misc_feature (1475)..(1479): n is a, c, g, or t
  misc_feature (1484)..(1484): n is a, c, g, or t
  misc_feature (1486)..(1486): n is a, c, g, or t
  misc_feature (1494)..(1494): n is a, c, g, or t
  misc_feature (1496)..(1496): n is a, c, g, or t
  misc_feature (1501)..(1501): n is a, c, g, or t
  misc_feature (1503)..(1503): n is a, c, g, or t
  misc_feature (1506)..(1506): n is a, c, g, or t
  misc_feature (1509)..(1509): n is a, c, g, or t
  misc_feature (1511)..(1511): n is a, c, g, or t
  misc_feature (1516)..(1516): n is a, c, g, or t
  misc_feature (1518)..(1518): n is a, c, g, or t
  misc_feature (1526)..(1527): n is a, c, g, or t
  misc_feature (1539)..(1539): n is a, c, g, or t
  misc_feature (1545)..(1545): n is a, c, g, or t
  misc_feature (1552)..(1553): n is a, c, g, or t
  misc_feature (1557)..(1562): n is a, c, g, or t
  misc_feature (1567)..(1570): n is a, c, g, or t
  misc_feature (1575)..(1575): n is a, c, g, or t
  misc_feature (1577)..(1577): n is a, c, g, or t
  misc_feature (1580)..(1582): n is a, c, g, or t
  misc_feature (1585)..(1586): n is a, c, g, or t
  misc_feature (1591)..(1591): n is a, c, g, or t
  misc_feature (1603)..(1603): n is a, c, g, or t
  misc_feature (1611)..(1613): n is a, c, g, or t
  misc_feature (1615)..(1615): n is a, c, g, or t
  misc_feature (1623)..(1623): n is a, c, g, or t
  misc_feature (1628)..(1628): n is a, c, g, or t
  misc_feature (1638)..(1638): n is a, c, g, or t
  misc_feature (1640)..(1640): n is a, c, g, or t
  misc_feature (1642)..(1643): n is a, c, g, or t
  misc_feature (1653)..(1653): n is a, c, g, or t
  misc_feature (1655)..(1655): n is a, c, g, or t
  misc_feature (1661)..(1661): n is a, c, g, or t
  misc_feature (1668)..(1670): n is a, c, g, or t
  misc_feature (1674)..(1674): n is a, c, g, or t
  misc_feature (1679)..(1679): n is a, c, g, or t
  misc_feature (1687)..(1690): n is a, c, g, or t
  misc_feature (1694)..(1696): n is a, c, g, or t
  misc_feature (1699)..(1701): n is a, c, g, or t
  misc_feature (1708)..(1711): n is a, c, g, or t
  misc_feature (1719)..(1719): n is a, c, g, or t
  misc_feature (1722)..(1725): n is a, c, g, or t
  misc_feature (1728)..(1731): n is a, c, g, or t
  misc_feature (1744)..(1745): n is a, c, g, or t
  misc_feature (1748)..(1748): n is a, c, g, or t
  misc_feature (1750)..(1750): n is a, c, g, or t
  misc_feature (1754)..(1754): n is a, c, g, or t
  misc_feature (1759)..(1759): n is a, c, g, or t
  misc_feature (1761)..(1763): n is a, c, g, or t
  misc_feature (1765)..(1769): n is a, c, g, or t
cgattagaccaatgtcccaacaaatcacgcccaccgtttcattcccgcagggcgatgacctgcgcagaatgatcaacaaaatgattggtcagtcatgcaatctgatgctcggctctctgtttaagctgattacgaaccatcaagaattcattaccaaatctccgtaacattattagtaaaatgatcaaaaatcgtaaaaaatgggaaaaataagtaataagtgagcgagtaggcgacaaaaattttttaattaaaaaatattttttcatcctaaactaattgaataatgcggttaaagcagattgatcaatttttaaaattattaaattttgttttcttaatttaaataaaaaaagaaattggcggataaaatgttgctaatttgtatgttgtaaatgaatgactgtagaagttaaaattattgaaaaaacgggacctgaattccaataaaacagtccggctaattgtcaaattaaatttgttgaaaaccgggacatgaattccgagaaagttacagtgatttattgtcgggctaattattctaatttaaatatcaaatttttttatcccatggaaaaattttcttacttgttgcatgattattttttttttaatttaaaaatcccttttctataacataaacaaattttcgaattaaattattttttctaaattttccccctcaattttctttcaaaaaaaccatccccggtttaaacacatttttttcaaattcactcactctctccgtccgtttacaagaagcgcccaagccccacccacagggctaaggggtgccataatgcattttgatcaaattttaagatttcaatgctgccctaaaatttaaatcaaatttaaaaaatatgcttgaaactctctttgtcgaattttaaatttaagtttgtgtgtttattgtctcgaaatttaattaagagggtttttgattatcatgaaaatttaaacatgaagcctccttccttctaatatttatctaaaaaatttatttcttatttgatacatttatttaatattccgtcggttggcttttattttaaattttacttttttctctcctttttttctttttgcctaatttctcctttctaaaaaaaaatttaaatcttttttgaattcaatatgtnttttnnttgnnncttttnnnttttttcncctttnnnnnnttttgnttnntttnttcntttctnttnngtnnttnnttntcnnntnnnttttnnnnnnntttcnnntttnntgccttnttttcnntnnnnncggctctccncccggggtgtgncttgtctcngnnntgncgngagcgngngtttggcgngnggcgngngtccccnnngngncgngngcgngngtttggcgngnggcgngngtccccnnngngncgngngcgngngtttggcgngnggcgngngtccccnnnnngncgngngcgngngtttggcgngnggcgngngtccccnnnnncccgngngttggcgngnggcgngnggncgngnggcgngngtttttcnntttttttctgtngccttnttttttnntttnnnnnncttcnnnntcgtntnttnnnttnngggtncgggcctgggtntttgggcnnntnccgggtcngggtnttgctgggtncngnnggccgggtcngngtcctngtttttnnnccgngtccnagtcatgnnnntccnnnccnnnttctttnnnnttttttcntgnnnnttnnnntttataagcatgnnatntntttnttttngnnncnnnnntttcttctttatcggttttttccacctttttttgcggtgcgttttttaaaact

SEQ ID NO: 42254 - DNA, 1074 bp, Heterodera glycines
caatttcatggtaaaagtataaaaattgcagtcctaattagcagacttaacttttcttactttcgtccacttaaatttgaaaatggcctcgggtgccgctccgtgcagtgaccagcgaaattcggcaaaagcggcggacaaagcgccgccgccctcgcagggccaccgaagtcgcaaatgggcgacggacggaggggcagcagcgcactgcgaaaatgtgggcatttcgggaacatttcgacagttaatttgcgattttcagtgcgtcgtttgcggtgatcgggcgtgcaatcaccagtaaaattagagaaaacagtcaaaaaaccattaaaaccgttaacccccccccccctcaaaaaataaagttattatggcgttgccgcgtgccatggctgcaaatgtttcttctggcgatccatcaaaaacaaaatgaagttgtttgtgactgagatggcattttcgccaatgttccttttaaggtacatttgtcgtggagacggccaatgcgacataataaacccaaaccatcgcaattcgtgccgcttttgtcggcttcagcgatgcctaaaggcaaaatgcgcaagggcaattaattgaccaattaattaattggggactatttaaggccggaatgcagccggaatcagtacgaatgccgaaagaaggagcggacaatgtgacgaagcaaattgccattttggagcaatgcctaaagggcaccaaagaggcggagggactgaagcggaaatgggagaaaagtgacggtacgtgggagagataggatgttacagggagagtatggtagttggatagtacggtttaagtttagctgaattgacagaatttcctggccattccggcatttttttaacttatcggcacaaactttgaatgccccggggtccattcagccaatctctgctgttatttgtcactttttcagctctttcctcctctcatttgcattgtccgttgtgccatcagcagcgacttcccccgccggcagaacacctcaaaaatgggccaaacattcaaagtcagccgatggtcgctgcacattcattccagccaaat

SEQ ID NO: 42255 - DNA, 1342 bp, Heterodera glycines
  misc_feature (6)..(6): n is a, c, g, or t
cgtttntgtgcgagtacaactggaaaaccaccaaaacttaccataagagaacatcgtgaaaacatgttcccaggagtttttggcttcactgaacacgaatcagcaaccgattctgtaaatcccgaatttcgcactgatttcgtcagactccactgattcggcccattggaaagatttaaatttttaatgcaagattgattgactgaccagcttgccctctttgatcatgaaccatcgtcggttccacgatttgaatgcgtttgtggcccgcttaaacaaatagccctccatgatgcattggggatcaagcggaatgccggaggggtgttgaaaaatttccttaaattaaaaaagaaattaatagaaaattgaaatggaaaaatcaatgaactgggaaagacagaaaaaggagaaaaagtccgtaaaaaagtgaaagtatccattgaaaatttaaaaatgatgaatcactgagaaaaaaatatgggaaaaagagaatgggagaaagaaaagtcacaacgcaatgaaaaatggagaaaatgcgagcaaagcgctaaaggttaaaaggggaaaaaacagagtcatttatcacgaatacatttcaaatttaaaggggtctccgaaaagtgaaattgacacttaaaaacgccaaattgaggaggaaaacaaattttattaatccaattcccctgggtgttcgattagcaattgtcccggaaaaagaaaatgcaaataaattcaaaagtccgccctctcccttccgttgtcagaaaaaaacacacttttggcacgaacgcgtgccggtcctgcattttgcgctccgtctgtttgtacgtgctgcgcatgcgcatcaccgcgtccccaatcagaaactcctgttgctctgcaaaaatttgactgcctcgggtgaaaaagttgccgtactccttgacaaacacccacaactgaaacaataacaacatgcaaaagggcgagaaaatggggtagaaataaacggacggaccgcctcaagcagcgctggacatttcaaagcgtgagcaatgctaactgagggggagggattaagcataattttgatggaataattggaagcatgcgcctttattataaaaccactttgtgccacatagtcgagcccaatgtgggagaagcatgtgccaatggctgtcagtgcattctccgagtcgcgcaattccttcagaaacaaaatggaagtgtttagcgttgaaaagattgtcaagagagggaaaaaaccccaaaaataggcaaatcaaaggaaaaagttcaggggaacatttactacaataaatttgccaaacttaaggccacctgcgctttgtttctg

SEQ ID NO: 42256 - DNA, 1307 bp, Heterodera glycines
  misc_feature (708)..(708): n is a, c, g, or t
  misc_feature (1198)..(1198): n is a, c, g, or t
gggtgaaaattattttggcgattgcaatcggaattccgaaaatatcggaaatcggcaatcggaattccgacggctcaaaaatttcggcaatttggaaatgaaaattttccgtcatatccctgctatatttaacaaaaaaaaagaagtaaatatttggtaaaaaaggattgatttaatttttgccaatagtttccatagaaatatggccaaaaaaagttttggtcccaccttatgacgactacaaatggacgactgccttattctgctaaacaaaactttcaagaaccaatggacaaatacatataattcttttctgcctccagcagtgggcaaaaatgttttacgtcggactctttttgggcagccttttttgtgttgctaaaaatggcacaaaattgagcatttttgccaattttttgcattcataaaaatgctgtgagaaatattttttattacgtaaatttatgaagaaattaagaaagatatgtacataaaattgtgaaaaactaaggtttgtaattttaaattttgaatttaaaaataaaattttcaattttggttttaatatttattccattatattaataaaaaggaaaaaacaaatttaaatccgatttaaaaacatattttaatctttttttttaattaaattattttttatagcaaaatatatagttttattgttaaaaataataataataataaagnaaaaaaatatatcttctttatttttaaaataaaatacggtttttaaaaaaaatatacttttatgaaaataatattagatattttatagttcaaattattaatttacaatatttatttacacttattaaattatatatcaattgatccttttctccctctttttccacatctttctttcatttatccctcctcttcttcgctataatgctttttcatctgtccctggcgctttagccaaggcttttcctcaaatccgcccccattcagccggacgggcggtcgtcgtctccgtactccgatcagagctgcctgcacatattccgctaggcataaacagaacgctctccttctctcgtctcccctcccccggacggggaccaaaaattcagtgccgccaactcagtcccagacaattttaggcgctataatgtaagccataacttttttctttcttggttgaaaaattaataaaattgctaactgaagctanagttttttaaatagtttgaagagagtttttaaatgagatttaacaattcacaagaaatgaaaatttgaaaattgcaacaaaaaaaaaatcagaatttttgagttttttt

SEQ ID NO: 42257 - DNA, 856 bp, Heterodera glycines
  misc_feature (140)..(140): n is a, c, g, or t
  misc_feature (324)..(324): n is a, c, g, or t
  misc_feature (374)..(374): n is a, c, g, or t
  misc_feature (393)..(393): n is a, c, g, or t
  misc_feature (509)..(509): n is a, c, g, or t
  misc_feature (702)..(702): n is a, c, g, or t
  misc_feature (770)..(770): n is a, c, g, or t
  misc_feature (796)..(796): n is a, c, g, or t
  misc_feature (826)..(826): n is a, c, g, or t
tttctgggatttacctatagaattaaagaataaaactgacaacttattaagcgaatattattggtgaatgagaagaaaattaaatatttgggattaaaatagggagaaaagtgaattggtggaatgtttttgggatttanatatagaattaaagaataaaattgataaattattaattgaaaattataggtgaatgagaagaaaattaaagatttgggattaaaatttggagaaaagttaattggtgtaatgtttttgggatttatttatagaattaaagaataaaattgataagttattaaatgaaaattataggtgaatganaagaaaattgaatatttgggattaaaataaggagaaaagttaattggtgnaatgttttggggatttagntatagaattaaagaataaaattgataagttattaagtgaaaattataggtgaattagaagaaaattgaagatttgggattaaaatttggagaaaagttaattggaggaatgttttngggatttatttatagaattaaagaataaaagtgataaattattaagtgaaaattataggtgaatgagaagaaaattgaatatttgggtttaaaatggggagaaaagtgaattggtggaatgtttttgggatttagttatagaattaaagaataaaagtgataatttattaattgaaaattataggtgaatganaagaaaattgaatatttgggtttaaaatttggagaaaagtaaattggtgaaatgttttcgggatttanctatagaattaaagaataaaagtganaagttattaagtgaaaattataggtgaatnaaaagaaaattgaatagtagggtttaaaat

SEQ ID NO: 42258 - DNA, 1209 bp, Heterodera glycines
aaattttttccctccggagctgggctcccaatatttatttttcttaaaaattggctcaaagtcgaaaaaatgggcatttttggtgaaaatcttttaacaattgccgctttgtttctctaattttcaaaaaaaaatttcccggtggcgccttccggcacccccggaccctctggaataacttttcaaaatgattttttgactctaaatgctgatttttcactggtaaaatgattttaaaatttttacctgcctggcaaccctggttttttccgtatgatcttcgcgacacactttttccaaatacttttgcggaacctgggggtccggcagtgccgataggcgccgccggggaaattttgaaaatttgagtgtaatttgttaacagattcttatcaaaaaatgccaattttgcgatttttttaggaaaaatagtagtttttggtcaggtggtgagtgaggtcaattcaaaaccgttaaaaaatttcaaatttcgtataactattttgcctattctcctatgaaaatgccattcttaggggtgtatatttaaccccgaccccgagtcggggttaagggtcggggtcggggttcgtcggggttggaagcgtcggggtcggggctaaccccgaaaaatggccaaaaatttcggggtcggggcggggtcgcaaccctaaataaaacagccaatattgtgaaaaaaaattatatttccctttttagaatttaaaaaaaaataaatttaaaaagtgtataaattaagaaaatattcaaaaaaagaaagatcttttcataaaatttatttacaatttttattttaataaaataaaataaaagagccaattattgtgaaacatttttaaatattttttccttttcagatttaaaaaaataataaatttttaagtgtttaacaaaaaatcctaaaatttatctaattgatttttttcaacggaatttgtgggcacaaaattcacaagaaattgtgaggttgctgaataaattttaaatatgtttttatgactaaaatgatgaattgcatttttcttatttccaatttgtttaaataataatgaaaaattcaataaattactttaacaacaataatgccacgtttaattcccctaaaaaatgtttttatcattattttatttttttattgcgaataatttttgcttccgaccggaaattatgttgcgttgttgttttatc

SEQ ID NO: 42259 - DNA, 816 bp, Heterodera glycines
  misc_feature (51)..(51): n is a, c, g, or t
  misc_feature (53)..(55): n is a, c, g, or t
  misc_feature (57)..(57): n is a, c, g, or t
  misc_feature (65)..(66): n is a, c, g, or t
  misc_feature (79)..(79): n is a, c, g, or t
cttttcattttccaaatgttcaactcacttctgctgctccttaagatcatncnnncnaaccccgnncatgggctgctgnctttttttttgtaaaccgtctttttctctctcggtctctctttccttttcccctctttctttgcctcctctttccttttcccctctttttttgcctcctctttctttttcccctctttctttgcctcctctttccttttcgtctcccttctcactcccctgcttctcttcttcacttcctcccgtttctctatttctttcttcatttccttccttcttttcctcttttttctcttcctccatcctttcgggtacggtgcaaagattgaagtacagtaccaacagcatccatccgcacccaatcagcaaaattcctcctcccgcaatcagagcttagcttattaattttgaaagtgatcagagtttttggcgtttgttcagtcaccaaccgatcacccaccattgcgcacgttcggtcatttcaatttgaaccaatgcttaagggggagggggatttgaatcatcaaaagtctaacaaaaggcaaccagaaatgccgatgatgggaattctgaggagggcggacatttcggagagggaaagcaacgaaagatcagcgaagagagactaaacgaaaagtgattagagagggaggggagaagagggaaatgaaaagagagggtggggagagatagggagagtgatagagagagagagtgtgtgagaagggggaaaagaaatagagaaaaggtatggaaacagactttggcgggcaccattaggccattcagagaagcaga

SEQ ID NO: 42260 - DNA, 1374 bp, Heterodera glycines
ataattatgggtttaataaaaaaaaaatctttttatatacttttacaatataaaaaaaaattaaatttttctcactgatgcccttcggaaaattgtaatagccggccgcgcaccgatcacattttcgtccaatcacattcggcttgcatttgcattgtccaccatattcggcacaagcgaagtccaaacttccttaaaaattttagaaattttaaaattaaaattcaatattttttttataaaaaaaaataccctgagtgttgcagtcgcatgccaatgcagcagcattgaaatcagtggtcagtgaaaaaattttttgacgacaataattgctggtgttcgaagggctaaaaattttgaaattttttttattttataaataatttctgaaaaaaatgtttcaattcaatttttgttttgctttttcttaaccatattgggctatatagagcccaccccaaaaactgaaaaaaaaattttttttgaaaaagcggtgaaaaaaaaagttcgtcgattcggaggctaatggactgatgtttcgccgttttggatgtgattttttgtaagaaatttttttaaaaagaaaaaaccaaatcatttttattaattaaaaaaaaaatttcataatttacagtatttatcgtaatttattttgtttatggcattttgtgccgcttttatttatgcttttcaggattttattccgcaaaattttattcaattttttaaaatttattaacatcaatcgtctaaagactaaaaaattaaagaaaagtcataattaatggctaatttttgacaagtgcaatttaaaattatttatttattttcgataacataaaatagccctgccccctaaagctaactgatttttcaaaattttttgaaatttctaatccccccccctaatccgctgaatattgaaaaacccaccggttatggaagttgtcatccgagcatttgtccacaaattcgttggccaattccaatggcaacgggcgcaacactttgtccgtgtactgctccaacggtacgaccatcacatagtcaatgtaaattggccatttttgatgggtttggttggagtagaagcgtcaacacatatttgtcatccagtcgaaaatgatgttggcccgagtgctttttgtccatctaattaaaaaatatataattttttctttttaaatggttatatggtaattagctaattcgtctaatcaggcgattagaagggtaaagatggaaaattttggctataagatgaaactaatcagcataaagaaaatctatgtttttataaaattatatccaaagaatgcactaaatcaaacacaagagagaaaaaagacagaatttctgactctagaggtcccc

SEQ ID NO: 42261 - DNA, 1325 bp, Heterodera glycines
  misc_feature (29)..(29): n is a, c, g, or t
ggagaagcaaggggctgtggctgggggcntaaaatttgggccacatttggagaattaattctgatttctgaaaaagtcccagaaataactatttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttcttttcataccttcttgtagagctcgagctgctctttccaatggacttatcccggtctcgatccgagccgaactcacgaagttatggagtgaaatgtggaaaaattgttttcaccccaagtatttttttctgaaaaccgattaaaaaattcggggtttggtataa

SEQ ID NO: 42262 - DNA, 942 bp, Heterodera glycines
  misc_feature (24)..(24): n is a, c, g, or t
ttccatgtgcaacaattgggaatntggaggtaatatttttcacatataaaattatcaatattttactttttttattgccacctttattttttaaattattttttaattaattttcactttttttctatttttataacttattaataaaataaatgaatgttgaaaaatattattatttataattttatttaaaaaaattcaaatgtaaaagaatggtttttatagtcatttagtatatttttatttaattatagaataaatttatttatattttaattaattttaattttagattttcatcccaacgctgccaatgtgttggaagcagctgttgccatcgttttcctgggctccggcattggactattagctgctttaatgatcggcattgcttatcatttccaatcattgtttttcatcaccctgaggggatggcttttaaagcggattcagttcagcaaacaacaaaagtgatcaatcaaaataaatttataacataataatagaaaaataaaatttaagaaaataaatttgaaatatttttgatcgtttttaaaataaaaaatttccaattttttaactaatttaaattccgaaattcattaatgaaaaaaatccaattgtgtatatatttttagggttaattgttggacctctgatgaaacattcagattaactcaaaaataatcgggaggcataatttctccaattgtcgaccaattcaaccctccacggggccaattcaaaaaaaaaattgctcaataaaaaataaagctttttcagaagagcttttataataagacagattataattaaaatacaaaaaaaaatgtttcttgtattaaattaccttattttaacagtttctataagatacagtacaaattaattggggaaaaattgaaaaatatttaaaattcataaaattaaatccattcattt

SEQ ID NO: 42263 - DNA, 1419 bp, Heterodera glycines
ctaccatttggccctcacaaatctacggttccttttggcatttatcattacacaatttgcaaaacctcattttcagcctttgtgcaaactgtgcgcagaaactctgagactttttgatggtcgtcgtcttcgcttggatggtgccgttgcagctgaaccccaacaaataaccaacgagtgcgctttttcatgtcatgtcatcatgttcccccccccccccctattttttcgtcttgccccgttttgttttctcgcgccttttccgtccgttttttttttgttgaattttttgtgtttggcacgctcactctctctcttccgtggacatcgcttttgcttccctttggatttcacattcaaacaacgacaacctctttttcctaccagtcccacttcctctgccgttgctgggagacctttttcaattcggatccaagcccttgacttgaacaattcaaacaaaaaaaaaattagactttatgccaaagtctgagtgtggcactccatttaattgaaacgccgaattgatttgcagtcaatgtcggcaaaaattgagtcacaaaaagtcgagaaattgatccggcattgaaaaataggcccctggtggtggcatttccgccccctcccctaacacataatcatcatgatcacataatcaatcatctcactttctcatcattttattgtctttttttgtatgtatatacattttttctatgctttctcatgcccccaattttctgattttgtttatattatttcgtcgtttttttctctctgcctccccccttctgcgcaacgctcatatctctcctctcacatcccttctaatccactccctaaattctcctttaacattcatttaacaccaaatttgcgtagacactaattgttttaaataattaattaattacctaactaatctaatacactttccgctgatgatattttgttttttgttttctctgtttctttgcccttggttcattcaccttttgctcttcttttttttgtgtttctcttctgccttttgttttacagtctcacgaacacatcgccaaaacagaaaagcgcgcgcgtatatataaatacaaatatgaaataatcgagtaccatatgcccacatgaacacctaccgtatatgcagagtccaccatttgtttgtttttgtgtcgtatctgtgttttttattttatttttcttctttttgtttaatttttctaattttatttacatttaatttctttcatcaacaaaactttccgtcatcgtcgtcgtcgttttgctttttctattttttctgtccatttgaataaataaacaaaatttaaaaaaacaaaaaaaaacatttggattttaaataacacacactcatctcaaacggctttttcttttccacactttcggatcggaatgaaa

SEQ ID NO: 42264 - DNA, 1184 bp, Heterodera glycines
  misc_feature (11)..(11): n is a, c, g, or t
  misc_feature (21)..(21): n is a, c, g, or t
  misc_feature (23)..(23): n is a, c, g, or t
  misc_feature (38)..(39): n is a, c, g, or t
  misc_feature (41)..(41): n is a, c, g, or t
ccaaaaaccgncggcggcacngnggacgcgacggcagnngngaacggcttttttgtagcgccaatggtagaagcattgctgcccgtttgtgtagctgtttgtcgccgagttctgttgttgatggatctgtgcgaatgtccgtcaaaatgcaatggcatcggttggccaaagaacagcgcttcgaccaattgaacttcgcgcttttccgaccccccaaaagaattgtcgtccaaatggaaatcattggaatttgacggcaaatattcaacggcattcgtcgatttggctggcagcggaagaaagccgaggaaaagaagcaaaggcatcgcctgggggcccatgtcctggaactgactaaagaaaaagaaacgattggaccgatcgaattgtctgatcagcacgtgccatctacaaatgggcaaaagggcttcttcaaaatataaattgaaaaaccctgtccgattttcctatccaaatgactctgaatgatgaaaaagctttggacgaatggtgggcactttgtctccgtggaagcgcatcaaaaagtgtccttttcgtcctttccaaatgaattggctcttacgtcgccaaatccgtccgcaaatcccttaagtttggctttttgcctttgatccgattgtgcgcaatttgtctaattgcggcgacggcgtcgaaaggacggaatgttattttgtgccattagaagatttgatggatattatgcacggatatacgatgtgccgatgatgggagttgagtggggacagaacgatcggaggaaaagcgaaaggaaaagcgaagagaaaacggacgaaacgaagcgaatgaataaaccaaatattgaaaaagcgaataaatccaacggtttttcacattttaataataaaaatatacaaatacaacaaatatgcacagttacagtaacatatcgatagttccaatttcctcttaaaacttttctttaaaaaattaattcagtgtcaaaatatgaaaaaatccatcaatggactcaattaatgagttaatttgttattattaggatattacctaattcatttttatcttttaaaaaaatccattaattttttacgtttattttattgaatagaccataacgatgaatagcgcggatttgcgttgaattgtgtccttttccgtactgatccgccgccgtccattgatga

SEQ ID NO: 42265 - DNA, 915 bp, Heterodera glycines
tgattttacaagcaaaatatctagttttaactctatttaatacttacgaattatagcatcgagagctctatagatatttcgttacctcttttcaacatgacctgacaacgcgtataaaaacaataaaaattgtattaatttatgttgtaaattttcgttacatagcttgcgttgccgagatgatttttatttattatttataaatattattggtattaatagtaactttatcaaatctttttaaaataatttagattatttatcacttgcttttatttcgtttttatttaagttattattattttgttaatctcttgtcttgcttttgagtatttatgttgtcattcattttctcaaagaaaatcactttcttgccaaacaacaaaatattcctcttaatttttataataaatattctctttctcgcactttttatttctttaaattaatttaaagcaattctttaaattcataagaaatgaataaatttttcctgaataatttagtacaaataaaacgggacattttttatgcaattcaataatattattcaataatttattcttatttataaaatttaataattattttcttataaaataaaattattatagtatttataataatttacgatctgaaataatattcttttttgaaaatatttgacattttttttaaattttcaaatattttgttaagtggattaaaaatgaaatcaatgtttgttatctttggtataattaaaattcatgtttagactcataaaattataaatataatatcaataatatgttatgaattcgttattaatcaaataaaaaataaatgtaagttcatcatattcaacctattcaaacaggttttgaattttatctcgcatttcattttacaacttaaaatatatataatattaaa

SEQ ID NO: 42266 - DNA, 949 bp, Heterodera glycines
attttcccctccattccctccccccccccatcacatatttatgtaaaaaagaagatcctccctccctcgtcctacttttgttgcatttccattcaatttcttcattcatttgtgtcttccttcagcaatatttcccccttttccccgtttaatttccatttaaaatattttacatttcccccttccttttagcactttttacattccttccacttcctccttctcttcttccgtctccgatgtttcctcccttccatcctccgtcttcctcttcccccttcttcggcccttcccattcgtcctcctcttcctcttcctcctcctccgtctttcttcactcattcaaacccgtgcagcccttgcagaaaaagcgctcgtcggcaaatgatggcacttctcctcagctgaaaaacattgttggacccgcggcggcggagaagggcaccgatgggcagaaggagccgtgcatttgcgagagggaccaggcattggttgtgtgccgaaggtgcggtgacagaggtggcacattgggggaaggcgatcattaacatagtgacatgggaggcatgccattagagagatttgtcttacaattattaatatctgattactaattagtctgatggtaatatccaaattgggaattaatgagaatgatcagtgattactaatcagtttatacaaaactcaaaggttcactagcgtaatatataagaccggaaaagctagaattataacaatttctaagtgatttggtaattttatgtttcgaccttatttgactttgacctcaatttattttattttcgcatatttttgtcttttaattccctgtgatcgtccatatattgtatattgtcacttactccacgacacatttatatgaatagtcgtcagagtaagtggtactcgcccttctgatgactttttttttatttttacgaataaa

SEQ ID NO: 42267 - DNA, 975 bp, Heterodera glycines
tgggcatgtgtggcacccgtgaacagttggaccccgaggcttggcgaatgggcatgcgtggcacccgtgagcagttggaatgggcatgtgtgcacccgtgaacatttggaacccgaggcttggcgaatgggcatgcgtggcacccgtgagcagttggaatgggcatgcgtggcacccgtgagcagttggaaagcgagggcttggcgaatgggcatgcgtggcacccgtggctagttggaatgggcatgcgtggcgcccgtgctcagttggaacccgagggcttggcgaatgggcatgcgtggcacccgtgagcagttggaatgggcatgcgtggcacccgtgagcagttggaacccgagggcttggcttatgggcatgcgtggcacccgtgagcagttggaatgggcatgcgtggcacccgtgctcagttggaatgggcatgcgtgggacccgtgagcagttggaatgggcatgcgtgcacccgtgaacagttggaacccgaggcttggcgaatgggcatgcgtggcacccgtgaacagttggaacccgaggcttggaatgggcatgcgtggcacccgtgaacagttggaacccgagggcttggcgaatgggcatgcgtggcacccgtgagcagttggaatgggtatgcgtggcacccgtgagcagtcggaaagcgagggcttggcgaatgggcatgcgtggcacccgtgctcagttggaatgggcatgcgtggcacccgtgttcagttggaacccgagggcttggcgaatgggcatgcgtggcacccgtgagcagttggaatgggcatgcgtggcacccgtgagcagttggaacccgagggcttggtttatgggcatgcgtggcacccgtgagcagttggaatgggcatgaatggcacccgtgctcagttggaatgggcatgcgtggcaccaatgagcagttggaacccgagggcttggtttatgggcatgcgt

SEQ ID NO: 42268 - DNA, 1249 bp, Heterodera glycines
acataaatttttctgtattttctgaggttttcggggttgcattatcataaatataatattaatttcattcagcggctcgatattataataagcacgatcaatatgttaatggtgacttaaaaatacatggtctctcaacaaagcttgctaaattataagcacatttttgactaattcatggattgtatttttaatgtaatatcatacataatatcgagctgctgactgaaattaattttatattcgtggtcagcgaccccgaaaaccccgggaaaatattaaaaaaatattttttttttaataaattttaaacacagagacagaagataagaaccttcttccaaagagtggacattccattgcgttttggaaaccattttggcacaagtgaagtgaatcttttcatcctggaaacgatggtattatataatatacataaaaagggaaagaagacggtgctaaaagatttagaggattggttaaaaagaagccaagtggaggcgactcttgccaatggggccggctttaaatgttcccaaaatttcaagttggggggtcaccaactcgggcgaagacctttttcgaatcccaactttataatccagcggaaacccacctggataccaacgagaataaaaagagtacaatttttaaaaaatgcaaaatctgattccctcttcccttcaattgggtgattaagaaatcaaaattgaaaaaacggcacaatcaatctaatttgttcttaatttaaattcattaaaggagtgggaccttgttcgtctcaaaatttcgaatggccaactttttcaagttttgccagaaagctcatgaattgatgttggtgatttggttcgccatcggagaggtaaaggctttctctctaaatccatttaaatttattttaccttcttttatatttctcttatttgaatagatgcaaaaattaaacattggtctccaaaatgtttagatcgagaatggaggaacaccgactacgccattattgacgccaaaccaaagtccaatttcttcgtcactttccggcttcggctgggacagcttcggcgtcgggaattctcatccgggctctggtcacaggtccggcggtgcgaattcgaatgcggggtccggagaattgcccgtcgtgggaccacagcctcagcatgaggaagagtgaagagaccgcttcacatttgggatgttttggtgcataattttaactgaagtggtcaaaaaatgattttttttt

SEQ ID NO: 42269 - DNA, 995 bp, Heterodera glycines
  misc_feature (934)..(934): n is a, c, g, or t
tcttttgatttttggcccttttgtccttaacatcgcctcattcgaagaaaatgtgtcaaaatactgctccgcttttaacccaagtgcgtttaatttatctgctgttatttttcaccaaaaatccatttcgtaatgttccccaaggttttttccgattcgtcattccctcaaaatgggcgtttgtcccttgctgcctctccgcacactttggtctccggcaccgcttttgcgcagtcactttattgtgcccgtaaggcactgtttgctgatcggtttcgtagccctgggtccaatttggcaatgaccgtcggcaaagttgcgcatgaactttttcaggtgagtaaaacaatattgggctattattttccaatttttgcctatcatattcgctcattgtcagattgctctcgttgaacggcccgtcaatttgtccagagaatggctgttccgtctatggcgttgccgttttttgcccgaactttgcatcgaattggtgggaatgcaatgttcacttgagcgcttcgaagaggaattgagcccgtacctggacaacatcacctcatggattagggtaaagcggggaattgaaaattaattattttgactaaatcgaactaaggatggcatttcccgggaacaatgtgattttatttctatcaaagttcaaaaacacttcagacacatattaccgacccatgtccaaagccaattgcgcatttgaagcgccgaccgacgccttttaccgaacgaaagggaagcgacgaagaagcagaggaaaatgacaacgatgttcaaaaaggcaaaaaaaaaatagttgaaattgcaattagtggcataagtacccttttaagtatctgattctgaacccgtctatttcaatgccattcgtgacattgaggagaacgtttggacacctacgcttggcttgaaaggncggattgacgtttcatttgtggtataaaatttttggtaattttttgcagttttttttaggc

SEQ ID NO: 42270 - DNA, 642 bp, Heterodera glycines
ccccccccttttattcgttgcttttccttcgatcattcattctttggaatgtctcccctcctcaatttgtttgatcctttcattttttgtcttttccttcgtccgttgctttgcactataaaaggcgacggattcatgggtgtgcaatcgctttttgcgtccattcctccgccgtcgaattgcttcgcaatttgtgcgccatttgcccatttaatccattcattttcgctttctttcccactctttttttgctttcatttaactcaaattgaaagttgtcttccttccgtcgatgggattttgatgagagagattttaggcagccaaaaaacgagtcgcattttaaatgggggggggggggaaagagattcttttgctgctgatcagatgctgaaaaagaaggtaaacctaaactttttggcctgtttagagaggaattaaaaatttttaaaaaacttattcatctccctttttgatagaaaaagcatcagagtgcctaaactaacatgtaaataacatttggcgcgtatcagaaccctttctgaaaaaatacttaagaattaattttgctaaaaataaataaaaacgaaagactcagattttcaaaaatatttatgagccaactagctcgggggtcatttc

SEQ ID NO: 42271 - DNA, 893 bp, Heterodera glycines
atataaaatttatcaaaaccctaaaaatatgtataaaaaattatttttgcatgcataaagcaagcagtttagtgaataaggttttttagtgaacatattctttgatctcttattatatactattatcattaaattaatatttatagtaattaattaatttttatatagaaaacaataaaaaaatatttattttctgcaatttacaaataaattcgacctttaacagtttataaatttaattcaaattaaatacattctaatttctattggctctaactaaatcaaacacagaaaaataaataaataataatgtagtttcattaaaatgcttttttgctaatgaaatattaaaaataataaattacttaattaataaaaatttaatttttgattaaatggaaaattattcatttaaaaaaaattaataatattactttgtaaaatgaaaagaaaaattctaaaaaaataatttagcaatattaatagatttattattataataatgttaaaattaaaattccctatccccgggaacatttttcttacttggttcattcatcaagaagcacaaatattaatacattttgataaaatccgggcactggttagaccatgataagtccaaatatattctttatttgtaaaaaaatactattattattcattagttaaattaattgaaattcttaaacaaaaattatgctcgatcaaagcaagaactaaatgtaatgaatggaaagaatattgttattaattcaaaaatagatttcttttaaattaaagtaaaaatggcttcttagctgataataaagaaatacaaaattaataattttatttttaaatatttatttttaagttggcattgctttccttataatagaatgccataataa

SEQ ID NO: 42272 - DNA, 70 bp, Heterodera glycines
cgccgaggacatgcagggcatcaagctgcgcgtgatgcagaaccagatcgcgctgggcgtgttcaacacc

SEQ ID NO: 42273 - DNA, 829 bp, Heterodera glycines
gggggggggggaagggatgagacaatgatcacgcccaacagtgatcagataatgatcggcagtgatcagacggacagatgagatgattcaattgacagacaaaggcacagtgattagagaaaacaacaaatttatcactcggaaagtaaaatggaaagaatcaatgtatcaaagagcagcaaagagatcaaatcacttcgttttccattggtcgtcgttttttactcaatttaggcacttcggagaggtggggtcactggcgagccaagggcatttctgaacagtcgcatttttcaactccaatctcatccatggattgctctgtcctttcaatagtcgagagtctcgagtcaacaaacctttctttattaggtttgtttcacaacaatcccccaattatccgctgtcattcctctaccccaccgtccctcacttttcggttgtcccccgggggtttcgtcgcttcgcttttccctccttttgcttttccacccaccaaattctgttgtccgcatggattgtgtccgatggagcagtaccaatcgtggtagaagaacagccacattgtggtgaacagcagggacacgtagaaaaccagcgaaagtaattccaaccgacggattgccttttgccaatcactttccatgtcattttggggtgtcatcgacacaatgtcctgcctgggacattctcggggaatttttttgaatttggaaagattgtgccaccttatgccttgtacatttcgctccaatcggcacaaaccgaacgccaactcatcgatcagtagctggaagcactggtagagcagcaatttgtcttggtgaag

SEQ ID NO: 42274 - DNA, 1162 bp, Heterodera glycines
  misc_feature (58)..(59): n is a, c, g, or t
  misc_feature (61)..(61): n is a, c, g, or t
  misc_feature (67)..(81): n is a, c, g, or t
  misc_feature (83)..(86): n is a, c, g, or t
  misc_feature (103)..(105): n is a, c, g, or t
  misc_feature (107)..(109): n is a, c, g, or t
  misc_feature (111)..(112): n is a, c, g, or t
  misc_feature (114)..(115): n is a, c, g, or t
  misc_feature (121)..(122): n is a, c, g, or t
  misc_feature (124)..(125): n is a, c, g, or t
  misc_feature (127)..(127): n is a, c, g, or t
  misc_feature (131)..(131): n is a, c, g, or t
  misc_feature (136)..(136): n is a, c, g, or t
  misc_feature (138)..(139): n is a, c, g, or t
  misc_feature (143)..(143): n is a, c, g, or t
  misc_feature (148)..(148): n is a, c, g, or t
  misc_feature (152)..(152): n is a, c, g, or t
  misc_feature (156)..(156): n is a, c, g, or t
  misc_feature (159)..(160): n is a, c, g, or t
  misc_feature (179)..(179): n is a, c, g, or t
  misc_feature (181)..(181): n is a, c, g, or t
  misc_feature (194)..(194): n is a, c, g, or t
  misc_feature (1107)..(1107): n is a, c, g, or t
caggtctatttaaaaaccctaaaacttattttcaatttacttattctttaaaaaatgnngngattgnnnnnnnnnnnnnnngnnnntccttaaaaaaaacatnnngnnnanngnnaaaaannanngnaaanaaaangnnaaanaaagnaagnaaangannggcccctgaatgaaatatnanataattttatgtnaataaagtacgtgtataatgaattggttggacaccgattcatattatgtaaatattatagaaaatgatggccgagttaactttcaaaatagattagggtaaaaatttgtgaattcaaaggacaacttcaacaatttatcaatgcaataaaatggcaaatttaattcaatgtttttggacgaggaaaattggattttgcttaaatttgtagaaaataattgtgtcacgaccggttattaaccggtacccctggttttggttatgccggttttggacccacggttttcggttaatgaaaaagtttttcattataaatagcattttgaacatgacgagacttttttttgctttcggccgagtgagtaccgtgcgattttcggcactatgataatttcagcgctcattatgggttgtataatggcgacagcagtttttttacgacgtatttttcatggggaggagtccggcgccggtcaaattcctaaagattaagcggtgacttttgaaccctaacaacgacaatgcatttggacagttgcaaataaatgaacatagtggccgtgatgcaaacgacgagaggcaaatcaaggttttgtgctgagcgaacgaatttgacccataatttgggagggggcaggcccagcccaaaaatttgttcgaaattatggcatggaacatacacaaaattacgatgactccttcggttatccaaaccttagacgaatttcgatatctgtcaacgagaagcgctgtgttggagttggcccgcaaaacctcaactgactcagcataatgttgaaatccacaagcaaatacatcattttggtgtttttgcgcgtagagccaataacattccgttttgaatgctggttcagcaaaacccagctgcggttcaacaaattttggccatcctncagcccaaccaatgcaagcgtccaattttcaaccacgccaaccttatgcctggcc

SEQ ID NO: 42275 - DNA, 762 bp, Heterodera glycines
tatatatatatatatatatatatataacgtgtcaaatgtctctagtttttattttggggcaagagataagcggcataatgaagcagcagcagtcaaaagagcaacctctccgccatcaacaagtgccccctgttttcgagcatccgttctcaatgtgtgtgtccgggtgtccgggcagtggcaagacgaaatgggtattgcgaatgttgtccaacctggacaccctcgctggccccgcacacctttcgggtgtgctctactgttatggggaagtgaatgaagacgtgctgcgactacaacaactggaaactgagacgggggaggaggaggaggaggagtacaaggggggtcaaccgcggcggcgctgggtccgcccctgccacgcgcttcccgatgaggaggcggtgaagcgggcagccaaagcgtgcggcggcagactgctattggtgttggatgacctgatggtcggcatgcgtaacaaaatccttgatctgttgttccaccgtggctccctacacttggggcgtcatgtcgttgtgttgatcacacagcatctgttcacacgagatctgaacatccaaaacaacgtcgcccagtctttggtgttgctgaggatcccggcagcgactctacatggttccgaaaatccacaaatctattcatttttcatcaaatgccgtaagtgtcaatttcgatgaccactgattttttcaaaaaaaaatgaactattggaatttgtcgtaaactgaacagatttgatga

SEQ ID NO: 42276 - DNA, 1478 bp, Heterodera glycines
  misc_feature (35)..(35): n is a, c, g, or t
  misc_feature (1451)..(1451): n is a, c, g, or t
ttttgttttagcatataataaaaattttaaaattntggaaatttaatatttttgcaattgtctataaagtgctctttagcccttgttttagtgtttttaatgtcaattattaatttttacacaattttttgagagttaaaagctatttttagcaattttaaggcatattttagtgcatattttggtatttttcggttattagtgcatattttatgcgcatatttggcatttttagtgcatacaacttcgaaccctattaataaccgtcgcaaacacaaattcttatgacgatacaaaaataaaagcaacaataaacattttgctttagaaaaaataatttcaataaaattatggcggctcgaaaaactgataattaaatttattggtaaatttaattttaaccatgataatgaataattttaatttgaaatgacagaagaatttattaaacggctttgatatttttaaagtcaactttaaaaaatatattagttattgtaaacacatcaagtaatataaaaaaattaataatgattaattgcgagccaaaaaaacaattttgaatttaaatagtaaaaaatattctgtaataataatttataacagcttgacgaatatctatctcatcctaaaaacaaaatcattcattataagctcattaatgaaaatttggcctagaaattttaatgatatatgagaaaaattagggttagacgggtccgggtatttgggcaaaaaccgggtccgtgattgccgggtattgaaaagccgggtaccacgtcgggtaccagttttcagaccgggtccgggcctgggtaccctggtaaaaccgggtattaagaaataaaaaataaatcaattttttgaaaaattttttcattaaaaaaagtttatgatttttaaaaagcatgaaaaatataatgttttacaaataacgctttattaattgccccaattttttgttgttatttaaacctttttgcggtgattttccaaaaaactttcgtggccaggggcagtgcggtggtgccgatcagggaaggcacggaattccgatttccgacatttttggggtcggaattccgatttccgaaatttttgatgaaaaagcggaaattttttttgaatttttttcaaaaaattaacaattttttacaacttttgttaataaattgcactgaaattttcaaaaatttcccggcggcgcctatcggcaccgccggaccctaaaaatcttatttttcttgagaaattttgcctcaaaatcgctaaatttggtcattttttggacaaaatttgttaacaatttgcattaaatttataaaattttccccggcggcgcctatcggcaccggcggacctccctcgccatgttttcaaaatttgaaaaaacaagccgcaaaaaaaggtaaaatttttgatgaaaatcattgaataattttttaaagcanaatatatattaaatagatcaaaaattt

SEQ ID NO: 42277 - DNA, 833 bp, Heterodera glycines
tgacggacaaaaaaacaaattatttacaacaaacaacgcctatcggccgaggggggggggggagagagcgggagagaaagatagggcggagagagagaggggaaggacagagaaagagagggtatttgctgcatttacactaatcacaagcaaacgcacttattaccttaattaaataattaattaacgtgattaccaaccacgaccatcaaaccatgtaaaagttcaacactctcgacaataatttgttcttgtcagaaacggataaatcaatgtttttgtgacaaacttttattgtaattcgttttctgtatactgtatttgcagggtaattattaaattaattagcataaaaacaaattaaacttagcaattctataataaataaattgtatttttagtccccggcgggatctcgcggggaatttacaaggagtaacctaaaccagaaactctaagaatccgaaaatttctctactatgagccgagactctctctctcgcaaatcccttccaaaattattcgaaagcatttggccaatttgttctcattttaatttcgtggcgttgtttccatggctacgcccgagggcattttgagcggatgtttctcccccccccccccgcacattggggcggtgcgcgacacaaatccgccactcgcccggcggggggggggggggcacggggacggcatctttgtgatttggcacttcatcgcagttgacaacaatctttcaaaactttttgtgagaggcccgcgcggtcaccagcactatggctaattctcggcgggtgatcgcgcccgcattaatcactttaagacggatattt

SEQ ID NO: 42278 - DNA, 1315 bp, Heterodera glycines
  misc_feature (41)..(41): n is a, c, g, or t
caagtaagccaaagaaagggtcacaaagggaacattcgtgnacagaaagggaccggcaaatggacgggcattgctgcactcgaatacggcattcccgtcacactaattggttggcgtgatcattttctcgcaattgacaaatgtccaatttagcggaggccgtcttcgcccggtgtttgtcggcactgaaaaaacagagaatggacgcgtcgaaactgctgccgaagccatcgaaaaaagcgagcgatttggtgaaagacagcaagaaatttctaaacagcattggcagtgtgagtttggggagaattggaaaatgattaatttacaaagggtacgacggtgccggaaaaaatttaaattctcatttttgtaaacagattttcactcagaaattgttaatttgtgggtttttgggaaaattttgcaaacttgaaaattttcaagcgatttttgaaaattttttgaaaaacctcttaaaaattttcaaaaccaatgtttttgtaggcgttgtacgcctccaaggtggtcagctacgcccagggcttcatgctaatggctgaagctagccgcgagttcgactggaatttgaattacggtgccattgctttgatgtggcgcggcggttgcatcatccgttctcgattcttggaccgtattcaaaatgcttttgaaaagaatccgtcgctggtcaatcttttgctggacgactttttcatgaaagccattggagacgctcaggcaattcaaatgcaattttagcgaaacgaactctcaaaacaccgaattgtccccgcaggactcgtggcgtgaagtcatttcgaccgctgttcagcttggcatcccaatgccagcgtttagcagtgccttggcatttttcgatggctatcgtactgaagctctcccggccaatctcatccaggcccagcgcgattatttcggtgctcacacttacgaactgctcgcccagcccggcgttgctgtgcacacgaattggacgggcagaggagggaaagtgacgtcaaatgcgtactccgcctgatgaattaacagaaagacctttcaattagtgaccgatcaaattgtgattttgccttatgttgtcatattttatcacttaattttgcaaggaaattctcattgtgatgaaaaagggattgtcattcacaattaattaattaattagctgtgccttttatgcggtccgtccgacgttttgccatttcatttcattttccctgcccttcgctgtcgtcggtcagtgccaattcgtacagtgtcaaagtacgcgttcgcttccttcctctctcttccgctg

SEQ ID NO: 42279 - DNA, 961 bp, Heterodera glycines
ttttaatatattcctttctaggacttgacctggtttcttgatatcgaagctgttttctacgctatttctaaaacggctataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttgatttcttgatatcgaagctgttttctacactatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagctatttctgggactttttcagaaatcagaattaattctccaatgtggcccaaattttaggcccccagccacagccccttgcttctcccagttttaagtcttgcatttgtcaaataaattcaagacttcaaattaataatcaaaaattctcctaaaaatttttttgaacccaattcaaaa

SEQ ID NO: 42280 - DNA, 1005 bp, Heterodera glycines
tctgaaggatgttctaagtttgattttatacattggacctttggttttgttcatcgttcattaaggaatatttttttaaagtaatgttatgttcctccttcggattgactatttgatcctcagatatatagtttatattttcgtttatttttggcataccttcaaaatcttttaaacttttttcaaattttaaaaggccttggttcaaaagagataaaaccatttggtaggcaatatctttgggatagtttttctttaggtcatcacttaaagcatccttgtactcattccataacaaactcggatattttggttcacaattaattaaaatatttacaaaaagatttcggagacctcttggaaatttaaactgactggcttcgtttaagcacttatcccattctgaatcatctcttgttaatcctaaagctaagcaggcttcagcataattcgtatatttaattccattaacaatttttaaatcatcaaaacttgttgcttgtttatgtaacaataaataacgaagataacataattctctgttttttggatttactgtataaattcttccgataactttatgtgtttttttccttggccatttccattttttggttttgttatcataagtgcaaaatgttggcatttcaatgtatttgaattttggagcatttgggtattctttaaaaaagttaaaataagctattaatttacttcctttttgcattgcctcttctaaattatcatcgtttaagttttgatcaaaataaacagtttgttcgttttctaaatgaacttccagtctttctattgtatgtgatttaccttgtaattcatatttaaataaacggtagcaagcttcaacaggactcaaatatcgtgcttcaagatactgccctatttcatcatattttaaaagagttttttcaccattttcttcttcttttacacattcaaccgttgctgcgtcataccctttgtaaatatatttgtaaatatatttaa

SEQ ID NO: 42281 - DNA, 1658 bp, Heterodera glycines
  misc_feature (1635)..(1635): n is a, c, g, or t
ctttctgtgctttttcattatgttcgcctcgtgttggtactacgctttgattgcatgctttttgacgatgtccatttacaaatacgtggaatggaaggggtgggaaaagcagcggaattgcgccgcaattaaatcaaatatatatttaaatgataattaggacgaaaagcaattaaaacgctaatgaacgactaattgagcaaaggattttaccatacttatttaaatataaaagtaattaagataattttcaggaaaattcaaaattgtggtaaataagagattttgttttatttatttattaattttttggattctgttattggattataatgccaattaaattaattagttttattaatttggccaaatcagtccaaataattaagtttaattggttgtcatttcagcgcaaaacaagaatggggagatggcctccgtgggttggcgctaaccacggcacagtactctctgatgaaggtggaggacaaggacatgcacccgaaaaattggaggcaaaaaaaaatttttttttttgaaattttggggaatttctttttctttgccaggccacaattgctgattttggtggacggaaagtactccaaagaaatgattgacttgcgctcgctgaacttgctgaatttggccggccaactgaaggcgggcaaagggctggccattacgggtccgattttcttgacttgtttttttaattctaagtttttaaatttaacaatttcttatgaattttcaatgcttctccggtttcgcttaccgaaaccgccgaaggtcaacttttaaagtctaaaattaaggaggtgtaaattgatttaaatttttagtgttttatatttcatttgattctatttaccaaaaaaaaagtaataataatttcttaaaattcaaacattctttttctttaaaatgaatttaattgaataaaaaattctttacatttatggtattttggcaccaattctttttcccattttataaaagtaaattttgaaatgccaaattccatcagaaatattttgtttgtctttatgtgctttatttataaatccaatgaattctttctttttctaatattttctcatggccaattccctgaaaaatcgtgtcaatattcccttagtcttacaaaaatttattttttcattttttaaaattaaatttaaaaaaatttaattgccttccctctgattttccagtggcatttgtccgctgctccagcacgcggagcaatgtgcaagaaaaccggaagaaggcggacgaaattaaggacagagtgcagcaggacatgggccaggcccgcctccgcggtttcggcaaagcgttgctgtacacggaaagccaggcacagtgccaaactcaattaattatttagttgacaccgaaaaagccaaatggcggtgataaatatggcatttggcgtatattttttcgatgttttgggtttttgtttaaatttacttttttgatcagtaatactagaagaattttgaaaacggttttgtcagtttgttcggccataacttttttcttaattggccaaagtaaacattattggtggtatcaaacgaagcttaaagtctcggggattttgtgtgtaactaaattctgagctanatcactcataaaaatttattctt

SEQ ID NO: 42282 - DNA, 1558 bp, Heterodera glycines
  misc_feature (1372)..(1372): n is a, c, g, or t
  misc_feature (1535)..(1535): n is a, c, g, or t
atccgagtgatattccatattaaatattacctgtttctgtgcttttaggagagtccatggcacttgtgccacccttttggccattggctcatccgttgactttgtctttttgctttcattttctgtcccttttgccatttcgttggttggtcgcaacatgatcagcaatttcgactgctttttcctccaattcgtgcccaactttggcctcttttcctccgtttcgatcgttttcttcgttggcatcgatcgactgatttccgtccttttcccattatggtaaaagttattagtcgcaattagtcgagacactaattcctataatttaatcatttgccaagttcagtaaagtccattttggtttccgctagtcaaaaattgtaaaatgctctgccgttacttaggtactgtcttcttgagcggcactttttcatttacattttcccaatgcttacggtaacctttggctacagtatctatgtgctgattgaagcggcacaattggtactctttgtgtacccagattggtaaaaatgtttttattgaaaacatttttagtttctttttcggatttatgcttttagggctgttctatgcaccaacggcgacatgttcagctttggcatgtccgcaatggtgctgagaaatggcctggtgatcaacggtgtctctttcttttgctatttatttgtcgggttggcaatttttcgctgtcggaagcaaagttggacggacaaatgaatataaaatagttaatgtttcacaatgtcaaaatggttcaccttctgttttagatccgaatgccatggtcatacatcgaattttcaagtccctcgctgccattatggctttgttggttggcacttacttttccatttgcttcatccttttgttgtttcgctctgtcaaagacccatttttcaattttcacattttgtcttccatcagcgcactgctcacagtcacagcggccagctccaacggactcattctgtttatatttaggtaaaaaacgaaaacaaatattgccaaattaaataatggtaattattttttaaatatatttttaaaataattcaatttatttggataaattagcagcgaatatcagctggcgttccacaaacatctcaaaggatggcccctgattggcctgtgcttaagccgaatgggacaacaagtacccgtaaatgttattgtggtcaccaatttcaacattgctgctaatcaaccgcgcactgttagccgccaatgtgggcaaatgacgacaaaacagaaacttttggacggagccaaaaagccgaaaattatcagtagcaaatcaaccatactctgctctacatgaccaaagcaatttttttaatgtgattgngcagcggatattgttcatcagttagaattcgagagaataatcacgaaaataaaaaatatattaaaaacattttaacacacttagaatataatacaataaagcattctctttttatcatctctcaaaaagttcgttcagcttttgtctcgaccgaagatcactnctggatttacaattttaactgat

SEQ ID NO: 42283 - DNA, 1660 bp, Heterodera glycines
  misc_feature (802)..(802): n is a, c, g, or t
gctgccggatatgttggtgatggtggtggtcgtggcgcttttcatcgtcttcaccaaaactacttcatcgtcgtccgtccgtccttccgccgtcaaagtcgtgccctcctcctctcctccttcctgctgccgctgctttggccattggacaaagtgggccaatcaaattattatgagtttgtgcttgttataagctaaagagggtgtgccatcatgccctgcagccgacgacggcacacggggcaaggagaaagcaaaaatggcacacaaaaaaaagaaataatcaccaaagccaagcaagggatggcacccagtccctcacttaccggcacggcatggcattagcaccccgagggcacacacacataacaaagcgtgcccatcccgtacagcagcggtccaacagagccccgtcgggccactttattccccccacccatttccattatcattgttgctcctttctcaccccttccccccaatgtgtgtgcattcttcatttttcacagactgtgccgaggttacgccattagtgagtcatgccatgttaaataacatgccccatgatgcctcatcccgggctttaattgtcaagatttcatactgtgctttttaataccatacacttgatagctttactgacaagcgaagacactcatggtctcggctcgagactctcgaggctaagatttgtgctctgtatagcaaatttaggtgaattgtgatataccacatcatatcaattcatggaccactttgccccctctttgttgagtacataatggagggaatgaatgatgtnggtggtggtggcggaagtggtggtggggaaaaagagaagagtttcacctctccatctccccctcccccgtggcactttcccccgtgccgacgaagacgacccatccaactacttagtggtgtcctctccaattgaaccctcctcgctcgacccacgggcggacccctcggccccgaagggcaccaaccccccaccattttgctacagctcctcctcatcttccactttttcttcccatcctcaatccctcccccccccccaatggaatggtccatccattcattgccccccgggcctcatcacttctcattctcccaccaattccagcccccctccccacccaacctcaaccacattaagcacatttattgactaaccacttaaggaggagggggaggagaagcccggggagaaacggtctcgccgcccccggtgcccttctttgtcatcaacgaaaagcgtctcatttatttcaggattaagggccccccaaccaacaccacacacatcaaagcaatttggaagaaattttctaattttacatcgcatttgcccccgctttcaaaaacaagtgttgctgtttgttttggacagtgtgttcggcggtgttattttatcttttctgggtgtaatttgatcagggcttttaaattgggggatgacacgggcaatcatcatcaacatcaataataataactacaacgacaaatgatcaacaacagcatcattagtggacaacggagcagcagcagccgcaattactcatattttttcactgttttaatactgatgatgatgatgatgatcattttgagcagcaatagcggcatcaaatgtgagcggaaggagacaattttg

SEQ ID NO: 42284 - DNA, 1411 bp, Heterodera glycines
atatctaataaatttataatataattctcatatattcttttgttgtcttggattgtttgtgtagaaatttcttataacattataaaatagttctacaaagttttttttcgactcacatgggattaaagtcgctattagaataatgattaaaagatttcctagagctatttattacattatttactttcaaatagttttattattaaaattaatattatattaatcttttaagtgcctttgaataataagaatcatttattttttaattctattattttttaaattagtaattatatttatatttgtttaatcatatagtttttatttccgaatagatacgcatactatggtaagtgaaaacaacacataatgcttatactaatacattcatgttttaaatattaaattaaaatatattcggtttcttcaatttattatctattcttttggtgccaggtattgcaattattttcttcacgttcgaatgagattttcattctcttacctaatttttttatattaatattttgataaatttaaatttaaaaatttaattcttcaattctacagcacggttaatctttttatattgttatattaattttctaactatacaaaaagtattttaaatttttgtattaaatatttctaatttgaacattgaactattttccatcatgtttcattaacattttcgaatttaagacattattctctatttctttacggtcggactgaaaataagattctcttatcaaaaatgtatattattaaaatatttaattcttcaatttatatcataaccaattatctttcaaatgatagcgtagattccgcttttatattgatgcaacaacgcttgaatttttttacttttttagaatttagtgaattcatatttattctagatgtttttttactaaatgtattattttttttgcattatgctatgataatgcttcaggcttttttgaccttgaatcaaaataaaacaataaatattcgtaaaattattataaacttggcattagaatcttgattgaatcgaaggcaaaatttggatgcagcaattagacaatttttttatttaagtgtaatttaaaatacaaaaattaatttaatttttctttctatttttaatctattttacaaataatttggattggctcaattacagaggcttgaagctttttgatagtataaacgaattttttttattttttgcacgaaaaatgttctttcaattttttttcaatagattttcacaacaagtaagattgtttaatcattagtatattttgttatgttatttttaatatgtaaaattttaaacatgaaactatttgcacttttgtgaattgcaataattgattttattctgtagtattttttagacagttaatattattac

SEQ ID NO: 42285 - DNA, 1002 bp, Heterodera glycines
agtgtttgtttttttttttataaaaaatttttcctctcctctccccccctctgaggggcacaccagcgggggcactctcacacgattcagctgttcatgggctctctaaacctatttttattttttttttctatctcttctctgaatggagttataacaatttttcacaacagttttgcatttaacagacacattctaaaaattctaattagtatggtagtccaagcctattatttttttttttgacttgtctctgaatggggttatcccagttttagtatcctttttgaaaaacatcaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggtacttgcatccgattcagctgttcatgggctctctaaacctatttttattttttttttctatctcttctctgaatggagttataacaatttttcacaacagttttgcatttaacagacacattctaaaaattctaattagtatgttagtccaagcctattattattttttttgacttgtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacagcaacggcggcacttgcatccgatgcagctgttcacgggctctctaaacctatttttattttttttctatctcttctctgaatggaagtataaacattttttcacaacagttttgcatttaacagacacattctaaaattctaattaatatggtagtccaagcctattattatttttttt

SEQ ID NO: 42286 - DNA, 1421 bp, Heterodera glycines
gacttttcgacagaaatattttaaatttaaggaggggacttttcgacagtggacttttcgacagcaaaggacttttcgacagaaatattttaaatttaaggaggggacttttcgacagtggacttttcgacagcaaaggacttttcgacagaaatattttaaatttaaggaggggacttttcgacagtggacttttcgacagcaaaggacttttcgacagaaatattttaaatttaaggaggggacttttcgacagtggacttttcgacagcaaaggacttttcgacagaaatattttaaatttaaggaggggacttttcgacagtagatttttcgacagtaaaatgtaattaagtttcaaatttaggggtgtaaaatcttaaaattttatccaaaagcaacaaattaagtcaaataattattgaaatacataatttttaaattcaaaaattcttttcaagaatgtaaacaaataaatggagatgatttttttaaaatattccatttcttaagatgtattttttgaaatttttgatcgacttttagggggtgtatttttcgtttttattacctttttattcataagttttttgcaaaaatttattaatttaaagttctaaaaaataaaaatctagaaaatagatgctaagaaatcgaaaaattgcttaacaacaaccaaaaaaaaacattttttcgtgcgtttcaggtcaatgagagtcaggaaaaaattaggttaaaacctaaaaatattagccctagtaataatgatttagcaatacatattatagtatgttaatttaaaagaaatttagtaaaactaacaagcaatataatttattttaataaaaattatttgtttttatgtttactgtcgaaaagtccactattttttatttttctgtcgaaaaatccttcactgtcgaaatgtcctttgctgtcgaaaagtccttctgtcgaaaagtccgggagccatttactttcagtcgcttttctcattcatcgcttttctcattcattcgttctgtgcttttcccttaacagagcacacaaagatttgtcggatcctttgattgaacgctcggaatgtttgagcccggaaatgttcgccaaccaaagccaatttcagcgccaatgcgcaacccacgaaacattttgcatggtcagtggaaacggaaaaacacgaaaatctacaaaaattgaatcatttgacggacttcagaggacaccgattctaaatcaattctaattttaattgctgatcaattaccataccatttaattggcaattcccctcaaagacctccgtctcctctatgaacggcttttttgtggagatgcgtcgcgactgtgccgaacggtgtcggcccgggtgccaagagagcggatacggacttttcagcagacaatgtctccgattaatg

SEQ ID NO: 42287 - DNA, 989 bp, Heterodera glycines
atttaaaaaaataactctaattactccacagtgtttaaccctttagaaatgtggttaattatcattcataacattatcacgtcgttgcttaaatcccctcaacatttcaattcttctccattaagcccctgggctcatctttaattttttgcttaaaattacgataaattttttatattccactgttttcaatactagcaaacttttccatatcacttaaaaggctgatattcctagtttttgttaacaaataatcttttttatatctagagcgttgaataaataggatgaaaatgttttaatcaaatattttacttttttctgcaccttgttttggagcagttacattaagtctatgttatagccagcatcctcaaacaaatttgatatcttcaaattttttattccttttgccggtatattaaatagtcaaaatttagaaagacatttaaaaaaataactctaattactccacagtgtttaatcgcatgcaatgtggttaattatcattcataacattaacacgttgttgcttaaaccccctcaacatttcaatttttcttaattatgcccctgggctcatctttaattttttgcataaaattacaataaattttttatattccactgttttcaatactagcaaacttttccatatcacttaaaaggctgatattcctagtttttgttaacaaataatcttttttatatctagagcgttgaataaataggatgaaaatgttttaatcaaatattttacttttttctgcaccttgttttggagcagttacattaagtttatgttatagccagcatcctcaaacaaatttgatatcttcaaattttttattccttttgccggtatattaaatagtcaaaatttagaaagacatttaaaaaaataactctaattactccacagtgtttaatcatatgtaatgtggttaattatcattcataacattaacacgttgttgcttaaaccccct

SEQ ID NO: 42288 - DNA, 775 bp, Heterodera glycines
  misc_feature (50)..(50): n is a, c, g, or t
  misc_feature (55)..(55): n is a, c, g, or t
  misc_feature (63)..(63): n is a, c, g, or t
  misc_feature (108)..(108): n is a, c, g, or t
acttctgagcgcaccttaaattgacggacggacgacggcgtttaaggggnattgntaaggggngggagaaaaagcatccttagggggggggggggggggaaaaaaganaatgtcttattttgagaaagggtatacgttacaaaagtgttttttcttaaaagggagggaggagagaaaaggagatgaaaattggtttagaaattttagatttattttatataaaagaaaaatgattatgtgttattttgagaaattttatatgatataaaagaggtagagagtgagagggagggtggtgagtaattgttatttaatttttcagagaatttttaaatttattttatattgaagaaaaaagagtatatgttattttgagaaattttataagttagaaaagatgttgagggtgatagggaggggggtgtgtaattgtaatttaatttttcagagaatttttaaatttattttatatctaagaaaaatgagtatatattattttgagaaattttataatttataaaagtgttagagagtgataggaaggggggtggggaatagaaatttaattttttagagaatttttatatttattttatatttaagaaaaatgattatgtcttattttgagaaattttatatgttagaaaagatttagagaatgataggagggggggggtgtaatcggaatttaatttatcagagaatttttttattttattttatattctaagaaaaatgattatttcttattttgagaaattttatatgttataaa

SEQ ID NO: 42289 - DNA, 1605 bp, Heterodera glycines
  misc_feature (1580)..(1580): n is a, c, g, or t
gaagttgatcttgataaataaatctttaaagcacattcctattaaatttttagatacgaaaaaccattttaaactggaattcttataaaattaccctaaatattaaaaattttttaaattagtatgaaaaaaggtatgcttattaaattcccaaaaatcttaagcatgaattcttggtccagaactttttgaaactcaatgaaaatttctgaaattttaaggtaaataaagaattcttagtgctaacaaatataatttaattttggctcaattgcattttaaacactttcaaatattaaatgttcataattaataattacattgtatatgaatgcccatgcaaaaaacataacatattcgatgctttataatttttatacataagagaaaaattttggaaaattatattctgaaagagattaattaaagcttttgaatgataccacgaaatatttaatttcaaacaaaatccctcacatttttgtacttagtaaataaaagtgaccaaaagcaatgaaaaattaatacaattgacaaacaagcgaatattcctggcaaaacaatggaagacaagaccaaattggtgacaaaaatgagcatctcatttttcacataaccaaataaaacccagttaaaatcgcctaattaggcacaaaaaattcccgaaatagccatgaaatacatcaaatttaaaaaagttggccacgtattaattgggtttttacttcgtcgttacatttcaaaaataataaaaataaaataataatcataataataatagacttaattttttatatttgtttttctaatttttttttttagcaaaacagttaataatttagatgatagggctttcctttatggcaacaattttctacgtcataaatggtctattaatagtagtttctgagagttttgggtcactcagattatggatatgaatacatattggccattttcattattctgaattttttaattcatttttttgggttctttccttaatatttatacaatattcaaaattattttagtacgttaattccctaaaataagctagccaaatgatggagattttacaaaacagaaacacgatccagcacattcgaccctttaatccctttgtaaaagtaaggaggttcttttgtaaggaacatttcgaaaaattcatgaaacttcagaagaatgattctcatacgaatattacaaatttatgttttacggatgtcactaatattcattttatatatatcctattttattaattgccaaatttgtagccatgatattattttcttgttgaaaatcaaatttatttttaaacgttagcaaattgtcttcgccttagctaatggctccccgcagcttacaaatgatgttgctggtcaaaaaccaaatcacactgctgctgtacatcaataaagaaacaattttaaccaatttatcaatgttttagcccaaattttttaattgaataaaacaatgtttccctaaaaaatttttcattatgccgaaaaatttcaaaatttcatttatagatagaacttacgtctgaatatatgtaataatcacattgattnttaggggggtggtaaattggactac

SEQ ID NO: 42290 - DNA, 1038 bp, Heterodera glycines
tagtcatttttcttggatataagataatttaaaaaattctctgagaaattaaatggcgattgcgcaccgcccttcctatcaagctcgagcgcatttgtaacgtataaaatttctcaaaataagagatagtcaatttcttggatataagataaatttaaaaattctctgagaaattaaatggcgattgcgcaccgccctccctctcacgctcgagcgcttttgtaacgtataaaatttctaaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgagaaattgaatggcgattgcgcgccgcaccttcctctcacgctcgagcgctttgtaacgtataaaattctcaaaatagagatagtcatttttctggatatagataaatttaaaa

SEQ ID NO: 42291 - DNA, 1271 bp, Heterodera glycines
atgacacttattgttagaaacttatgggaattttagccccatctaggaattttttgtccgtttttttacattcttttcacctttaaaatcctttgatgctttctttaaatattttttgcgtgagctttgttctcctccttcaccttgcatttgcctttgtccatggccatgcccacagtgacgagccaccgcatttaaaatacacacgcgaagtcaacgaagcggtggtaaatccaataaatgtataattcattatgtagcaaagtttgtctcttaacttattatttcagacaaaaagcgaagatgcaattgatcaccaccagcacggccatttgcatgacgacggacatggccatcaccacgactgtggagggcaccagcacagccatggggaacggcacgagacggacggaaagagagcggcgagcactctccccaaaatcggaagggcaacagacagtgacaaaccgtacgacaaagacaggttcaaatgatgagtaatagccaagacaagctcatcacatcatatcattccatctctttcagctatttggcctttctgaatgaccccaaaattcgcctttggacgtacgccgttggctccaccgttttgatcagtgccgtcccctgctttttgcttcttttgattccgatcaaagtctgtcccttcgtccgtttgcggttattcctcctttaggaaaacactgccgaggattcgcctttgttgcgcactttgctcgctttcggtgccggtggacttcttggcgatgcgtttctccatttgattccccacgccacgccttccggccattcccattcgcactcgcacaatgctggcgaaggccatgcgcacggaccgcacgacctttcagtggggtcgtgggtactcgtcggttggttctttctcgtgctttgacttggtcagattataaacattagtttggagttggcttttacataggaaaactgcaatacattgataaaatttgttgaggatcaaacaacaatctttttgacccaatcgtttttttacccaattcatttcttatttgaaacccaaaaataggtcgagtcgtgtttcagtccaaaaaacgatttgaaatacgtttcagttattgttttaccagttattccttccattttcatacaggttttatgacattttttatcgtggaaaaatctgtccgaattattcgcggaaatgacccaccgggccacggacattcgcacggagatgagaaaaggaagaaaaagcaggcaaagttttctga

SEQ ID NO: 42292 - DNA, 842 bp, Heterodera glycines
aagccaatatcaaatcgacacacaaaaccatgaatgaacgaatgtatgatgaataatattaagtaaaaattcaattcagtaaataataaagcatgagaaaggtcagagaattgctggacggtcaaacagaaagagggggaggagagaacgggggggggggggttaattatctcataattcagtgctgtacgatttttatttaaatattttttttataaataattttaaaaaaaactttttagattttttaaaaaatgttgtgcaaatgcggcgaatgcttcgaatgcgaagatgaaaagcgccgcctcaagcgcaatcgggagctcaatacccgcaaagagcaaattaagaactgcacaggcaatcatctagcaccggctatgatggaactcaaacgccggaatatggaactgtttaaaaaggcttataggccggtgaagggcgtcatcaataaaataaccgggggtgagtttaaaaaagaaattgaaaaaaaaaaaaattttttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaatttttttttccagttaaaaaataattttagaatcagaaagaaattttggctcactatgtaggccaaaatgatctactccagaatgaagtggactattatcagaatcttggtaataatcctccattgaatgtgtccccaatgggggaggatgctataatgttgaccagggacgatggtatgccgattggtgcag

SEQ ID NO: 42293 - DNA, 1739 bp, Heterodera glycines
  misc_feature (21)..(21): n is a, c, g, or t
  misc_feature (1564)..(1564): n is a, c, g, or t
  misc_feature (1681)..(1681): n is a, c, g, or t
aattcatttattataaatttntggaaaaacattaatttatctatatataagaaataaataaaaactaaaaagcattaaaaaagcttttaataaaggcacgtttcttactaagttagaatttagaaaaaaatatattaaaaacaaaatttcatcaatatcgtaatactttttggttaatatataataattattatcaaataaataaaatatttctaagtttcttaattttagcttttccaaaatttcgacacacaaagaagcaaattttgttaaaaatgagtgagtgtactgtggtgacttttcttatgtaagttttgggtacttttaaaagtgccaacttttatctgggcggaaaaccgggtttaacgggttttaacagcgtttatttaagcgcacttttggcaatcatttgttatgccaatttttgtgccgctgtgtcaaagcaatggacattgttggatcttgacgatatggagggcatgagaaaagacacgcagcatggtaaatgaaaaaatactcttgagaattttgttattttccactattttgccacaaataatttctctatagtgccctcaaaaaaaataaataaattcgatacaacaatctggtcttgatttgtttcttgaatacacagatccagatccacacatagtttctgggcaccgtacactcagctaaaaattttaaaaaattttaaatttaaatttttaatttgttcccaacaaaaatgcattctaacttagctctgaagcaaggaaattttaactcgataattctagacttagaaaattttttgctagctatattttttatgcgctaatagcagttatgaatatttcctctcttaaagggaagtggagaaacaaacgtgacggcacagcggtcaaagaatataatgccaaaaacatcaactataccgaattttatgctcgcgttgtcgccaataaatgcctactgaccgtgaacaaaacccaagaagaagtggagagggcggaggaggaggaggaagagaacgtggcaaatggaaaagttggcattttgtcactgacaaatgagaaaaaataaattaatggaaatttcatagaaatttgctaaatctttaatcaggaggatggtaaagaaatcggccccatatcaaggaggcggaatggggaggcacgtacccccccccccccggccgccccgaaatgaaaaactttaagaaaaaattgcaatttttttgaaaatttacacgatttaatcaaaagtttgaaagaaaattttcccgttgatgccgatcgctactgccggaccccattctatcattgtttattaagaatttgacctaaacaacacaaaatatttcattctttggagcaaaactgctacaaattccttcttttttggccccggcgcgctaatagaaaaaatttttggcccgaagagcaaagagctcatcgggtgcccccacagataattttttatggatacgggccagaaagaaatacatagtatatttttgaattaaatatttgaatttatataataaagtgagcaatttttcaaattttccatttcctanaattatatatatacagattcacgtattcgaagtcaaatcacaagaaaacgagaagcagcaagaaagggcaagacctgacactttaatcgcgtttcacagaattgtcattacgccagnaaagtgccggcacaaccaatttgagtaaattaattaattccatttttaaatatatttt

SEQ ID NO: 42294 - DNA, 1384 bp, Heterodera glycines
accgagaacgcacaactgagagcccgagctggaccgaaccgtttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaagaaggacagcaaaccccagtctggaggctagcagcccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcacagttcactcgccgttactacgggaatcctcgttagtttctttccctccgcttactgatatgcttaagttcagggggtgttcacgtctgagtttcaggtcgaaaaatcaaagcaggaatgccagtaatccaggcactccgccacagcatgcaaagcattggtgcgcccgagttacggtccgtaaaacgcgaattagaaccacaagttcgcgccagcacaccaaaaccccacagccgagctaagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaaaataatgaaaaaaaagaaaaagctggcggtgcccgagctgacactcattgagtcttaagccacgtgctaggccaagcacgggccctaccacgtcgtctcatcacggccacggacgtagcagcaagcacaaacacaccgctagttacggcacgtaagaccgggaacgaaaccaccatccccaggcagtgtgttatgtgcctgccacaacaaccgctcaacg

SEQ ID NO: 42295 - DNA, 632 bp, Heterodera glycines
gggcgcatcggttcgggggatctcccccgaaatcaaaaaaatcgattttttcaagtgtccgtttggggtactcaaacaattatggggagcaaaaatccaccgcagaattaaagtccaggctatagggaagctactcccgaaggattcggtctccccataaatctgggcgcatcggttcggggggcctgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcgtcggttcggggggactgccccgaaaacaaaaaaatcgattttttcaagtgtctgtttggggtactcaaacaattatggggagcaaaaatccaacgcagaattaaagtacaggctatagggaagctattcccgaaggatttgtgctccccataaatctgggcgcatcgggtctctgcaactgcccctaaatataaaaaaatcgatgtttttcttcatgccatcctcgaggtactcagatccttctataaaactaaaattcattcttcaattaaagtacaggatataataaagatactc

SEQ ID NO: 42296 - DNA, 1015 bp, Heterodera glycines
  misc_feature (957)..(957): n is a, c, g, or t
attcagacattgcttgtcacgggcactttgctttagatgtggagaaaagcatcacgttttggtatgctcgagtccggaaaagacgcccgccaaggggagcaatttggctccgttaggcacccgtgcaccaggcggaaggacatcccagtgggaaaatgcgcccgctacttcttcggcagccccccctcagggcaacagaaatggcactcagattgcctcggccattgctgagggcgaattttttacccctattaatgagttttgcgccgaggagaaaacccgaccaaaggcctatctcatgattaaggaaattcctgtttttaatcacaatgggccctctcccgtgccgacgcccgtcttttttgaccccggctcccagcccggcttcgtttcctctgcactcgtttcgcagattgacccccctttgatcacacaggaaaccatggccgtagggggttttttggggagtggcccatcccaaccaatgaaattttcgtcccctcgtttttcgatccgcctgcggcggagggacggcggttgggaaacggtggaattaaatcaaactccccacatcatcccgccagttgagtttttgagggaaatacattggaaccccgccgaaaagctgaaaatgggagtagcggttaaagaaccgcaaattttgctcgggattagggaattttggaaattttttgtggccagaacggaaattttccccgggctgttccgaattgatacagtttttggccccgtatttggaggggagatggaccatttttgttcgcccgtggtttcgcattcgattccaatggcctgtggggcaattctgaggcaagaagaccctaaaggaggtggtccagcgcctatggaatttggaatcaattgggattagtgacccgttggatccgaatgacgacgaattggctatctcccttttttaagattccgtccgatttngaggggaaagatacgaaagttgggtgggcatggcgtccagggggaaagagacgattgc

SEQ ID NO: 42297 - DNA, 526 bp, Heterodera glycines
aagctaatagaggacacttacaaaggagaggtgcccaagtgacggtgggatttccgaatgaaaattacagggtaggtagattacccccccccccccacccctttggatcataaaactcatagtaatcaagactcccgcaattcctgtaacatatttcaaaatgttgccctcaagaccgagctcacgcatttactacgagcgtctcagcgaagtccgactggatgtgccccattggccagtgaacacaaacaaggacagtcaaaccccagtctggaggctagcagcccaacgtatagcaacgagacggcagaatgcaaaccatatacgccagctctgtccgtttccacctcatcggttacacgtcctccttaactctctcttcaaagtgctttgcaactttccctcacggtatttgttcgatatcggactcgtgctagtattcagccttagatgaagtttacccacctgatttggtgctgccatcccaaacaacccgactcctatacacgaaaagatgggtacgcac

SEQ ID NO: 42298 - DNA, 1018 bp, Heterodera glycines
attttttaggtcaactttttgccgtgtcactacaccttttataaagataatctcaaacattaatttttataatcacaatttagtgcccttcccattcacttttcaattacttttttttttaaataaatttctcctaaaaaatcagcaaaaacagcagctgaagaacacttgtgtcggtcattcaatcactttcgtttccatttattactgttgttaattcgcatttccttttttcaaattgattttttattcaaataaaatgtcaatttcgaccggtccaacaaatggcacagccgaagcagaccagggtattgtataatttaaaacagtttctcaattagatatttttaagattttctatttctaagccatgaaaatttaaaacataaaaaacgatagcgctttaataatttaaaaagattcatttttaaaggccattaagttttagatctatctaaaaacctgaagttttcgtttcaccagcctcataaaaaggcttaaatctgagatttttttcttaaaatgaggaaaaattaattaaaatataatttataattttgaaatttaatatttattttcagcactcttcccaaatttgagtccgtccgaagaattgcgcctgttgagagcacgaattcagcaattggagaaaatggagcaacagcagcagcagaacatggaaatggaatcgtcgtcaaatggcaattccaatgaatttgtgcagagtgggaacggtaaaaaaatgagatacggtagaaaattaaaaaataaattgaataaattattttcgatgatcaacccaacgcaatttgggaacgaattggccaattagagacacagcaacagcagcaaaagggccattttgaaaggatgatgagcatcgtccgcgaagaacaaagtgccaaatttgtcaccatggaaaaatttcttggtgccttgggggagcaaatcattaattaattagcataattaattcctgggggggttttttcgcgtagttgatcagcttttgcatcaa

SEQ ID NO: 42299 - DNA, 1023 bp, Heterodera glycines
tcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgagcgctaaaataatcagagtgccgaaaatcgcatgtgatctaagcctagaaaaaatggtctaagtaaaaatcgtaattacgctcaaaagcttctcaaacaattttagcgcttccaactccttctaccattgcctttatacatcccattatgagcgctaaaatatcagagtgcgaaaatcgcatgtgatct

SEQ ID NO: 42300 - DNA, 391 bp, Heterodera glycines
ttaaaaaaaacaacataattttcgttgaaacttttctaaatcgtttaaataatcgacaaaatttttacagttgaaatgtgtcggcggagtgccaacactttttgctgtttttgcagcaaaaaactggacggaaattgagcagaattttgatgaattgaagaaactgagctgcaaataacggaaatgccaaacaaacaaacaaaaaatggctgataaaccttcttaaaaaatgtaccttatcttgattcttttgaatctcaaaatttttaaaatgttccattaattaaaatcacgaaaattgttgaaaactattttttaaacaaaaaccaaaataaacataaaaatgcatgataaatttttctttaaaatgattattattagagtagagcgg

SEQ ID NO: 42301 - DNA, 1178 bp, Heterodera glycines
aggtacaaaaatgattagaagaggtacaaaagtgataaaagaggtacaacagtgattagaagaggtacaccagtgattagaagaggtacaaaagtgatcagaagaggtacaaaagtgatcagaagaggtacaacagtgattagaagaggtacaaaagttagtaaaataggtacaacagtgattaaaatttgaacaaaagtgattagaagaggtacaatcatggattaaaatgaaataaataagaaaattgtattattggatgtattataaatttatcaaattaaaaaatccttttacttattaaaaataaagttagaaatttataatatagaatatttattgaaattgaaaggaactaatttctcgaattttataaaaatttaattcaaataaaaaaatgtaatttattattaataaaataaaaaatattttaaatgaataaaacaatgaaaacacgaaaaaaatggtagttattaattaaaaaaacaacgttggaaattattaattgaatatttatttaatttgaaattaaattattttttttacaaattcaaaaaaaataatgaaattctttaagttaaaaaaaataaatttaaataatttaaaagaaatcttcaaattaattaaaaacagtcaaaataacccaaaaatgcactgaaaaataatgttacaccgtccggattcgaactttgcacccccccccccaaaaatgatgcctcagaatccccaatcacacagggattctgaggtcttgactatgtgaaaagttaaatctgatcacgtaccaaataaaatccataaaattctcctgatttttctctatttttaaggctttattcctgtaaaattgatcaacccttcgatttgttatgaattttcaaatattaggccaaaatcctgagggccaaaaaattgccaaatattttcgaatttttaaaaaattccaaaaattctgaaacttaaaataaacatcatattcgtactcagcaccttaaaaatacccagaaaaaaatttttcaccctctttttcaacccaaaaaaaatttccgaaaatttctagggggcctagctcgaaaaattttgaaaatttccggccatataatacactattcgatagcattttaaaagctctacaattttgctctaaggcatttttggctaaaaacgatccctgacga

SEQ ID NO: 42302 - DNA, 903 bp, Heterodera glycines
aattagtagtgatgctcgagagtctcggtctcgagtctcgactcgagaaaagtctcgggtttttttggtctcggtctcgagtctcggtctcgattttcgagactcgagaccgagacttttttacacccctaatgattgttggcctttggtaaacttctatttttataaattttaggttcttttttgttcaaaatttattaatatatgcgtggtccagcgggttgtgttcttgattttgttccttatttttgcgttggatcagttcccctccaagtattattttttcttctcatttttcaaaattaatgtttttttcgatgggagttcaaacacaattttaacaattaaaatcgtaaaaatgtaatttttggactaaatctattaacaaagtgcactaaaaatttcaaaattttctccggcggcgcctaacggcaccgcaggcacccaaaactcttacttttattttaacaaagtagctcaaagtcgcaaaatttggtcatttttgggacaaaatccgttaacaaattgcaataaaattttaaaaaattttcccggcggcgcctatcggcaccgccgggccccctgttaccgaaaattttttttgaaaaagagcaccacaaaaaatggtgtaaaaaagtcaatcatatgaaaaggaaaaatgtatggtagcttaaataaggaaaaaaaacaaaaatttttgagaaaaaaactcaaaagattgattttttcgatttttaagtgtgtaagaaaaaattttgaaaaaagtctcgggtatcgggtttttttggtctcgggtttttgggtctcggtctcgagtctaggggtcgagtctcggtctcggggtcgagttacggtctcgagtctcgggaaatttttggtctcgagcatcaatagcaaatacac

SEQ ID NO: 42303 - DNA, 1240 bp, Heterodera glycines
atcaaaagattaattgctccaattattaataaaaaagggaaacattcaatcgagcaatttaaaattgacaaaaaatcaaacaattttttctgaaatcgctatttatttttattttttatcttttacaacaaatatattttttattcaaaatcatttcataatttttcatttatttttcatttccttcagtttcattcatttttcgtcctttcttttcttttctccactttgttccgtaagttggccattgccaaaatttgacgaaatgccatccgcagcatcaaaaaaagtgccaaaattgccaaaaataccgcactgatggtgaacagaatggcatcgattgaataataagcgacccatcccaattcggcatcggttggcatgttaagctcgttcagatgcggaaattcggctgcgaattccacccaacgcaccaattgctcttttgcaccgaatggcgacaaagcaattttcttttggatgagtttggcattggcacgaaaagaggcgtcgtggagaacctaaacaaaccaattaacattcattttaaaattttaaaaaactaattgtcggagattagcaatttatcagcgaaattcaaaataacattcctaattagctgcaaaaattctgattgtccaaaacaaaatagctttagtaaaataaatcctaaatccaattaattttctatgcttttgaagtgcttttcgtttttcctttctcattcatttgcttgtgtagcgaaaagtgcatcgaatgtatcctccgatggtgcacttttgctcacccgcatgagcgctgttatcagcactttgcgcgttctatatgtgattagatggcgaatgccatcgtgtacggccatccctcggtgctttgcacaacacggcgttgtaatagccgatcaccgtaacagatggaatgcctcacaattggcacttccgatttttgctgcctccgccagtctgtttcgcacgcaatgagtgacaaaatgcgtcgctattttggatgccctcaaaatttgtcagaagtaaagaatgcaataaaagaatggcgcatctaaaatggcattttgcggcacccattagaaagtgtgcacatttggagtggctttgatcagttaggaatcatttggtacggattgggcgtacaatttacaaatgagttcatactgggggagtagaaggaatgggtggagaagcgtacgtggcaaggattggcccaaagtgggggtgttgtctac

SEQ ID NO: 42304 - DNA, 526 bp, Heterodera glycines
  misc_feature (491)..(491): n is a, c, g, or t
tttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaagtttttcgctcgtttaaaaagcaattaaaaatttttagaatttgtattcatcgccctttttgatagtaaaagcatcagagtgcctaaactaacatgtaaataaaatttggtgcgtttcagaaccctttctgaaaaaaatatttatgaattaattatgcaaaaaacaaataaataatgaactctcttccttaatattttcctgcaccgaaggacctcnactcggccgcttcgcggcttcgtggtggagccttc

SEQ ID NO: 42305 - DNA, 997 bp, Heterodera glycines
tctcgacataaaagccgaactgattccggcaggctgcttttgttcttaatttcaatccgaggcctgctgtccttgattcccttcgcttgccaaaactgatcaaactgattcctgccaattctcggcccttgcttaaaaaggcaaaagccacgcacaatgtgaagcaaaattggaagggggggggggaagtgatcaaaaagggaagacggacgaattggatgatgagtgaaaatgagttgagtgagtgagtgagggaaaggacgaggatggggaatgggatgggaagggatttgggagattgaattgatcgtccgcgagggaggcgagtgaatgagtgactcctccgcaaccccgcgcgactttgtgctgctgctgctgctgttgttgctgctgctgaacaacacaacacaacagcggcggcaaggacgccgttaaatgcaacgggcggcgacggaagagaccaaagattgccgccgtccgctgcttttgagggtcggtggctctcagcagattgtaaatcggaacagtagtggaggatcttgtattgaggaggattttaggagaataggcttggcaaagcttatccatgaactgcttgaactccatttatgtcccaggccccggttttatcggtgccctttttcatggaattctgggaaaaagttcaaatccaattttttgagacgaagagaaatctttcatcagagtccgatccaaaatcatattagctttcgagaacataatagcctttctcaaaatgtgcccgaatgaaatgagtgtgccgtaccaaaattcatttaaaaaaatattgaaaattcacgttttcgcgcaatgaaagcagcagaatggcatgatccgaactgatcaggcttctggaccatttttgattatccaaaatggccttatttgccaccagtgagtctcggcattgcctttcgtggccattctcgtctttaattttcgacatacaaatggccattatcaaagcattaaccag

SEQ ID NO: 42306 - DNA, 181 bp, Heterodera glycines
taataatttatgttcaaaaataaatgcattcaaataatttgaaagttcgaaaatgtatctcgtcttaattatactgccaagcaagataaatttggaaagccaataaaattataagtctaaatatattttactaaaaaacaattaaaaactatggtaaaacgaaatatattgtttttaattt

SEQ ID NO: 42307 - DNA, 745 bp, Heterodera glycines
aaaattttgaagaggctttccgggaacggattaccatcgggggttacgagatagtaaaattgtcttaaaaagagatagccattttctgagaattaattcacaatttctgcagctcttagggtaatggaaaaaattttgaagaggctatcaggaacgattagcatcggggttacgagatagaaaattgtaaaaagagataccatttagcatcggggttacgagatagaaaattgtcttaaaaagagatagccatttttctgagaattaattcacaatttccgcagctcttagggtaatggaaaaaattttgaagaggctctcaggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagataaccatttttctgagaattaattcacaatttccgcagctcttagggtaatggaaaaaattttgaagaggctctccggaacagattagcatcggggttacgagatagaaaattgtcttaaaaagagataatcatttttctgagaattaattcacaatttctgaagctcttacggtaatggaaaaaattttgaagaggctctcagaagcggattagcatcggggttacgagatagaaaattgtcct

SEQ ID NO: 42308 - DNA, 1014 bp, Heterodera glycines
  misc_feature (57)..(57): n is a, c, g, or t
tctagagttttttaaggcaccttcattcgtataaactggactggagcttttgtacgnccgattttagaatcgggtgttgaaccattttaaattttattttccattttctttttatattttattttccattttctttttatattttattttccattttctttttattatttattttaaattttattttccattttctatttattgtttatttgaattttattttccattttctatttattgtttatttgaattttattttccaattttctttttattgttattttaaattttatattcacttttctttttattttttatttgaaattgtattttccatttgctctttattgattaattgagtattttatttcccatttttcttttattttattaatctgaaattttatttgccaattttgtttttaatttttatttgaaattctattttctatttgctctttattgtttaattgaatattttattttcatttttctcttgttttattcatttgaaattttattttccaatttttcaattttcttttattgtttacgtgaaatttttgtttaaaggtttggttgataaaactaaaactaaaattcataaaaaataatttttaccatcaaaaattcttatcaaaagaaactttcttaacccaattattgctaaaatgctgaagatccgattgaaatttgatctgtgccggtggagaaaagccgacgatttactgtgtgatttgtctcgatgatcaatgcactagaaaagatatctcgaaaaacgaaaaactagagatgctttgagaaaaaatcatacaaaaatcttttacatgaaaatggaaatttaccgtcgctatattttgttggtcgtacgtgagaaaatgggcgttgtttttcattcgctttccatttagtgatcaatggccaaaacattcactcgcctattcccccccccccggagtgggatactgtaacaaaaagaggagaatggtgaaaagaatgaataaaaaattaaaa

SEQ ID NO: 42309 - DNA, 939 bp, Heterodera glycines
ttttggggaacccccacatgtacaacggtgtagaaaaaaagagatagccattttctgagaatatctattctctgagccagcaatttccaacccgacctttgtagggctcaccggcagatagtaatgcgtttttggggaacccccacatgtacaacggtgtagaaaaaaagagatagccattttttctgagtcatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagaaagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgacattttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccattttttggaaataattaattcttttgaaaaggaaattttcaacccgactttttgaagggttcacccgcaaatagaatggggttttggggaaaacccac

SEQ ID NO: 42310 - DNA, 941 bp, Heterodera glycines
agaacggccatgcaccaccatccaccgaatcatgaaaccctttcaatctgtcaatccttacggttccgggccgggtgagtttccccgtgttgagtcaaattaagccgcaggctccactcctggtggtgcccttccgtcaattccttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccat

SEQ ID NO: 42311 - DNA, 1125 bp, Heterodera glycines
  misc_feature (302)..(302): n is a, c, g, or t
tacagtctgaatacggtaaatacaaaaatggcaaactgcagtatttttaagtaaattattacagataaccagcaatcacaatatatagttgagtaatttggtgatacttgtgggtgaagcttttggaaattaattttcattaaattatttggtacaaatatttttttgcatgaattaaaaattttttttttggcatttttcaccatattcaattcaataaataatttttatgatttaaaatagttgaaaaaaccgcgattcgggaagatatgtttaaatttttttaattttcactcaaattntggctttttacattcaattaaatcgggagagccgttcaatttaagaaacatttttatgaccagaattaataaaataaaaataaattctaaattatataaaaaataattaattagtttttaaattcccaattattttatttaaaaaaacaatcattgttctcacctttacatcggtggaagctgaggccaagccggttttcgcacattttgcaattctgcaacattttgccaaaagcgcgctcctccacaaattggtgatcacaactgttgattggccgtccacgagcccatccagggccgaagccgggcaatcttacaaaaaaaaaaaaacaaataaataaaaatatacataaataatatttttataaaaaaataatttttattgtccatacttttgacgactattcgattgtggtgttcgagaacagaagcgacggcgctgggctgctggcgttgtgaactatttaaaaataataacgttggacaattggtagaactgatcaaagtcctctgggggtgttaaaattctgatcacttccgatcagcactttgatatggagtgacctgatcccggtggtgcaatttcacttttcttttaaatgagcacaaaaaacttatatgaggatgaattttttcacatttttatcaagtacaaaaaaagaaatatgtcttaaaatttttgggtgattggaaaaattttcgggaataaattattttaaaaaaatttctttatactttgtgattgaaggtatgcctggtaaaaaaaatttagctcgaacctaacgcattcaaaaattgcaaacgaatagggaaaaacttcatt

SEQ ID NO: 42312 - DNA, 859 bp, Heterodera glycines
ttttttttttcccaaataaatttttcaacccccttttttccccccgggaaatgttattttttttgaatttttgacccgtttggagtagattagattagaaaaattgaaaaattttgaattcatttttcccactcctttttcccagggttattattttgtaaattctttttttcaaaataaacttttcaaacccccattttccccaccgtgaatgttatttttatgaaattctgacccggttttgagtagattagactagaaaaaattgaaaattttgaaatcatgttttcccactcccttctcccagggggtattatttttgtaaagtctttttttcccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtcttttttacgagcaataaacgtttcataccccatttttcgccacgcgtgaat

SEQ ID NO: 42313 - DNA, 951 bp, Heterodera glycines
caaattttaaaatcttgataattcgatagccctaagtattatctattattctgcaaaatttaagaaaaaatagttaagtttcaataaagttatgacctgagaagctcagaaaaccaagttttttttcaacgtttttgcccataacttttttgtggcttaacaaatttttttgaaattttttaggctaatagaaaacacttagggctactgaatgacatcaatattttaaaatttggttgtctttgagcaaagttatatcaaaaatctttccatttgatggtttcttgacaaacgcccattttaatggtttttgactaacgtcatagcacccttacatatatattaatggcaatttccgtttatttctttttagtgctaatttcaatttttaatttcagctttgaaattttcgtagatggtcaattttttttttttttttttactgttatatattatttttaatcattaccagtgatttcgatgattcacatattattgtaataaagtaggtactgacatctactaggaattttatattttttatgaaaatttttaatcgttttttagttcgtctatttatcatgcatgggtccagcacagatatatttccttgggaaattggaagcattaacaggaatatttgaaaaaatgttaaattttaaatataaatttaagaatcccatgagtgaataatacaataattttgccttactcattattccaaaattttcattggccaaaataaattgacaaaatttcttaccatgaataaattgtcatgaaaaattttttgcaaaaaaaaattctaggacatgaccaaattgacaactgcaattgaaaaagctgaaggatgcaagtgcaatcttgttgaaaaaattgagaaggaattggatgatgttgagggtattaaatgaaatttattttttatacaaaaattattatataaaatga

SEQ ID NO: 42314 - DNA, 627 bp, Heterodera glycines
tttagctgtttttaagcttctaggatggatttctatatccatccatattttccatatttcgtgatttatatcatatttccatatttgtccacattggcatgattgtccataaatttatccaaaaaagccctattagaacggcccccatcagctaaaatggccattttgaatctaaattccgaaaaatttccaaaaaaaaaaaaatttttagcaaaattttctcgagaattttatttacataagttttaaacatcacaaaaattgggaaaatttgtgccacaaaacaaggaaaatgaggaaaatttcgctttttggtcgattttcacaaattaataaaattttatatttgtcgtttttctttttaaacgctttttttataccgtactcagccattttaaatgtattttgccaaaatttaatgcatttgaaggaattttggaaaatttattcccgtccatattcttgcaattttatgtccatatttcgcgatttttatccattttttttccgagccctaattattatagaagacggtctcctcttgaaaaattttgcgagattcaaaaaaaatgttgtaacacaaatacccacccattgcaatttgcaatggctgcttcccgcgcttcg

SEQ ID NO: 42315 - DNA, 962 bp, Heterodera glycines
  misc_feature (811)..(811): n is a, c, g, or t
  misc_feature (909)..(909): n is a, c, g, or t
tcattttttttgtcttttgaaataaattgtgaaaaatatacgaaaattattttagcttttaattatgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatggaaatatcagatggggtgcgctcttttctaaaaattcctcttttcgtctaaccatccctcccttttgtgcactatttcgtttcaaaattgaatcatttttttggtcttttgaaataaattgtgaaaaatatacgaaaattattttagcttttaattatgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtcttttgaaataaattgtgaaaaatatacgaaaattattttcgcttttaattatgctgtacaatgcttttaagccccgccgtgcggcggctccccttttgtgcactattttagtttttaaaattggttccggactttttggctttttgaaataaattgtgaaaaatatacgaaaattattttagctnttaattattcagtacaatgcttttaagccccgccgtgaggcgggacagttccaaattttgtaccacattttactgtggaaagtccaagtaccttattnggacactacgtgtcaatgagcacagtcgcctttggggcagtgtggaacggaaa

SEQ ID NO: 42316 - DNA, 1286 bp, Heterodera glycines
tagagctcgcattttgtggcatatgcctttttttctgcgcacttgtttcgacatattaagcataataacatattttccacttggtttgaggcttctattacataaatgcctttttttggtattttgccgtttggtgccttttttggcgttttttccgaaaaattccattaaaaatgctataaaatatggaaatatacccctaagaaatgacctgaaaaatttttagaaaatacacccctaagaagtgaaaaaattttcgaaaactgatcgccaaaatttctttttttttcttgataaaatttttaagtttaaaaattttcctctttcgtagaacattataaaaaatttaataatcatttaaatgaacaaaattaagttttatcattaagttttacgtgttatgctccctaaaaatccttaataaaaaaagccttttttcatgcctttttcggggttttcctgtctttacaaatagtactcaaaacttaaccttatcccatccatcatcatatccaatttgacacttataaaaactttgaaaaatgtcaatttcaaccgattcaactaacagtgtagaattttcatctgatgattgtggtgaatcatttattgaccagcaaaagttaaaggttaacaaaaacaattaggaaaaatatacatataattttttattaaaaatttaattcattttttattgagaaaaattttagcaaattggtgaaaagtttgccaaaatggaattggtattgaaaaacaccaaacttgagctcaaaaatgtgagttttacataaagaataattttgacaattaaatctaaattgctaattaatttataaataattaattaaatttagaagggacttcaagaaaagttgaagcagcaggaaacgaaagcactgctggcaaagatcgaagcggagaatggaaaaatgaaaagagaaattgagaaaatgccggaaaaaatggacgagaaggaggagcagtacatggacaagttggaggagttacagaaaaacgtaatttttgcaatttttttatttctgccctttgaaatcgaactttaaccatggaaaggaaatcggtgataaaattcgtttaatttcagcagaaggcactccaagaagagcacgaaaaaaactgatggaacaaattgtgaatttacagacgaaagttgacaaattggaaatggaaaatcaaaagcaaaagagtaagggaaaattcgtgagcaatgattactgtacctaccgtaacaatattattattattgctactgtcaaataccattt

SEQ ID NO: 42317 - DNA, 254 bp, Heterodera glycines
ttaattatgtgaatctatctttgataataagaatttatatcaaaaagtataaattgtttttaaagacttttgtgtatttggtattctgtgcacatttatattgttttttaaaatcattttttagagacagggtctcactctgccactcagactggagagaggtggatcaatcaaagctcactgttacctcaaactcctgtgctcaagcaattccaccacctcagcctcccaagtaggtgttttctttttttttt

SEQ ID NO: 42318 - DNA, 732 bp, Heterodera glycines
ttttaaatatgccaaaaaatgtaggcttaacttttttactgtaaattcgatcactcatattttttgctaattgagcagaagcttaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagacagttcatttaaataatttttatccgaagaaattggttttcgggctctcggggtcaggcccctgacccgatgcgcccggatttatggggagaccgaatccttcaggaatagcttccctatagcctgtactttaatgctgcgatggatttgttgctccccataattgtttgagtaccccagacggacacttgagaaaatcgatttatttttgttttcggggcattccccccgaaccgatgcgtccagacttatggggagaccgaatctttcggg

SEQ ID NO: 42319 - DNA, 227 bp, Heterodera glycines
aatgaaaagtttatcgttataaattgttcagattttttatattcttgatattattcgatagccctacgtgtcctctattagcctgcaaaatttcaaaaaatttcgctaagtttcaaaaaagttataaccaaaaatctgtgaaaacctggttgcttgtgtacttttggccataactttgctcaaacttggccaaattttttgaaactcaggtgagctaatagagaacc

SEQ ID NO: 42320 - DNA, 939 bp, Heterodera glycines
  misc_feature (928)..(929): n is a, c, g, or t
gcagaatcacttggctcatgttgaccggcacacagtcgccgcataactgcttggtccggttggtcagcttcaggccgcacaagcgctgctgctgcttcatcgcctcgtcattctataatattatttgtttatggaataaattttttttttaaatgtttcgaatgacagtcgttttgtgacgttactcaaaaacatcaaattggtattcctcaaaaaaccaccaaatgaaaatgtttgcttataattttacaaaaaagttaccgttttaatccctaatatcattttatagacttaaattttctctattatcctgccaaatttcaaaaaatttcgttaagttgaaaaatttcgaaaaagctggttttttgagttcctctcccattaaaatttttttgaaattttgcaacctaacagagaacatttagagctatcgactgttatcaagaattaaaaatttggttactttgcaagattttttgtcatttttttggcccctccctttatgctggaccatgctcactcatcactctcaccccctaactttaataacctctcaaaaatttccactttagtcttatgaccggtacattaggtcatacatacattgattgattgacctatgtaatttgtatggctcggtcctaattagtgattacggacgatgttatggtcaggctgatcatttggcctattttttgatcaaaaaactgctgatcagctaccaaaacggtgatcttaaaacattttcaggcctcttatccgtctcaatccggtcaggccgatcacttggccaagttttgatcagaaccctgctgatcacgataaaatccacctcaatgatgcttccgtccaccacattctcgtcctcactgttcggcactgcacaaatcgtcggccagcggtccgtcgtcgttggccaccgcttccnngctgcgcagc

SEQ ID NO: 42321 - DNA, 1026 bp, Heterodera glycines
ttccattccttctacaatcgcctttatacataccattctttcgcgctaaaattatcagagtgccgaaaatcgcatgtgatcttagcctagaaaaaatggtctaagtaaaaatcgtaattacgctcaaaaagcttctcaaacaattttagcgcatcaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacataccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatgggctaagtaaaaatcgtaattacgctcaaaaagcttctcaaacaattttagcgcttccaattccttctacatcgcctttatacatcccattatgagcgctaaaattatcagagtggcgaaatcgcatgtgatctaagcctagaaaaaatggtctaagtaaaaatc

SEQ ID NO: 42322 - DNA, 1294 bp, Heterodera glycines
tatatgtgatttaaattatccttttttctgtttaaaaaagttttgttatttattattacatatggtaccaaattatattcatatgcatgttttttttaatacaggggccaatttcggtttttgtactcagaatttaacaaaaaaaatttgattttttatgtagtaaaaataataaaatattttacgatttaaacagaaataaataaatgattttttaattaaattttcaactttaaaaataaaataaattttgaaaaaaattcgttttcgcgtttcgcttttttgttttcttttttgggcgtttcgcttttcgcttttcgcctttcgttctgtatttttagtttcgcacagccttgatatatttttttcctgaacaagcaagggttctgaaacacataaaaaacatgtttttagcttgggtgacattttagtccttctttcggaaattttaatagaaaatttcaaatattacccccaattttgaaaaattgtggtggatatttgtattttatggtgaatgtttttgcgcatgttttacaaatgaatataatttggaaccctatttattaccatattgttttgttttttgacacgacgcggtttttaatttttttaaattattttttagtcaattattattgtctatataattcaatggtttgaacgaagcaagattttggaaacgcttctaattcagggaaaaattccagcaaagagtatgaaaggggtttaacgctccctacaaaagctgattagaagggttcaaagctccctacaaaagctgatgagaatggttcaaagctccctacaaaagcggttgaaaaggttcgaagctcctttcaaaagcggttagataactctctaaacaaagaattgaaacattttgtaataaatttggatgattcagacgaagatatgaatgatttaacagatttattcaatgcacagtcttcaagtcaagatattttaagagaaagacaaaggaaaaatatggaaaattggcgtaaacggaaaaatgagttgcctgaagcagaacttaatgcgtttaaagaaaaggaaagaaaaaatgttgaaaatttccgtaaaagacaaagaaataaagaaactaggctttatttggcagctaacaatccaaacaaagcagttttttatgcgcttagcccatttgagataaagtgtaaagaatgtaaagctgtgcatttcattgaagaaaattcaatcaatagttgccaaaaaaacaagatttttacagttgttgtaaaaatggaaaacttacgtcattaagcgatcattt

SEQ ID NO: 42323 - DNA, 930 bp, Heterodera glycines
tcaaatggaacaaatctctgtaaatggtaaggaaaaaccctttcatttttctttttaaaatttcggggggacgaagtttatagtttttattcgaattcagcttcgctgttgggtgttgtccgaaatgaatgtcattttcgtgatcaacgaccttgaaaagcgcccgaaaaatgccttacaattagacaattttgataccctttttttctttttttttgccgaaaatggtgggcgctccaccgcgttactctatttttctcacacgaaaatccgtaaaaaatatctcacttaaaaatttaaatcgatttcggtcgtccctaaaaagtaggaaagacactcacttttcttcaaacatttttgccaaatcgcgaaagccaagcgctgtccgaaaattgtgccaaatttttcgcacattccattccgattgggtggcaaaattgcatttgaaaatgtcgaaaaagttggggtaacgacgccgaattgccgccacagcgtccgcttcgtcgctttcgtcaagcgccaggcgagtggaaaagcggaaaatcgcgtcgctcagaaagaagaaaaaaccacccgtggtcgactcgacgtcatcctggacttcaatttggacctaaaacaaacacaagtcgtaaattccatttaatggtggggacatttttctaaccaattccaaattaatattttgacgcgcccaagggacaaaaatttcatcgaaaaaacatggtgccatgattttggcatgaatgaccattttttgtcgtttgaccgtcaaaatttcaattttagtgttttttgctaatttctaagaaaaaatccatttttacttaaaaatttggcgctggaggcttgggcggaagaggtaccaacacggaaaaactatttcatcaataaattctattattcttcgtaagctctttacatgctcta

SEQ ID NO: 42324 - DNA, 782 bp, Heterodera glycines
tttttcttaccccctttttttctaggcgtagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttagaccattttttctaggcgtagatcacatgcgattttcggcactctgataattttagcgttcataatgggatgtataaaggcgattttagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggatgcgctaaaattggttgagaagctttttgagcgtagttacgatttttacttacaccatttttttctaggcgtagatcacatgcgattttcggcactctgataattttagcgttcataatgggatgtataaagcgattgtagaaggaattggaagcgctaaaattgtttgaggagctttttgagcgtaattacgatttttacttacaccattttt

SEQ ID NO: 42325 - DNA, 1336 bp, Heterodera glycines
aaaaaaattgcctccaccaatccgtggggaaacctaaaaaaaaaaattttccccaaaaaaatcggaacttttccgccgggcatcaagtgcatttccaacagttcaacagtataaataaatatagcaaaatgaaaattttttttctttcttctttagaaactgtttaaaatttttgttgttaatattcaggaaaacgtgttttttttactgacatttttttcagaagaaggatatgaacaatcacttataaggctcatgctgggagataaaggaatcggaaaaaaaaatatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgacagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatgttttccttcctctttagaaactgtctaaaaatttttgttgttaatattcagaaaacgtgttttgtttagtgacaatttttttcaagagaaggatatgaacaatcacttataaggctcatgcttggagataaaggaatcggaaaaaaaaattatctcaacaatcagtcgtgaaacagaacaataattcggaagcagtgccatattgggaaaagatgcaaaaatagagtaggctcgaaataaaggcaactgccgaagatta

SEQ ID NO: 42326 - DNA, 1169 bp, Heterodera glycines
  misc_feature (1135)..(1135): n is a, c, g, or t
ttaataaaaagaatttttttttttacaaaagtgcttacgtattatacgtttttattaatattgtatcaattattgattgaagcaaaaaaaaagaaaaaagaaatgaatcaattgtatattttgttaataaaatagtaataaagtgtaaaaaaagtcgttttcggtgacaaatgttttcgtaacgatgcgaaaaattatgaacaaaaaagtgtgaaaaatgaacatttggaattatataagaatttatataaatatttattaattttaacgaatttttgaaattgtatataaaatatataatatttttcatatttccatcattgggttaaacttttatgagaataatatttcatattattgataatgtcgaaagggtaaaatttttaaaataaattgttctcgaatttatatcaaaaaatttaattgttagaccgatttaaaacagcattttggaattttaacagaacttaagaatttagatgaattttgaagatgtattatataattgaataaaattcatttgagaaatttgttattcataaaattaataaatcgaagttgctagctacagtaagttaaaaatatattttttaataatttatagatttgaacgatgtttagaaatttgaaaatacttgttttgattcatttcttcaaataactttatgatattttaaaacaacttataacaatatcattttttaagaaaagaaactaattttagaggggtacatttaaaaattcataagaaatttatggcaatggaaactgtttttcctactattcaaagcatggcgaatccatgaaaaaactatatatttacatgaaattttcatccttattaataagataaacaaataataaataactaactaagtaaaaaaaacaaatgaaaaataaaatattaaaaccgttatgaactcattttaattttgagaaatctgaaaatcgtgatcttgattttgagaaaagcgtttaaatatgcaaatccatagacaatatttaattttatccaaattttattgttgtccattttcacataaatggcattcgggagatttgaattatttttctctaaaaagtacatttcaaaaatggaaatgcaaattttataagcttatttcaataatctttntaatacctatgcctttaatcgccgctaatataaa

SEQ ID NO: 42327 - DNA, 1711 bp, Heterodera glycines
aaactgagatacatttagtgttagtacgccaattgacttttttcaaaatttaaaattaatttttagttccctcaggcgctgtggcacccgcggcaccgttgccgcaaggcggtggccgtggtccaagcgcggcacaaagctacaacaaatatgcgcatgccgctgctctgcgcacgcgccaccgtgtcgcgtaatgaaagggcgagagaagggaaaattgagagaaaagggggagagaaaggaagagaaaaatacaaaaacgaaataaaagaattattgtatattttaaaaacaaatctgaaaaaaaaagaatttcttattcgaaggattattttttagaaattttattttattttttttaaatatgaaaaataataaatcattaataataaatcaattccaatgccaacactctgatgagaagcaattgctaaaacattctaagcaaattgataaccaaaatatgtatagctcaaataagaatatttattatttttatttttatgccgttcttttcttctcaatcccttttaattcattggcgctcaaaattttcgtaaaatcggcgaataaaattcgaattgactctgtccaattgctctttgtttcttcgccttcgtttttttgtattcccaaatgcaaaaagcaaattggaactgttcaaaaaattgatgctgaacagaattttgtggaaataaatttgttgggagaggaaaattggaacaaaaatggcaattttattgccaaagtttcatattcgggcccacctgttaatgagcaggtttttaaacaattaatttttacccatttttaaattttatttcccaattttgatgctcatctcaaaatttgttgacgtcgatgctcactttttacttcgtgctgaaatggttgtcgtttcaattgaagcgcaaaacggagaacaacaacgaacgctgacgataatgccgcacagaaagcaatgcttcgtggaggtgtactgtaacattgccaacacagacggtacgagtacagtactcgcctttggcaccggacaaaaagaagccggcactgcccaaattcacttgtcactttttgacggagaaaaggcaaacaaatgttttgaacaaaacattcacgtaaaaattttcgacgaaaacaaagaggtaaaagaatttaattgaaataaaaaaatatataaaaaagaaaattacagcaaaattttatttttaattcttcggaatttttcaatgtatcaaaacaaatcacaattgatttaacgaaacccaactgaacaatgagagatgaattttggcttaatcataagttagttcattttaaatgatatggtcgactttttttcattctttcgaatattttttcataaatcctttccaaagaagataattgttaaatttatttttatctttttttttgagtatttcattttgcttctttgctatttattagcaaataaaaccaaatgattcaaatgaacttaaagcatgttgccttgatcattaattccctatataagaagtttatacctatgatccaagcataaaaactaatttaagactttttagcgaatgttacgggtcgtgagtggggtcaatcgacgcagtttttcaagggctataagggaaaaatacgggttttctaaaatgttcagaactgttcgaactgcaaccaaaaaaccgacccaaactcacactatttggattacctattt

SEQ ID NO: 42328 - DNA, 654 bp, Heterodera glycines
ttcttaccattaaaacattatctgatcccttttttggtatcttccataccataccaccacgaccacaatcataataccgtacacttctgcaacaaaataatgccttttagggcatgggaaatgcgctcgcgcaccccaaacaatgcatggaagacggaaatcatatatgtatgaagagacaggccagcacagtcatccccccccccccccccggcgtcgatcggacacacattgttgcccaattttccgaccaattagccgtgcacatacaaaactctgtcgcccgggggtgggaagggcgggggaagggacagaccaaagatatcattttacatacaaatttggaacaaaaattttgttgaacaatcaacaagcacaacaacaataaaaaagttaattgccttttaattgcttttcccacacatcacacacacacaggcattttttggccatgccaaaaatgtgttccccccaaaaaagtgtgattgttggccgtttagcccccccccccataattcctcctcccataaggtgacatttggtggtggagttgatgccgatcgacgagtttgtcccaacaagaatggaaaatgattaaaaaatcccttcctttgagttgctacatatttagctactcactaaacttctttcacc

SEQ ID NO: 42329 - DNA, 1217 bp, Heterodera glycines
  misc_feature (52)..(53): n is a, c, g, or t
  misc_feature (55)..(55): n is a, c, g, or t
  misc_feature (60)..(61): n is a, c, g, or t
  misc_feature (65)..(66): n is a, c, g, or t
  misc_feature (68)..(69): n is a, c, g, or t
  misc_feature (71)..(71): n is a, c, g, or t
  misc_feature (75)..(75): n is a, c, g, or t
  misc_feature (94)..(94): n is a, c, g, or t
  misc_feature (109)..(109): n is a, c, g, or t
  misc_feature (120)..(120): n is a, c, g, or t
  misc_feature (135)..(135): n is a, c, g, or t
  misc_feature (144)..(145): n is a, c, g, or t
  misc_feature (165)..(165): n is a, c, g, or t
  misc_feature (175)..(175): n is a, c, g, or t
  misc_feature (211)..(211): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (237)..(237): n is a, c, g, or t
  misc_feature (252)..(252): n is a, c, g, or t
  misc_feature (261)..(261): n is a, c, g, or t
  misc_feature (271)..(271): n is a, c, g, or t
taaattaaaccaaatatttggagaatttccattttttctcttcatagatggnncnctttnnaaanngnngngagnacttcttttttcatttggngatgttgttgtaganatttgtttttntgggggaattggggntgaagttgnntcggtttgtgatggaagtgntgaggagggnaaagaaatggaaatggtagaaaattggggtgaagtngaagaagaagnagnagaggncaaatncgagagaggagaagnaattggganggaagaagtnggtttcgttgtcaattggcactgcgttgggttgggcgtcgttggcatttctttgtccgttctttgctgctcagttttttcagtccctggcccatcgacagtccctttggccatgtcattcttttcttgctgctccctccgtttttggtccgccacttttttgagcaacgcttcacgcgcagctgaacaaaataaatagacaaaatatttagatttggcattgtccaccaatgtgtcccggacggacccacgaccatgagaagacggacttcgaagttcgtcggaggcattggggcagtattttcactgcgagcagtgagcagacgagaagcggtcaaaatggagtcaaccgcggtgttgggcaacacagggccaatgagttgggaggaagttgcagccaactgaaatcgaaacaaatcattaggatattcatagcgcacatacgtgtgcaaggggggggggggtcaggaaaagggtcgtgcgttcggcgatgacttttgcagagcccttttgtcaacggccggccaattttttgcacgaccatcttttgcatttttcatgccagttttttgcgttgcacttttttcaaaaaacttttggggaacggggggttgggtcaggcggtgccgataggcgccgcagggaaaattttttgaaattttgattatgatttgttaacagattttcaccaaaaaatgacaacatttttgcgctttttgggtcaccttttaagagaatttaggcatttttaatgaaattttaaaaaaataggcaagattttacgaggaaaggatgtcgaacgcagaaaaattgggaaattttggcgaaatttcttagggaaatagtcaattttcaagtccccacttaacgttcgacaaatcgccctcatggttagtcgacgcaataggagacccgaccctttccttgaacttgccgctcccttttct

SEQ ID NO: 42330 - DNA, 947 bp, Heterodera glycines
ggaaaaatcaaaaaaaatcagggctctctctattcatatactaaaaatattcaccaattcccttttcatgactataaaaatcttttgttttccgctttgactcattaaaaaaataaagcttccaacgaattattattctgctcttttgtgtgacatcattcggaactcggccaaaattgtgctaattgccaaaaatgaaccgacggtaaaagaattttaaaagtctaaattcagcattatttagctaaactgttttcccatttcagttggatttgcaacgacgtttggatggacattttcccctcttttgaccgtcctcaacttggcctcaaattggcacttctttcgccacgtttcaatgcgttggtggacaaacatttcaatggcaaaagcgaattgacaatttggagaacaatcgaaattcgtcgcaaggacaaaggaccagaaccgaaactgtctgtgctgatggatgacaaaattgtggaatttccattgcccgattatccgttgccctggaaaatccgttttaagcgccttcagatgtggtaattataaatcagagctatcgcaataaaagcattcatcccatttttaggtacatcgatcactccgtcatcgcttttcttcgttcaaatcatcaaattttcgacaaaagaggcaccaatttatatttgtggattccatcatcacactctacgaatggccagccgatttgggacatttttgttcgtgaaatttggcccattttttctgaaaacattcgccacttgcgcttttacgatggtgatcatttggacaatttgcttcgtcgcacttcgccgacaattctcactgatctcaaccaattgacttcaatctattcctgtggtctgtcgcccgctgcgtttggtgatggttttgatgtgccaattttcacaaatttctgctggccaagcattgtccaaatg

SEQ ID NO: 42331 - DNA, 1512 bp, Heterodera glycines
aaatagaccggaaaaattaaagtcgaatttttaatccattcaaactaaaagtgatttggtcgctatttatttatttgtattgatttcatattatattttattttttggcggcgatctcgtttttaattgttttgcgctttcttgaggacattttttaaattaatgttttgtcctcaatgtaagcggatttttcccttttgtggactttttctttattgacaataaacaaattaaaagcttccctgattatatattttttctttttataattatgctgcttgatcggaaggaattggaacggccaaagacaaggattgtaagtttttcaagttttgttcgctattttatagggctgggctatcaaggtaaattctcgttctcggtttccgcgtctcggacaattttggatctcgagcagccctaattttgtatctaatatttcttaatagattttaaaacatttaaattatatttattaatatattaaataattaagagtcaacaatgccaagacttgatcaaatatctctcaagtcaaaccgacagcccaaatgatttcgccaaaaaattggaaagtgcgcctcctgtaaaggaattgggtgatgtaagtttgttaataaaaatattttaataatttacactttggattaataaaaatattaatatttgccttcggcaaatgtcaactttcagcatttttttagatttttttggaggctttttatgatttaaagcaggcgtgcaattattcaggatcatagaaattacgggatttttagacccgtaattacggattatgaattatgtgatttttccgtaattttggtccataaaatggttttatagctgaatttctaattaaataaatttttgtacatataattgatagcaaaaacttatgactagggctccaattttagggtttacctattttttcctgagctccctatggtctggtctgaaatgcacaaaaaacatgttttttagggggggggggggttgttaagctacttttcgagtttttagaacctattttctaggtttttgtttttagcacctaaaagactgaaccataacatttttccgctttcttaattctttcatatctaattaatatattttgttttatgctttgctaatctttttttgtgttgtttaaaaaccgtataaatttttttggcgaaacgaattacataaatatgctcttgaaatgtttgaattcactctcgagattgacaatttttccgaaactcaataccaatactgagtattatccctaaagcgaagaatgggcgacttgcgaccaaaacagcactttggagtttcaaatgcacaatctttgacaattaaaattttaaatatctggaaaaccaacttgtgcagccaataatttcatttcgtttaaactaaaaactgaaactattaagcgaaagttaaaaacgtttaagccaatgtagtttatttatagtgtattaaaatagggacaaatccgagtaatcaaattcacaaaaa

SEQ ID NO: 42332 - DNA, 1007 bp, Heterodera glycines
catgctgtggcggagtgcctggattactgccattcctgctttgattttcgacctgaactcagacgtgaccacccgctgaacttaagcatatcagtaagcggaggaaaagaaactaacgaggattcccgtagtaacggcgagtgaactgggaagagtccagcgctgaatcgcagctcctctgggttgcgaggtgtagcgtatagaccgtgagcttgggttggcccgcttgttcaagtttcccttgaccggggctccagagaaggtgcaagacctgtccaactggcggtgcctatccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgtactgctagcctccagactggggtttgctgtccttctgttcagtggcgaatggggcatttgcaggcggagtgcgctgagatgctcggagtagctgcgtgagctcggtcttgaggccagccttttggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcacttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgaggggcgcaacatagtcccgtctcgatcgcatgcgatgggggactctagag

SEQ ID NO: 42333 - DNA, 617 bp, Heterodera glycines
tatttaaacgttaaaaaacgatagttagacatgttctttagaattttctcttcaaaatgaaaccaaaattgctctattttttttattaatggccaagtataagcattagaaatttcagaaaaacgactgttttatcactttttcctcttggcgcactgtatgcatttaattttcattaacttttagtgtagtgtctgactcatagtgtctgctgtttcttcatgttttatgttttttttcgattcactctttttttttttataaggttacgcaatatttgtcaaattgttgatatatgcctcatgaatacttgaaagggcagggatttatttactcgaaattccttctcatcaataaattgcatacgccaagggcgtagccaggaccttcgtttcgggggggggggggtcaactcaaaaagtcgattcttaggggtgtattttttcgtttttgtaacctctatttttaggggtgtattttcgtgtttttttttaaattgaactgattgcattattttatgtttcctttgcataaacgcgttatttaaattaaaataaaattatgccggcgatgtttcaaaaatttttttttcaaaaattctgatttcgggggggggg

SEQ ID NO: 42334 - DNA, 481 bp, Heterodera glycines
ttaaaaattgcactaatttatttcaaaagaatcattaaaatagcaaacacttggtccataacacaatttgaaaccaggaattccgaaccccgaccccaaaatactgataaaaaagttgaaaattcaagttcttttaaatttcacattttgttcaacctttgtttacacacacggaaacgaactgaaagtcatccctgatactcatcagtgctccaataaaatcgtttaaaccattttagattaaaaatcaaaatcgaaaaattccaattatgtggagagaaactttgctgaaatataacacattgaatacaattaactgttaaagaatttttgcttttaatgcattttttcaacgaaaaatctggcggcgagatagccaaaaaacaaggcgcggcgagttggccccgcggcgagaaagcgcgcggcgagttggccccggcgagatggccgcggcgagttggccgcggcgagttggccgcgg

SEQ ID NO: 42335 - DNA, 984 bp, Heterodera glycines
  misc_feature (947)..(947): n is a, c, g, or t
  misc_feature (956)..(956): n is a, c, g, or t
tttttgactgcaatttttttccttttttgaattggggctcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgctgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttcctttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattcagatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatncagaaaccnaagtcagtccagaaaggaatattttaaa

SEQ ID NO: 42336 - DNA, 1483 bp, Heterodera glycines
taattttctatcttgcaggattaaataatttctctttctttttatctccaaacaattttaaattaaccgaagatggacccgttggttttttcataataattgcaaaaaaaaaaatcgtagttttattgggaccgctgaacatgaatctggcagaattgtgacaaatctcaaacccgaactcaaacaaaaagatgaaaattcacatttttaaataaatttttttaattaagaaccaagaagaaaataaatgaaaaataaatactataaattttttaatttttaatttttagttttaaattattattttattaattatttttattcatttatttgattaataaagaaagtaaattttttatatgaaaagaagtgaaaaaaaattaacaaattaaaatatgataaatttattaattaataaaataatctgaagttattcgtgagaaataattacatattttaaaatttagcatttaattcaattaataatattgacaattaatcatgatcgtatgaccgacttcgtgaatactgtttcgggccaaagtttgttgtattctattgagtgttgcgatccgaaataattaatatttatttttgtttaataatttcatttcaaaaaaaatatgtttttgtctcattttcttgaatttaatttagtttttttaattaagaatcaggaagaaaataaatactataaatttattcatttttaaattttggttttatattatttatttttatttttaattatagtatttaccttttaaataattagaaaattttgcttaaaatataaatatttcggtaatttttttagatgtatttgtatatcaaatgcaaatatattgaataattttttgtaaatgaattaatttctgcgtattttttaatgaattgtccttaattttattagttcattaatttttaaatttatatgacttcagacttcattagcatttttcacaaatttcacgatgtgtaagctgtttaattatgcgattaattcattttttatacagaatatcgaaatctttgcacataagaaaataataataataataaataatttgatttaaatagcgaaaaagatttaaatatctaacaagagaaaaaacacaaactgtgatataattaaaatactaaaacattaattaaaattactttgcttagaatcttaaaaaatgataaaaaacagaaatattagcatatttgaaacaaaatgaaatgtttagactaataatatagaaaatgcagctgacatcataaaaggacgacactcctacggatgtgcacatgaaaagaataataaaattattcgaaaaaaagatcattaaattaaatagtccaaactgctacttttaaaaaaggagatccgacttcgagtttatatttgaaaaatcgtaatttatcattaaaatttgataaaataaaataacataaaataatataggaagtgtccctattatttgtaccaaatttcggc

SEQ ID NO: 42337 - DNA, 967 bp, Heterodera glycines
tgttgggctaccgtatcagttattaaaatttttgtttttcaaaaggatactaaaactgggataaccccattcagagacaagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagacaagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaatttttgtttttcaaaaaggatactaaaactgggataaccccattcagagacaagtcaaaaaaaataataataggcttggactactatactaattagaaattttagaatgtgtctgttaaatgcaaactgttgtgaaaaattgttataactccttttcagagaagagatagaaaaaaaaaaaaaa

SEQ ID NO: 42338 - DNA, 839 bp, Heterodera glycines
ttttgtagggctcaaccgcagatagtaatgcgttactttggggaaaccccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaacccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccatttttctgagaatatctattcttctgagaaagcaattttcaacccgacattttgtagggctcaaccgcagatagtaatgcgtttttggggaaaccc

SEQ ID NO: 42339 - DNA, 828 bp, Heterodera glycines
ggggacctctagagtcttggttttgttgcgtaaatgttgaactttgttgaaactctgtattttcgattttttgtcggaatccgggttcgggttcgaatagggtcgaaaccatctaaactattaccctccttttaaacggaaaaacatattcaattttaaaaataaataaatggcaaaacattaacaaaattaaaaataaataaatggcaaaacattaacaaaattaaaattacataaatggcaaaacattaacaaaattaaaaataaataaatggcaaaacattaacaaaacggtcgtcgccaattcggccggtcgtcgtccatcactcagcgaggatgcccaggtgccggaggataagccatcggttgaggacaatatggccaccccgtcgccgctgcaaagaaagtcaaaattcgtaagcataaggctgcattttgttgccctgccagcaaaggaaatgcatttttttttgttgcaagtttatatattactgtcggtggcagcacgcctattcttgaaaaaaatattttgttttctcgatacaaagttgttttaggggcttttcgggtcggaaaatctgattctgccatccatttcgaatcccgaacccgaattttagcaaaaaatcaaaaagtccatccaattttcaacaaaatcaaaaatatgcaacaaaacgcacaaaataaaacggagaatacgattctgcactccgtaaaaagaatgttaaagcgtgtagatgatttaaaaatgggtctcaagagccggttattactccgacagaggccgacaatataaaaattgtcaaaataatcctattttagatgact

SEQ ID NO: 42340 - DNA, 1202 bp, Heterodera glycines
  misc_feature (39)..(39): n is a, c, g, or t
  misc_feature (51)..(51): n is a, c, g, or t
agtcaaaaagcttttgtttattttttagttaatataatntaaaattatatnttccatatccattatatttctcataaaaaagtggcccttgtagagggtggattgcttttagttctaaatgaactcaaatgaaacaccaattttataaagaatttatatgcattaatttttttcatatccttctaaattccctttattaaaaataattattattaaataatcctaattcaaaatatatttcattttttaattttatgtgtaataaattataatttttttaacacatattttcaaaatttttatttaaattcctgcttttttcattatatcaattatttttgatatcatcattatgaataccttctaatcattgtcaaagtgttttttatgtttaaaagttatattttttaaattttcttcgtcgttattaaatttatttattccttttaaatgtatttttataacattatctgaaaccgttttttggtgacctgtttcagaaacatttgtttttgattcattttcctgatggctttctttgttacgacgaatattttggttttttcttatattaattttccttgttacatttatttttaatatgcttttcaaaaaatatatttaatcgattaaacattcaaaaactgattataaagaaaacactttaattttttataaaatttttttttgctataattattttgccttatatttgaataaatcttttactttccatttttataattaaatatttttataggttgatgagatttatttatttcaaattagttttttttttgtatttttctttgagtgttgttcaacatttatcttgtcttagctctaaattgacgttgtcgacgaagtaacacttgacgtccatgtccatgggaatttattgattgatccgggaataaatgctgcttagaatatctgtttactgcttgggcttaatttgccttacacttgaagagattatgtagttgaaggccgagattttttctcatatttcaaatagctttttttattggttttttagtttaatatatttataattattggttttcatattcattatatttcacataaaaatgttggctagaagaaagttggttgctttttttcaatgaactctaatgaaacaatgaaacgcctttttctaaagattttatattttaatgcattaattatctttatatcct

SEQ ID NO: 42341 - DNA, 1171 bp, Heterodera glycines
gcgtttttacgagatttttctcgatgaaattgaagggcagggaaaggtaccgacagagttgggagtaattctcccattcctgaatgtacgccctcagcagagagtcgtcgtcattgtgggaatggatattctgcaaattggcaacaattgccataaaatgattaattgttggacaaccaatggcatttgccttcccctcacattggccgcgtccgtcacgtggtcaagcagttcaagtcccaattccaacagtaatttctcacaaccattgaccacccacgaggcaattcgattgttggttgtgaacatgtcatgccaatcctttttcgacacattctgtaaaacaaacgttgaaatgaattgtaaagcattttttttgaataattcagtaattttcatccgggacggttttctttacagggttttctccaagttccaaaaaaattacagcaaaaaagagtttttgaatttccttcatttgtttttcatattggattcgttgtcatcacagcaaattaagatatcccaagctttaatgaacaaaaaccttaggctaccgaattgttcttccccctcccccaaattgttttgccataacgcacttctttgtggagcaaattccgcaccactggtaaggattttgcccactccgcctcgaatgaaatgttattgttcctcgactaaattcaaaatttatattaaaagtcgagtttaataaattaagaaatggcaggagaagttttttttctaaactcacaatgagaagtgaatttccgttgctcaattcgccactcattaataataataataatctgaattagccgcttgcatttagcttaaaataaaactgatggaagatgaatgcaaaaccaaatattgttatgttatgtaagtatttaaatttgaattaagaatgagcaaaaaaaacagagattttcttagtttctttaaataaaaaataaaataaccatacaatacagaagtaccgtaattgagaattacagactcatagagactggagaccacgaacaaaatgtaaagtttatttaatagagcctgttaagagcccagtttatgaccagcagtccgatcagcttgtgtccccttccgccgactatctcatcaccgatgggaattttcaccagcattcgtttacaaaatttaaaaaaaa

SEQ ID NO: 42342 - DNA, 898 bp, Heterodera glycines
  misc_feature (819)..(819): n is a, c, g, or t
  misc_feature (837)..(837): n is a, c, g, or t
gtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgcgagcatttgtatgtgtataaaatttatcaaaaaaagagatagccattttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaattttanaattccctcaaaaataanaggtctattgcgcaccgccctccctatcatgctcgagagcatttgtatgtgtataaaattt

SEQ ID NO: 42343 - DNA, 468 bp, Heterodera glycines
tgatatttattttaatatattgtgttgaatttataaaacattttttttatttaaaaattcacttgaaactgtcaattacccccgccgaaaattgtaaagtgtcatcatgcccccaaaaagagtaaaaataatgggcaataaatggtaaagaattgttgtccctaatttaactttttattttagactcagattcagtttccggggggtttttgaggatgatgaatatgaacctgaacttgggtttgctcaattccgaaccccggatccgaaattcgaacaaaaaatttgataaattgttttccccaaaatataagttaaaaccggtcaaatttcggcgcaaattgcgaattttatccaattaaacaattgcaagcattgttttacatcaaaatgaatagttgttaaatgaattagaagcttttaccttagaaaaatgcatcctctacatataattttctattttttgtt

SEQ ID NO: 42344 - DNA, 793 bp, Heterodera glycines
ttttgggtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctg

SEQ ID NO: 42345 - DNA, 739 bp, Heterodera glycines
tttattccatcgcctattgctttaaggttttgtctttgattttgcttttttgtccatttattccaatcgcctagtgctttaaggttttgtctttgactttgcttttttgtccatttattccaatcgcctattgctttaaggttttgtctttgactttgcttttttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtg

SEQ ID NO: 42346 - DNA, 971 bp, Heterodera glycines
  misc_feature (168)..(168): n is a, c, g, or t
  misc_feature (182)..(182): n is a, c, g, or t
  misc_feature (929)..(929): n is a, c, g, or t
gagagagtgtgtgggaaagagagaaatatgaagggaaaaagaatgagagaaggcggaaagataaggaaatagggaaagggggagagagagagagagagacggacaggggaaataccagaataaagagaccattattccggaagagggtggagggcggggggggggganggaagaaaattgcncgattttcaagatattcattgggtacggtgttgatttgatttattcctgacaactctgatgcaaccccacctccgtacacaaatttgtaaggtgctgttcgtcggtggcactttctatgccaaaaatggtgccggagttgtccaacgtgtgtccgactccttccggcgccagtttcaggacaacacgcgcgagaaggcaccttcaattcaggtacaaacatatgtgaaaattcttggttggaacaaagccaaatttaattatttttataattgttttaaattactactaattgccactaattgtctcacgcctttccctcttccattcccgctcaagggatgtgtcgcagaaattgttgtcaaaggccagcgtcagcacatggacgcactgctggaggcgcaaaaaaggcgagcggcgcggacgggcggaaacggtggcgaccaaatgttcgcggtgcgcaagggatgcgccagctgtgcgccggaatgcggagggtcggttgtcaaaccacggaccagaattgcaaaattcgagaattcatataaattagagcaagaacgggagaggacctatcggaaatgcagcaaatggtttaattggcacggcattttggcttttttttagtgcgccatgttttcgtgccgggtacaaccaacaaaagagcgagtgccaatgtggccaaatttatgccgcaaaatcggactcatttggccgaggctgtcaatggacgacggatagcgaaattngccaaatcgagcatgggaaacgcattcgaccatcattgccgt

SEQ ID NO: 42347 - DNA, 668 bp, Heterodera glycines
aaaaattttttattaagggtttctttgggcgcaaaacacgtaaaacttaaccaaaaaacttaatttctggtcatttaaatgattattaaatattttataacgttttcgaaaaaggaaaatttttaaaactaaaatttttttattcatatggggttgcaaaaaaaagaagctttttatcgagaatcacatttgataaatgagccccgtgaaagtagtacctgagaaatttcaaaaaaaacctactaagagcctagtagcaaaagcccgagaaattctccgcctcgaatttctaaatgtgtcataagaaatccccaattccttcacaaattttttctgtttgccttggccgttcatactccgcttccttctggtttcacattttaatttatgattcatcatatacaccagggatggtattccgaggcccaaaaaatttttggaaatcggaattccgggggtcaaaattttttcggaaatcggaattccgaccccaaaaatgtcggaaatcggaaatttttgaaaaaataaaaaaatataataaaatattctaaatattttaataagctaaattttatattattattcacaaagattaactcagggttttttggataaaaatctgttaacaaatcgcattaaaaattacaaatttttttcccgggcggcgc

SEQ ID NO: 42348 - DNA, 196 bp, Heterodera glycines
tgggctgccaccggcgcacggccatgggggcgcggcggcgcagcggctgcgggatctggcccacggccaagccgctatgacggcgccgaggcgggcgcgtctgccacatcttgagcatggtggcgccggccaccggcagcagcacgcacatggccaacagggcgacgaaatcagccattggccacctcctgcgccg

SEQ ID NO: 42349 - DNA, 1117 bp, Heterodera glycines
  misc_feature (68)..(69): n is a, c, g, or t
  misc_feature (72)..(72): n is a, c, g, or t
  misc_feature (90)..(92): n is a, c, g, or t
gattttggttctcataaaaagttgataataaatatttttcgattacagcttcaccaaactggcctcgnncgnggcccgcccctttggcgnnnagagcccccgcccaatccctccgacaattaaaagacgccgcccgcgcattcattgcgcagcaccgaccgttacacattgtaaaatgaaatgatgggagagtgagtcaattaattaattaattaatggaattaaacgttttctcccattgacttttgtttttggtgaatgaagtgccagcatttaaaaaaacgaaatatttgatgatggtaaaagtttggtcccggatttcaaccgggatttgctgtttttttgccggtttttgctcgattttctggacccagaaccgccggatctcagtcccgaattttcctatactcaattaaaatggtaataaaaattggcctgctaggcgtggccgggaaaatttgaaaattttcatcacaattgttaccagttttgcactaaaaatggccaattttcaatgttttagattaaattttattaaaaagttttaatgaattctgattcagtgggtgtcaactggcctaaaggaaaatgtttttgattaggctttaaatttgttatttcatcaaaaaatggttcataaaaaaaagaataaaaaataattaattaataaaattatgccatattttccaacaaaattcttaaacttaatgttttgaaaatttagcttcatcattgccttcccctttcaaaaattgaatttttttgattggaaaaatgaaattttcattgtaattacctaaacaatttcaactgtaaataaattaaaattcaaattaaaaatttaaaaaaatgcttcctttcataaatgcagtatttccatttaaaattttttatttaagctttaataaattctcttttcaattaaaattttagcatgaaaatttaggcgtttgaataaatttaaaacaaaatttatttccgagttacgcaaaatttgtttacaattaaattgaatttgttttgcgatttagatggtgatgattatgatgaagataataatggttatgattatgattaccctgaagaattacttcatttatgtacatatgtcattggg

SEQ ID NO: 42350 - DNA, 826 bp, Heterodera glycines
tttgtaaattctctgaaaaattaaatggccgttgcttaccgccccgcgtctcatgctcgagagcatttgtaatgtagaaatttgttacaaaaaagagatagccattttcctggcatacccatgaaatttgtaaattctctgaaaaattaaatggccgttgcttactgcaccgcgtctcatgctcgagagcatttgtactgtagaaatttgttacaaaaaagagatagccattttcctggcatacccatgaaatttgtaaattctctgaaaaattaaatggccgttgcttactgcaccgcgtctcatgctcgagagcatttgtactgtagaaatttgttacaaaaaagagatagccattttcctggcatacccatgaaatttgtaaattctctgaaaaattaaatggccgttgcttaccgccccgcgtctcatgctcgagagcatttgtaatgtagaaatttgttacaaaaaagagatagccattttcctggcatacccatgaaatttgtaaattctctgaaaaattaaatggccgttgcttactgcaccgcgtctcatgctcgagagcatttgtactgtagaaatttgttacaaaaaagagatagccattttcctggcatacccatgaaatttgtaaattctctgaaaaattaaatggccgttgcttaccgccccgcgtctcatgctcgagagcatttgtaatgtagaaatttgttacaaaaaagagatagccattttcctggcatacccatgaaatttgtaaattctctgaaaaattaaatggccgttgcttaccgccccgcgtctcatgctcgagagcatttgt

SEQ ID NO: 42351 - DNA, 662 bp, Heterodera glycines
gcgcgaggctcttctcctaattggcccttcaggctataatattttggtcaaagaatattctctgctgatcaccccgtatataaaattccaaaaatgtgccggcatctctttgacatctcattttccgatcactttttgtgtctgtttgttaaaagccaattggagcttcaaaaatcatcaccacctttgcattcctcacctttatgtgaccagttttggagacccacccaattccaccgcccccacaaattctgtccggttctgttgcgcgcgcttcacacccaatttgcgttttggtcggcgcccaaaatttcactgccggcgccgtcggcccgccccgccccgcggcgctgtgctatttggatgatgatgatgatgaccttcaagcacaaaaagtgacatcggcagaggggatcagctgcgggggggggggagcttttcctgtgacttataactgcccaataaaaaaatatacggaccgatcaaacggtgatcggtgggtgatcagcggcagcaaatgcatatagcggatgtgtgtgtacgcgttgttggcaaaaagccgcccgtccgtcgtccccccccccccgcccgccgggggcgcgtcattgtcattcccacattcccacaatttcccaccaccatctattttcgatacctcccct

SEQ ID NO: 42352 - DNA, 370 bp, Heterodera glycines
  misc_feature (363)..(364): n is a, c, g, or t
gcaaagggggccagcgagggggggggggggggttcgcagcgaagggggggccggtgtaaaagaggtggggggaggtggttcgcggcgagttgggggtcgcaaattttcgaaattttcttgtcgtaagtcggaagtttttgaaaagttccgacttttatcaaaattcggaaatccgaatttgtgccatccgtgctggtgttgtcccacatttttggcaaatgactgattgttgttttccaatcaaattgtttagcattttctccgtgccaatgccatttcttccgtcacttacgaaattcatttttctgttcgtgcgccgtcaatacaaatggtgccatttgaattggtgaacgaatggacaannaggaaa

SEQ ID NO: 42353 - DNA, 943 bp, Heterodera glycines
tcatccaacgggagaggaacggcgactatttggggaaggtattcatctttctctgtttatttttactcatttttccaaattttggacggtcaaaacggtgccgcacataaccgacgcgatcattgaatgggtggagagagtttcaaagatttctgttgatggcagcggaaaggcaccgcaaatttgcattgtcgaggtcagttaaatctgcttccgatctcttagagaaaaattgcccttacttcgcttttgcattttttatttatatttttttagctcggtggcaccattggtgacattgagggcatgccgtacacaatggttgcgctttgaccctttttgcgcgattcattttcttctaattttaaggctttcagcatggcatttcgccgcaaaacataccgtaatcgttttctgactgtgcacgtgaccaaattgttgcacgaggcaaacaatttgtgctagtatatatattagttaaactatgtttttcagtcgggcgaaataaaaacgaaaccggcgcagaatgggctgcgcagtcttcgcgagacgggcctttaccccgaccttttgctctgtcgttctcaaaaaccgttgacccaagcgctgcgctccaaaattgccagctttgcccaattggacatcaacgaaatcatcgacgtgtacgactgtcacgacattcacagtgtgccgttgcttttgctgcagcaacaaatgaaagagttgctgatcagccaactccaactgcccgacatgcgaacgaaggaggacttttccgccttctacagatggcaacagctcagtgaaaagcaagtttaaaaaaaaagatagaccctaggcttcggaggggctgaatccaaaaatttgattttttgccagaaaatgatatttagcattttatggtccatttcccaaaaatatggtaaaatgggggggggggggg

SEQ ID NO: 42354 - DNA, 1071 bp, Heterodera glycines
acgataagcgatgaaagtcttaatttgaagttaatttaaaccaccaaaaaataggcaatttttggtaaataaataaataaacacactgaaaataattaaataattttcgaattaaagtttctgttctgttttttatccctctgataattttaattaatcctcttgagttcttactgattgttcatttgcgagtttgagtggcttaacattgtgcaaagaatgttcagcaatcggttcctcatatgcacagaatacagatgcaaatctgtgaaaattataaattatttcctatattttttaatttattgtcctcttttcctttttcctctctttcggagtttactttctctctccttctcacgccctctctttttttgtctctttctagttgtctctattttcctttatctcttcctttatttccccccccctctctctctctctttcctctcttccctttacactctctccttcccccaatttcacccttaatttcgtcttcttcttcttctttatccctctccgttgtctcctccaataatcgcttttccaactgtgccgtgctgaatgggtactccgtctcgtccacgtcaaaagcgaccgttgcggcgatagtttggcccaaaaacagcagagaattggcatcgcacggaggttggacaatggcatcgatcagacggaagggaatgtcattttggatggggaaaatgctccgattttcgatcagatggaccaaaaggcggcagagaagcggcgaacggcgaatgagactcagattttcggtggcacttgtcctgttgaaagtgccaacggaatttgcgcatttttgaaaagcaaaaaaaggctcactcagtgagcagctcaaaaaagtgttccaacaacaatttccacacgtcgcgcgacgccttccgccatacgtccaaatcgcagagcaaatcctcgaaggtgagcaggtccgggatcagcacctgctcagccgacccgtcgtcgacagttccggccaaagtgaagaccaaatggagaatgtgcgagttcatcaggcatattttgtcctccaacagaaccgcgaga

SEQ ID NO: 42355 - DNA, 1033 bp, Heterodera glycines
aatcgtaattacgctcaaaaagcttctcaaacaattttactatcttcgaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattaccgctcaaaaagcttctcaaacaattttagcgctccccattccttcctaaaatcccctttaaaccctcccattatgagcggctaaaattatcaaagggccgaaaa

SEQ ID NO: 42356 - DNA, 962 bp, Heterodera glycines
ttttatttgtccaatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaactgtctaaaaatttttgttgttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcatcggccagcgtgtttaaagcaaacccgaaactgataggaaatttaaattgatcataatagaagtttaatttttatttgtcccatgcattt

SEQ ID NO: 42357 - DNA, 975 bp, Heterodera glycines
gagagagagagaagagagagagggagagaaagcgagagagagaagagaaagcgagagagtcggagaaaaaatcgagagagagagaaaagtgcgagtgagaaagcgggagagagagagagagagagaaaaaagcgatagagagagttagttaccgtatatttgtttgggttcaatgcaatattctccgttcctttcaaaaaatcatttagtgttggaaattgctcaaaaatcccatcgtaaaattctctccgaatgctaatgaatgagcgaatgtgttgctcaactgaatgcattgaacggattgtttgacagagcgccacacttttgtcactcaaagttgaaggaatttctaccaattgtgcagcaaatggtcgatcaactttaaatatttaaatcaaattttaataattgtttctttttcggtaaaatttggaattattatgaatgttttttaactcaaattatttgcattattatcatttaagtagcgaattagtcattaaaataaatgctaatgtttttcttaattccgccaatgaaacgaaaatgaaaaatttcgttggaaatacaaacccttatagcagctatagaagtgattgatttataatcataaaaaacaactcattttcaggaaatttataatggtttttccaaaaaactatgatttttataatacccccttggcggatttaagaaactcgctggcatttccaacaactaaaaatattaaaagtgccttaactttgataacaaaaaatgtccaacaaattttcttatggtaaatgaaaaataaaaaacaaaaactgacttttataagaggtgcctttgtcaattgattcaaagtttgcttcgtaatttaattgctgattccttaaataataattaatgatttaaaaatatattaattaattttacttttttatccgtcggtgtcatttttctcacaatttctgtgctgatgatgctgaagaaact

SEQ ID NO: 42358 - DNA, 762 bp, Heterodera glycines
tgtgtgaaatggatacgacaatcagtttttacacctatcacatttaaaaatacagttttattcactggatttcagctcggttatttgtcaaaagagaaccgggtgttcgcttgtgacaaggaccacaacattgtctcgttcaaacttttgttgtctgtcttggagtaccaaacggcggtgatgtgcaaggattttgacacggccgatcaaattttaaaaatcattcccgaaaatctacacacacgggtggcacaatttcttgagaagcaggtagaaatagaaaggttactaataattttaagcattgtttttttcatagggatttaaaaaacaagcactggcgattagcaaagatcctcagcatcggtttgagttagccttgtcacttggtgatttgcccgccgcttatgaaatggtattgaatttaaatgagaaaaggaagggttttagggatttgttgaatttaggccaagcaagcggacagtgaggaaaaatggaaacaattggcacatgcggcggtgattcccttttaaactttgatcaaattcttttacaccatttaagacaatcaaatctgagctccgtttggcaggtgaatgccttgctaaggccaacgatttcgggggccttcttctgctcgcttcctgcgccggttcgaatcgtttggtaaattatttacgcgttttcatgcggttcttcatttctcaatcatttacaagttcatttttgctgccggtttaagcaagaatttcattaataaat

SEQ ID NO: 42359 - DNA, 1141 bp, Heterodera glycines
cttgggctttccccagtaaaaggggtacaaattttgggacttttccgcctctggcgggggcttaaaagcattttgctgcatatttaaaagttaaaatatttttgtatatttttcacaatttatttcaaaaagccaaaaagtccgaacccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaatctagagtccgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcccccatctgatatttccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaagatccggaacacattttagaaactaaaaaagtgcacaaaagggggagccgccgcacggcaggtgattaaaagcattgttacgcataattaaaatcgataaatcattt

SEQ ID NO: 42360 - DNA, 360 bp, Heterodera glycines
  misc_feature (261)..(261): n is a, c, g, or t
ttatttacggtttgataatgatgccaataattgctggacgatatggggtaaaaaattgttttaaaatatgggaaattacttaattattttttaattacatttttattctttcggtaattttttttgttggtttttaaattgaattcgaatgcaagaaaaagcttgatgcttatacaaatatgtttagtcaatttagtttttcttttcttaaaaaattcactattttttgcataataaaaaaaatttatttaaatttttcancaaaatctttttaggagtgtccccctcatcttcccaccacaaaatcaacccggggtgggatcgtcggcaaaatgttaatgtaaaattttttccgactct

SEQ ID NO: 42361 - DNA, 1002 bp, Heterodera glycines
tttaccgtatttactgaaatagaaccacctcccccccttgaattagagacccccttttaggggggttgaaaaataccctttagtacggtagattaatttctgtacttatttgtggcgtgcccgtaaatcccatagaaaattggacaaatcaagcgaaaaatgagcaccgaattgattttgttaatgagaagctattaacaaatttattattagagtcagctgagagtcagacggatttgacatacggtaacttattttgtatttaaatgtctcaatggataatatgaatttaaagaataaataaaatctaaaataatttttaaaatttggtgcctaattttctgaatccatttaaatattgaaaagcgcactcatttccgcttaacaacgcataagtgatcagctgatccgcttcttctcgtgccgtgccatttccccgtgtccccgcgttttttgctttgatccgtccaatctcaaccgattgttctcgtccattctctcccaccgttggcagttcaaatccgtaaatttgcttttcaaatgcgaaattttgtcctctgatcggatcaaaaactgtcagacggatatccagtgatcggatggtcggaggccgttttgggcatgtcaatttgatagaaatatttgctaaaaagttggaaaacattgattgctctgatcattaaaaccatcgagcaaacgcaatagatctgtttaatctttttgtctatcctaatttaagctttgctttttatgagatttgtcaacaggtgtggcttattctgatcaagttttgtccttacagcaggtaaatgaaatcactcactttcacttactgaccattcgccagagcgatcagatatcaatatcattttagtgatcattaaaaaataatcatccaaaagctaaggcttaagactaatcagagaccaaagtttagagtatgaacaggtcaatctggtgaaaaaagttagatttaaaacataactttcagcaagaaatgct

SEQ ID NO: 42362 - DNA, 872 bp, Heterodera glycines
tatttttcgatagccctaaatgttttctattatcctgcaaaatatctaaaaaattctttaagtttaaaaaaagttatcgacctgagaagctcaaaaaaccaagtttttttgaacattattagtcataactttcttgaaacttaaagaaactttttgaaattttgtagtctaatagaaaacacttaggcctatataatgatatcaagaattaaaaatttagttgcttttgagcaaagttatatcaaaaaatattttcatttgatggtttttgacaaacgcccattatgattgttttttgacaaacgtcttagcaccgaatattattgtttttaatacaatgtccccaattaaaattaattatttacaatgagaaaaaaataatttggaataattaatttctgcaggccattaaaactaaaatttttaaaatttattccacccaataaaggggaccatgaaattggtgagcctgtgatttttttttttttgttaattacagttggaaaattaagcaaaaaattgggttggaacaggatttgggaaaaactctctttaatatcaaaattccatacaattaataggcgaccataaaaaaacaaacataatgccatataaattcaaaacataaacaaatgtcaccattgttttccaaccttacatactgtatgtccgtccccatttcaggtggcaaaaaacatcggagtacgtaatgcttttttgtatacaaaattaaaaaaacaaaatttttttgtaaaaatttgaaaatttttcagacacaattccccattatgaaaccgttgcgcagagaatgcgcaacaatcgcagcttcatgcccttgcgggtatggaggctgtgtgtttgttaccaagaag

SEQ ID NO: 42363 - DNA, 1565 bp, Heterodera glycines
  misc_feature (1412)..(1412): n is a, c, g, or t
aatttgtgcgagattaccgcccctattcctttcttgtgatgcaatcgactgccttaatgatctcaaactaggcattgtaatgtatgagtagcaattctggattcgaaatttcctgcttctcaaaattctgttaccaggtaagcggtggcaaaatgtagcctggcgagcattttctcaataatcgatttgaaaattgctggtgctgactttataccgaaggccaatcgctcgaaacgatattcccttgtgcattcccaacctgctgaattggattcgtcgtccaattcgttcggtctgtaaataggcatctcacagattgatttgttaaaaattttccaccgttgtgagttacaaaaatatcatctggaattggtagtggattttgtgagtcgagaagcgcgttgttcaagcctcgctgaagaatcaatgcatgacattcgtggtgatccgaccgcagacacatgcgccgtgatatttgcgcctcgacaattgcgccgcccaataaaaatagacatttgcgccacacatttgcgccgccctacaaaacacatttgcaccgttagtttaaattataaaattaactaaagtccacttgtattaatgttgcttattattttgtttttcttcacatcaaatttgcctttaatgctgatgtaggcattaacaaaataaaaaattaggtgtctatcgttgtgattgtttttttgcatttcttttaattgctttttgtagttgtacaataatttacgtaaaattcgttgaaaaaaggtataaaatattttaaaatatatttttgactgagcggatcaaatgtccatttttgcttcgcggcgcaagtgccgaggggcaattgtccgcggagcaaatttcgcagtgcaagtgtcgattttgctggtgctagcgcgtttgttaaaaactgccacccatgcgcgtttgttaaaagtgccagaatgataaaaaaaagcgaaaatatttgacagaattatgctctagctatcaatcttatctaataagagaggcggaacaagaagctaagaaaatgacaaattgcgaaataaatgaatttccaaaagtttcggtaggaaaactgaaaattagaaactctctttcaatttcaatgggatgtgttcaaaatcccggatgtttcccctaatctgcgctttgacttggactgatccgtaccgtttgctgatctcttttcgcatttgtttcagccattttaaggcaaattctgcgcgactcacatcacatggagaatgaatcttaaagaaaacaaaatggcattttgcaaaattggcatttttatttgcgtaatttttcaattggactttttggtcgattatttcggcaatttgttgttcaaatgtcccgtaaattctgtcgaagagcagcaaactgaacattctgtttgngatggttctcaatttattatgattgttcttcaaagtacggtcgtccttcatgttggtgatgaatccgatcagagcaccgctcaaatcgtggaaatacggggtgtcaaggcacgcatttacaagtgcctgacattagacatttgaattaaaacc

SEQ ID NO: 42364 - DNA, 832 bp, Heterodera glycines
acacctcaaaccctagagaagtgtcgttcaaactccgtcctttttgctaaggtgcactattttgccgaaaacgtacgatcctaacgagctttttgaaaagcgaaacttctgactcaaaacacctcaaaccctagagaagtgtcgttcaacctccgccctttttgctgtggtgcactattttgccgaaaaaggacgatcccaacgagctttttgaaaagcgaaacttttgactcaaaacacctcaaaccctagagaagtgtcgttcaaactccgccatttttgctgtggtgcactcttttgccgaaaacgtacgatcctaacgagctttttgaaaagcgaaacttctgactcaaaacacctcaaaccctagagaagtgtcgttcaaactccgccatttttgctgtggtgcactcttttgccgaaaacgtacgatcccaaagatttttttgaaaagcgaaacttctgactcaaaacacctcaaaccctagagaagtgtcgttcaaactacgccatttttgctatggtgcgctcttttgccgaaaacgtacgatcctaacgagctttttgaaaagcgaaacttctgactcaaaacacctcaaaccctagagaagtgtcgttcaacctccgccctttttgctgtggtgcactattttgccgaaaaaggacgatcccacgagctttttgaaaagcgaaacttttgactcgaaacacctcgaaccctagagaagtgtcgttcgaactccgcccgtttttgctgtggtgcactcttttgccgaaaacgtacgatcctaacggagcattttgaagagagcgaaacgttctgacccaaaac

SEQ ID NO: 42365 - DNA, 728 bp, Heterodera glycines
cactcaacccaccaacatttcaatcactcggtactcaacccaccaacattacaatcactggcactcaacccaccaacatttcaatcactggcactcaacccacaacccaccaacatttcaatcactggcactcaacccaccaacatttcaatcactggactcaacccaccaacatttcaatcactggactcaacccaccaacatttcaatcactggcactcaacccaccaacatttcaatcactggactcaacccaccaacatttcaatcactgggactcaacccaccaacatttcaatcactgggactcaacccaccaacatttcaatcactggactcaacccaccaacatttcaatcactggcactcaacccaccaacatttcaatcactggactcaacccaccaacatttcaatcactgggactcaacccaccaacatttcaatcactggactcaacccaccaacatttcaatcactggcactcaacccaccaacattccaatcactggactcaacccaccaacatttcaatcactggcactcaacccaccaacattccaatcactggactcaacccaccaacatttcaatcactggcactcaaccctccaacatttcgatcactggcactcaacccaccaacatttcaatcactggcactccaccccacaacatttcgatcactggccctcaacccaccaaaattttcaatcactggcactcaa

SEQ ID NO: 42366 - DNA, 1237 bp, Heterodera glycines
attcttttcctttcagtatctcctgcaaagtttaggggcgcttctgataagtttctgaaaaaaaagataagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtggggccttcgccccctatatgcatggaaacccaaaaccgattcgtcaattcccacgcaaaatatgtctccaaattcattcattcgtttggcattcggctgcttggcgctccaaaaaatgtgtccatttttccgtggtggtcgggcgagtccctctctcccctcggggggcgggaagttgttgctttgctggcgatggcattggcatgccccggtgactgttcattgagttgttgctgaagtggatcctttggccagacgaagtgccgcccgtccgtcctcttctcctttattcgttttgtttttagggacaccaattgccctttcgcccgggcgaagtgccgagggcaatttccatattcacatttcggcacggtccgatgcactcaagcaaaaattatggcactatgaggcaagaaaggcgaaggcgctaacttccgccatatgacctcccaccactcaaaacacttcactcttttagtgggccaatttgaccaccggcaatcgccgggcaaaaattttgccaaataatcccacacaatccaaccaaattggcttccttcacccatccaacccatcatcaaaaccattctctttttcaatgaatgtatagaaatggagagaaaaagagagtggcgtcagagaggcaaaatgttggccaagtcttggtatgatggactgactgactgctgccttggcttggctaggactcttcccgtttatca

SEQ ID NO: 42367 - DNA, 1192 bp, Heterodera glycines
ggggatggaatacgtacggaggggggggggggaaacgctaaatgctccgacattttccgcccattgccattttctcgaaggctcttccgattggccggccaaacgtcggaatcaataggactaaaatggatggatgtgaacatcctgatcgaggctgggctgaagagccgacactttgccaattacccactcaaacacagcaaaagccactcttgcctagggcattcttataaaacatgccctgaggcaaaacgtcggcattttgtaaaaaccgaggggggttcaatggtcaatggattcgtttggctcagagacaagtctcattaaaatgatcactttttgaggcgaatgccactgactaattaatattaattaataaattgcctctccattcaatttggccaatttgccattcattcctttgccttttatcgttagtaaattattttaggcgcagcactttccaagctccactaaatttgtttttttgtgaataacagtcagcaaaaacaaagcaaaaatggacgccatcaagaagaagatgcaggcgatgaagatcgagaaggtcattcgattgagcatttaaaaaggaacaaaaaaagacaacggaatgccaacaaactttggcattttaaggacaatgccatcgaccgggcggacgccgcggaggaaaagtgccgtcaaacgcaggaacggttggagcgtgttgaggaggaattgcgggacacgcagaagaaaatgatggtgagaggaggaggcaaatttgaatttaaaacattggcaaaatgttcaattgcaggcgacggagaacgaattggacaaggcgcaggaggacctgacggctgccaacaatttgttggaggagaaggagaagaaagtgcaggaggtgggccttttgccgattttggcatttccaatgcctttggggaggggcggcaacggcacaaacccaaaaataaattcttattttgtacctatttgatttggccaattcacttttcctccgtgtgttatccgaattcccaaaacggtgacgaaagcgagaattgcccgggcgaagaagcaaagaagcaaagactggattttcgatttgcgattgcttttccttcgctttgctttccctcggattttccccaccttcgccaggggacggaggcgaagaaaggcagcggaaaaagtgcataatttgctt

SEQ ID NO: 42368 - DNA, 522 bp, Heterodera glycines
aggccgcgaagcggccgaatgtcctccaaaaaattaaaaaacgggcgcgaagcgcccgtcctgaggccgcgaagcggcccaatgtctcacaaaaaattaaaaaacgggcgcgaagcgcccgtcttgagtccgcgcgcggccgaatgtcccccaaaaaattaaaaaacgaagcgcccgtcctgaggccgcgaagcggccgaatgtcccccaaaaaattaaaaaacgggcgcgaagcgcccgtcctgaggctgcgaagcggccgaacgtctcccaaaaattacaaaacgggcgcgaagcgcccgtcctgaggccgcgaagcggacgaatatcccccaaaaaattaaaagctgccgaatgttccccacaaaattaaaaaacgggcgcgaagcgcccgtcctgaggccgcgaagcggcccaatgtctcaacaaaattaaaaaacgggcgcgaagcgcccgtcttgagtccgggcgtgatggtgataatgttaatgtatgatttacgagttccttaacaaggtatta

SEQ ID NO: 42369 - DNA, 1226 bp, Heterodera glycines
taatccgttccgcagagcctcttcaaaattttttccattaccgcaagagctgcggaaattgtgaattaattctcagaaaaatggctatctctttttaggacaattttctatctcgtaaccccgatgctaatccgttccacagagactcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttggggaaatggtgaattaattctcaaaaaaatggctatctctttttaggacaattttctatctcgaaaccccgaggctaatccgttccacagagcctcttcaaaatttttcccttaacccaagaagtgggggaattggggattaattttccaaaaaaagggtatttctttttaaggaaaatttctatctcggaacccccatggtaatccggtccccaaaagcccttccaaattttttccattaccgcaagaagtggggaaattgggaattaattctcaaaaaaatggctatctctttttaggaaaattttttatctcggaaccccgatggtaatccggtccgcaaaaactcttcaaaattttttccattaccgcaaaaggtggggaaattgggaattaattctcaaaaaaaggggtctattcctttttaggaaaattttttttttcgtaaccccccggggttattcctctcccccaaagcccctttttaaattttttttttttcccccaaaaaggggggggaaagaggggatatttttttttccaaaaaaagaggtttttttttttttttagaaaaattttttttttcttttaacccccccgggggtatttttctgccccgggggccttttttttaattttttttttttttccccccgggggggggggggggggaggtggtatttttttttttaaaaaaaaaaggttttttttttttttttaaatttttttttttttttctccccccccccgccggggggtcccctcccccccccccgccccccccccactttttttattttctttttttctcccacgaaaggggggggagggagagagaaagaaaaaaataaaaaaaaaaaaaaaaaaattttttttttttttttttttttttttttttttttttttccccccccccccccc

SEQ ID NO: 42370 - DNA, 152 bp, Heterodera glycines
aatcatgagcctgcgcatcagcatcgtcgggatgggccacaccggcacccaggcggcgcgccgcctgctggcggccgaacccgatatcgccctgaccgtctacgacatcgatccggaccgctgcgaggacttccgcggcagcgccacgctgg

SEQ ID NO: 42371 - DNA, 1212 bp, Heterodera glycines
ctatgtccctttccactttgatttcaaaagcatacaaatcatcacaaggatggtaatttccatcatcatctacttggatgaaacgccatttataaaatgcagaaaagcaaaatcgaacaaaaataattgggtttaattatttgattcctcataatcttaatattaatattacaattatctattaatttcaataatatattttccaaaatcacaattcaggatttaattaaccacggtcgagatcccacactatggcttttaattcaattccataaaaagatcgtcatgtgcattcttgctatcattcaataattcttatcattctttatatatctgcaaaatgtaagaaaattttattgcttttcaaaaaagttatgaccaaaaatcgtaaaaaaatttgtttttgtccataacttttttcaaacttgatcaaattttttgaaacatggtggatagatagagaattttaagggctattgaatgataccaagaatgtttaatttgcccgactttaacaaaagttatgacgatttttttgtcgaaaaacagtacgagttggggcagtacgagttggcctagtacgagttgggtttttaccctctcgcctatcgccaaactctcgctctcgtctttttggggactctcgcctctcgccaaactctcgctctcgtcttttctgagacaagtcacacccctggtatatatgctataaagcaagagcgacacagaaattatgcataaagcattgcataatttattcgaatgggcaaataaatggcaaataaattttcaattcaaaaaactttggtattatatttgggtacaaaaaacccaaaagaaacatataaatttgatggaagtacaataaatgctgtggatacaattaggaaattaatttatttaaatttcacacaattttattaaacggtcattcgtatacggcgcattgctataaaagccctccttcctctcccattttctttcattcgctcactttttccttccctttttgcttctgcaaaggatttcctttttttctcgtttttcaaaggaaattgttgatttaacaattcaattttgctaatttgtaagcttatttaatccgtcgaaaactgttaataatttcccctcaacaaaatgtcagccagccgaaaagaagccgagcaaaagatgtcaaaagcaatgtaaaattaaaatgccaattttcaattt

SEQ ID NO: 42372 - DNA, 111 bp, Heterodera glycines
tctctgctttcgaagccatactctctcatgacttctttgatcgctagctctttgctcaatgcactttctaattcttctcaagcattaaataaattggaggttcttcaatgt

SEQ ID NO: 42373 - DNA, 787 bp, Heterodera glycines
ttttaatttaaatacccacctgggtgctgggtcgttacttaaaaaccatcattatgcatatttttgtcgaaaaattatttataactttgctcgaaagcaaccaaatttttaattcttgatatcatttgatagccctaagtgttctctatcagtctgcaaaatttcaaaaaatttcgttaagtttcaaaaaagttatagctcgaggaactcaaaaaaccttcatttttggccataactttttttaaacttaataaaattttttgaaattttacaggctcataaagaacatttagatctatcgaatgatagcaaggattaaaaatttggtctttttagagcaaagttataagcaaaaattttcattatgatggtttttaagtaatgacatagcaccaatgtggggcccccaaacggaaaagtaccaaaaatttttatattaatttcatctacatataaaaaatctaagaaataaaagagttttaaagtggtgttcccgggggaggcgcctaatatgtacaaaaaatgggaacatgtcaggggggcggggagagttttgtttttgccggcggaatgggtcgaatgggcgctgccatttgggcgatactaaatgggcgccagttctcgaacaaaatataataaatgcatttgataattgtgatgccagaaggaacggagtgtgggagaaagtggaataaaggacctgaaagaacctctaaaactagcgcccgtagctcagttggttagagcacggcacggattgctggggtcgtgggttcgagtcgcaccg

SEQ ID NO: 42374 - DNA, 1125 bp, Heterodera glycines
ccccggggtcgtttgggccccaacccaaaaatagaaaaatgtgtttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaaatcaatttcacattatttttggagtttctccggggaatttctcacaactatcgaatgaacccgtgaatttctgttaatttttacattttttattgttaaaattattgttgaatttatttttaaaatgtttattttacattttatgctgaaaattaaaaagttgtttttactgcgatttttcatttttctgtacttggggcccaaacgacccttgggccccaaaaagggaagccgaacgcgggggcccaaacgcccccgactcaatgtttagactttggccgattcagtccccgcccataattccgttcaaagcgcaggcgaaagtttaggcgccacagaaggattttttaatgggaataaactatcacaaaaagtgcccaattttccgttgcccaaaattcatgtcataaaattattcttcgatttgttttacctaacttatattcttcaattttccaaaaaaagaaagacggcggtgtttttttcatccttggacttcagcttttttaatttgcctttggctttggcaacagcgcaacatgccctttccttcttggccattccttctgttatttgttggcatggcgtgtccccccccccctcagcacccaatttttcccaccaattcggtttctcccctttactctccccctttaatttgtcattctattgacctctctcatcaaaaaagatcaaattcatttttgactattaaattaaattcaattagcttaatatgtttaaaaagatgagcacggcaaaagaggggaaataggcaaagaaaaa

SEQ ID NO: 42375 - DNA, 1756 bp, Heterodera glycines
tttatacgaggttgccgtttaaaacattggcatttgcccgcaaaaccgaggcttttcttttttaaatgaaagtgagattttaaatttgcggaaatctttcctcaaatactgtaacatttcattctgtttttcatcaataaaatgaaccaactttttaaattttagtgtgcgaaggtgggcagtgggcgagggcgtatgaaagtccagaaaataggtacaggttccggatgctttttaacttgtcattttttcagctggactaagccccggccaataagacccgaataaaaaaaaacaattattttgctgtcaatttttcaaataaattccatataaattaaatgatattattttatgaaacaaaaagataaaaaagtgatatttttgccaaatcattttattttaattttccatttttaagtttatttttttatttatttgtttttcttttttttgcgactgactttttgctcacttgaacagaaataggaattaattcaacgagaatcgaaataaaaatctccgattcgcaagtaattttccttttctttcaaatgattatttgacgcatggcggccatttaaaaagttttgtctgattttttaaaagaattaaaatcggattaatttattttattcaaatgggggaaggcccaccacgaggccgcgaagcggccgagtgagtaccttcggtgcaggaaaattattaaggaagagagttcattatttatttgttttttgcataattaattcataaatatttttttcagaaagggttctgaaacgcaccaaattttatttacatgttagtttaggcactctgatgctttttctatcaaaaagggagatgaataaaattttaaagaatttttaattcctttttaaacaggccaaaaagtcggtaggggctttttagtgaaaattcaatcactcatatttttcgttaattgagcagaagcgtaccaaactttgcagggatactccccggtaaaggactaacttacactgaaatgagcgccgagctagctggctcaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagac

SEQ ID NO: 42376 - DNA, 1355 bp, Heterodera glycines
  misc_feature (1281)..(1281): n is a, c, g, or t
  misc_feature (1284)..(1284): n is a, c, g, or t
tttttgtaccttggtgagtggacaacgacgagcaccgcatatgatcagacttttcagcaaatcaaccctgaaaaattttgacagatatgagcggataaaacagagaatggtttattaagtggcattttgagacagtgtgacattttttgggtaggacccgcccaaaaagaatggcagaactacgtcaaattcactaatttcctagtgaaattttccacgtcatttctcattataaaatctcattgaacggactctaaccgaatgagtcaattaaattttttataaattgaaaatgggagactatcgagcattagtgaataattgaaaagaaatggcacagcgcacaaagcgcagtcggtacgctgatggagccgattaaatacaatgaaagttcgagttcgctcgaacgcgcggcatttttttaatcatttaatttataaaattgttaaatttttccacggggcggggcgaaagggcaaggtggtcaaaacgtcgcggtccaaaatatgggtaaagaataacgaacaatgtagccccaaaaatgaattaacccccaaaaaatcaattaattactcgttcaatttggcggccaaatgccgtggcgagtccccgtgcgcattggccacgttcgggtcagcgcccaggcagagcagcaagcgcgtgatctgcagattgcgcttcgaaaccgcaaaatgcagtgccgtcattttgccactgtccgcctgctcgtcaaggccggcaccgtaggagagcaggcacatcaccatccctggataatggggaaaacttttttttgtttttaaatgggcgcaaaagttgagcaaattggattcagcattttaattaacttatttatgtatgttcctggaactcaaaaattctggaagatttaaaaaaaaaattcttataagaaaaatcaaaattctctatgcttttttgagatttggaaagtcatttcgctattgagaacatttttctgtttttttttctttgttaaactatcgaaatcggagttaaaatggaacgttagcaaatgatttgcttttaaaatttttggctcaaaaattgttagaaatgttttgaaagttaggaaggggtaagaaatttttcattcttcaccatgctattgaagaaaaaaaacaaattttttctcaaaaaatgaaagtaaataatattaaaactttcgaaaaaaaattttttttttgaatgccaattttaaagagcacatttatctagtccggccttaccaaggtcttcacgcatcacgaaactgatgtaacnggngtaaagcccggctttgttcctcacattcaggtccaactctttgtgcttcagctggagcaaactcatcaacg

SEQ ID NO: 42377 - DNA, 388 bp, Heterodera glycines
attgggtgatcactagatgaaaataatgggttaatcaaaactccccttaaatattttttttagaaattttaaatttatcaggctactaaatatttcctaaaacggtgagatcactgaccaattaatcacttcctactactgaacaaatttttaaacatcaataattgcgaatttttggaaaaatctgttaagaaaatcggcaacaaaaattaccaaaaattttttggtggccttattaactagtggcaaaaaattataagaggccgaagaccaaaaaaaaaagagaaaaagaccgtcgctcggcgcggggtgggggggggggttagcccttcccccaccgaagccaagggtctggctacgtccttggggggggggggggggggtaaaa

SEQ ID NO: 42378 - DNA, 1722 bp, Heterodera glycines
  misc_feature (1646)..(1646): n is a, c, g, or t
ataactttcccccttttttttcattgctttttcaattcctttacatttttcttcttgtccaatgttgtaaagttcattcttgagcaaattccattcatacttttcgtattttaacttggtgtgttgtaaatctctctcatttatcattttttctaattcgcctaataattcaccaacaatttgctgtatatctgaaaaataaattttatttttaattttattgtaacgaaatcataaaaagagcacgagagtcaaaatcgagaaaaattttcaattttattgacattaatcgctcataatttatatataatttttaattttaccatgaagagaattgtaattaagttgaactgcattggcaaaattctcaagcttttctccaaaatatggctatatcatttgccaggcttaaataaaacataaatgatcaattttaaattaatttggatttttttaaatatttattacactattttgtcatattattttagataatgatttttggccttttacgctaattaaaatctcattttcatttaaatatcaccttttgtttgtacataattcttttttttttctcaataaaacttggaatttctacttcatttctttttaataatttctcaacaaaatgttcgacattaaaatattttggttcaatttgtacacacaatcgtattgcaaatgtgagaagcaagtggaatttcaccttctcgttcaaatccaaaatctttattttcatgagtgctttaagttcatcctttggtgtaaaattttgaagcgttttcactaaatcaatagtctcagcaattcgaaaattgttggttgcaccaattaaactactaaaattaaaatgaattatttaaataacactgatttaatttaaggatatttattttagcgtcttaaaaataaaataaaaacattttgataaaaaatagtctcttaaaattagtttgaaaaatttaaaaatttaattttgttttatcaacctgtgctttgaaattaatgtaattaatgtgctgagtcgctgctgaacaaccgaaagtgggagagaaataaattggcgtttttcatcataattaattcgtttgaaaatttgctgagagtttcaaataaattttgactgaattttattttttattcttttaacataattcaccttcttttgctcattttgcataaatcaattgtattttaataggtaattatttgctccaaaatattcaaaagttcatttagcgaaaagattttctccgaataagacagtttttctttttgcttttccgcgtaatttttcatttttttaacattgctttcatcgcttatctcagtaatatatgcttttaaaattttgaattcgttcgaatatattaaactttttgtagaataatttttctcttctgtgtcatttatctgattttttaattttaattgataattgaataattactttcaacgcttgtgcaaattgtatcaccgctaaaaatttgttaataattatttaattgatgaatttaaaaaaaaactagcgcttaatcctaatgataaaattcgcataacctttctctttctttctctcctttttggcttctctcaaatttgtctaggatcctcacgctccccctccactcactctccacctntctctctttctttgtttctctcatctatctactttctctctctctctctctcctctttctctctgtgtttccctgt

SEQ ID NO: 42379 - DNA, 474 bp, Heterodera glycines
gggttagccgacatttgctgataatttcgtttaaaggttaaataaatttaacaatatgaactacaatttaagtgaaacaaataaatgattttaaaaaataaaatatatccaaataagtttaaaaaataaaatatatccaaatatataagtgattaatatcaaaatattctacgctataagtcagtcatcgcatttaaacaatttcaatttgccaaagttgtgtgatgcatacaaaagcaacagtgcaagttgcttttcttctttctgaattcgttttggcgacccatcaacacctaacaaaaaaaaatttaaaaaagttaataattatttaatttattaaccataaaaacaaatttggtcaaaagaagccgcaggcgattcaaacaaagcagcaatttaacgaagagattataagccatcttagatcaatacagtatcgcctcgcagctaacaattttgacttttgggaatgaa

SEQ ID NO: 42380 - DNA, 928 bp, Heterodera glycines
tcaaaccctagagaagtgtcgttcaaactccgccattttcgccgcggggcactcttttgccgaaaacgtacgatcctaacgagcttttttcgaaaagcgaaacttccggactcaaaacacctcaaaccctagagaagtgtcgttcaaactcccgccatttttcgccgtggtgcactcttttcgccgaaaacgtacgatcctaacgagctttttcgaaaagcgaaacttctcgactcaaaacacctcaaaccctagagaagtgtcgttcaaactacgtcctttttcgctcgtggtgcactattttcgccgaaaaaggacgatcccaacgagctttttgaaaagcgaaacttttgactcaaaacacctcaaaccctagagaagtgtcgttcaacctccaccctttttcgctcgtggtgcactattttcgccgaaaaaggacgatcccaacgatctttttgaaaagcgaaacttctgactcaaaacacctcaaaccctagagaagtgtcgttcaaactacgccatttttgctatggtgcgctcttttgccgaaaaaggacgatcccaacgagctttttgaaaagcgaaacttctgactcaaaacacctcaaaccctagagaagtgtcgttcaaactccgccatttttgctgtggtgcactcttttgccgaaaacgtacgatcccaaagatttttttgaaaagcgaaacttctgactcaaaacacctcaaaccctagagaagtgtcgttcaaactacgccattttttgtatggtgcgctattttgccgaaaacggacgatcctaacgagctttttgaaaagcgaaacttctgactcaaaacacctcatactctagagaagtgtcgtatcaactccgtcctttttgctgtggtgcactatttttgcgaaagaggacgatcctcacgatctttt

SEQ ID NO: 42381 - DNA, 438 bp, Heterodera glycines
ccaatttgcttttacttttcccatttttcttccgttggcactttcatacaagcatcgaaatagcggtgcttttcgctgggcggaccttccgggtctttcattttcaaaggccgttgatactttttgaatccaacatcatatggcgttatggtgatgttcagcatgaattgttcacttccgtcgggaagaaaatgttcgtacaattcatgccaaaatggtccacatgccggacaaatggcacaaaggcaaaagtttgtttagttttggcacaatgccaaaagtgctttttggcacagcgcctggcgttgtgcgatggaatttggttggtgtttttgtttttggagcgaccaatgtttgggaaacgcactaaaaaataatattattttaaattgtgatttttaaatatcaaaatttgacttttatctttgcacaatttgg

SEQ ID NO: 42382 - DNA, 142 bp, Heterodera glycines
cattttctaatttttcttataagttgcacaatcattttttattttaaattttgagtcaaatctattgaaaatctctcaaaaatttcaaatttcctcaatggcgtcaaacggcaccaccggacaaacttttccataaaaatct

SEQ ID NO: 42383 - DNA, 894 bp, Heterodera glycines
aattttaaaatgaaatcgaacaaaatatttattttttaatttttaatcatttttttccaagatcgcaatgactgaatagatatcatattcttgatcagtaatgatttaattatttggcaaaatttaagacaataaataatcaaatccattcaaagaaaaaaaatgctaaaatcttagcacaaaatgtgctcattctgctcgaattggccgactatttccaagtggactggctgaagtcgcgctgtgaggcgcatctgatcaattgcccggaaattccaataatcgaccgttttttgttgatcgatcactattgtctcgacaattttaaggcatatttttcaaaatattccaattttttaaaaatattttcctcatttagaattactttttgaatttggcggttgacaaattgcgtgcattttacaaggctaaccgcgaccaattgtcgccagggaaaacggctgtcagtgatcaattgttaggggaattggtcaaccgactttgtggatgatttgatattttgcggaaaaaacagtaatgaattggggacaattaattaatggggtgcggatttaagggatgaaaatttttgaaaaaggcacctaaaataggcacgaaaaaatgaaaatggcaaaaagagaataagtattaacaaattacggaaaatttttttataaaaataagaaaaaataaatcaaaggctttctaagattttcttttcggaaatgagaataaatccattaagtaaaattaaaattttaaggtggctggcaagattggaaaattggataaatccaaaatggacaagaatttgagggatgttaatatgctttttaatcaaaatgtcaatttttttgtattttttaacataattataagcatatttgtgccttt

SEQ ID NO: 42384 - DNA, 520 bp, Heterodera glycines
  misc_feature (15)..(15): n is a, c, g, or t
tcaatggcccataantttggggttgattgaccttctccctactctcatcccccgccccgctccgttgttttcatcccccgcccatccgcttgtccatttgacgcgtggccgcccgccccttccgccgattgcgcaaatacttcgggggacaatgactgaatgaatgaatgactccgccgactgacaataatgaccacagcgtccggggggcggtggcggaagagcgccccggggggagaggggcgggagggaccaccgccttgcactctgaggcacgggaagggactgacagctgacggccggcgaccgacagattggggacgtcgccgccgccacggttggtcggtggtcgcgggtttgccgggtaattggccgagaaaaagaaaaaaaaggggggagagggaccccccccccccctccccccggggagactaccccggattaggagaggggaggtgacaacaggtgacccttccgaccagtgacgacccgcgaactcttttgacactctctgtcctct

SEQ ID NO: 42385 - DNA, 795 bp, Heterodera glycines
attaatttattaatttattttgcttttgataataattctttttatgtttttattactgtaataaattaaataaaatataatttaaatattcagtcattaaatttattaattttatttcatctaattaaatgttttcccttttttgtgccttttccatcacttttttttctcttccttttacctttaatttcattttctgttttttaaattaattcttcttttaatttggctgcctaaataattgcctaattacataattaattaattaatccatttaatttccaattgctccccgtaataatccgtcccccctccttttctctcttaacacattcttcttgatgatgatgtgacggtgctgctgctgcttctgatggcttctcccccccccccaatccttcgccatttcccccgggggaccctcttttccaaaaggcgtcaatttccatcccccctttttttgcatagacagccgatacaacaacattattattatcatcatcatcaccatcattattattattatttcattttattatttcatttttgttttggcttccttgggggggggcaacttattcataataaaaacgccgcggggcgactgcgaaacaatccaacacaaagccccggggggagggaaacattggagtggtgggagaggggggggggggaagggaagccgcattttgcaacaaaataaaaaggtttaaaattgaaattcgggttttaatttggcttaaaattgtttttccaaggtgaataaattaatgctctcggaatccaaaaaaattc

SEQ ID NO: 42386 - DNA, 796 bp, Heterodera glycines
aaaaatacaaagaaaaataatgtacaccgcccggcttcgaacttggcccccccctcaaaatgatgcctcagaatccccaatcacacagggattctgaggtcttgactatgtcaaaagtacaatctgttacgtattcgtgatcagcaccctcaaatagccctaatgacatgttttttgaagatatttggtgaaaaaatttttcaactcaaaaatcctatgctcacccctttggtcccgaatctcaaaatcacttttatttttataaaaattcttaaaaaagtgataaaaatgccaaataaaatttatattatagagaaaaaaattgcggatttttgtagtattttacttttcccgaatagcttttcagaaggcagctacgaatttttttctgaaaaatcgaaaatttccagaaattctgaaataacttttttcttttttgaaataaaaaactcaaataaatcccataaaattctccttatttttctctatttttaaagctttattatagttaaatcgatgaaaccatcaccgagttatgaattttccaatattaacccaaatttccaagggccaaaaaattgccaaaaaataaagaatttttaaaaaattccaaaaattatgaaacttaaaatagacattatattcgtactcagcaccttattttaccccagaaaaatatttttcacccccattttcgtccgaaaaaaaatttccgaaaatttctagggggcctagctcgaaaatttttgaaattttccagtcattaagcacaccattcgatagcatttaaattctc

SEQ ID NO: 42387 - DNA, 826 bp, Heterodera glycines
tagagtcaccattgagagcttagcggattttacctactgctagctgccgacaaatctcaatgcctggggaaggaactcataaattatgccgtgagggaatttgaggagggtgtgccaaatgaatgggcggaaggcgtaaatgggagggggggggggggatggacggtaaaaaagaaaaaaaatgacaaaaaaaatataaatttttatattgattatagaaaaaaagaaatatccgttctttttttagtttttatctttttatcaatccgctaggaagtatgactttatttgaacagttttgatgtgttcgatcttctcactgggactcaatctgcagaagaaattaccaatctcaccaattcttcggcttttcaatcacatggacacaatctcagcaactccttggcatttcaattacaggagaatttgatcaccagcacttatctaagcaatcctcggcatttttcgttttcgggctgtcttaggggttgaaccggtagagggcggaggcttggccgcttcgcggcttcacttccatacaattgacctcactttcttcacttttcattggcaccatcggtacccaaatctcgcaaaatcttctttacatcatcggatacgcaaaatgaaaaaaatcacttttatttgttttcccttttctgtccctttttgacattcttttctcgactctgctgataaaactaattatcattatccatgtttggtatcgatcatctcctcttattatgcttttaattggccatattagcgctttcctttttctttgtctgccaattctttcgtgctttccttttctttcattcat

SEQ ID NO: 42388 - DNA, 1351 bp, Heterodera glycines
atgaattcaaaaaattgcaaattttcttgaaatttcccgttacgcttggacctgtcgcgattttgaagcctcgtcaattttttgtgtttgtgattgtgccaagaattttttttgttgactccacagattttgggcaaattccagaaaattgtatcgaaatttgaacacatttgacttagagcaaatcacaaaaatccatttccaattgaatgaaattcattcatttcctccctcttcggcacaatgccaaacattaaatgaaatatttaaatcccgtgccccaagagagaattgtcaatttttaattggggcgatttgcgccaaattttggcgcacaattaatttgcgattgttgtcctgctcgctggcgcgccaattatgaggtcaattcccggatcaattgatgcggaacatcgcaaaccgttgagcggcgaaaatgccaaagcgcagtgagtgagcaaaagaaatgggcaaaatgtgtgtcaataattgcgatcaaattagacacgcattcgatcgatcggacaacttggtgccctttcccctgtccgtcccaatcgagaatttctcgaggaatttcagattaccccctgatttagaggtttattctcatttttgggtgatcggggtgggacagggatggcattccgaggcgtcacaaaaattttcgtaaatcggaattccgaggcgcaaaaattttttcggaaatcatacttccgtgccattcctaatccctattaggggaaatattaaatctaaatttttttgttcaaaattgtttgtaccgtagcctcatacagtacattttagtaacattgctcttctcctatgtaatctgaattttttaattaattaaattgtgaaattattaatttcctttttctttcatggaactgttggatttgttcaacgaacgttcgctggtgtgggaagacgaggaaaaggtgaggaggcaatttgtggcgcaaaaagagatgagattagtcattttcaccgcgcacaccttaaaacaaaacaaaaaaggatcaaattacgaaatgactaatttttgcaatttttctaaaaataattttttttttttcatttttaaaataaaaatttttctttaatttcttaagatgatctttctattcgactacgtcaaaggtgcgttttcccattttattatcatttctgaatattttgcttaagccttggctttgaacccctaagaaaaaaaaaattaatgaaattggcaacattttttcagctcacgattttgtcaaccttttttttttgtctttgatcactgatcaatggctgtgatcatcgattgatcagattaaatctgaccatgattttgtatgtttaa

SEQ ID NO: 42389 - DNA, 1202 bp, Heterodera glycines
  misc_feature (996)..(996): n is a, c, g, or t
aattaaaatcacgatgcatataaaacttggggggaccgaaacgggggggggggaatttgctaaggttcctagtgatgcaaacaagggatggcattccggagccccaaaaattttcggaaatcggaattacgaccccaaaaacgtcggaattcggaaattctttcaaaaaatataataaaaattttctaaatatttttactagactaaattttttaattcttaaccaagtaaaaggtgatttcaaaaaatatttttggtatatttgaatatttgcttaaaaaattattcaatgattttcatcataacttttttcatgtcattttacattttttagaatatttttgagaagagaatattacaccttttttgcgacgtattttttcaaaaatttttgagaacatgggggagggggagaggcccggcggtgccgataggcgtcgccggggaaatttttctaatttttaaagcgatttgttaacaattttgtccataagatggccaaatttagcgattttgaggcaaatttctcaagaataaggatttttagggtccggcgatgccgataggcgccgccgggaaatttttgaaaatttgattacaacttgctaaaaaattttgtataaaaaatgacctttttttatttaaaacaaatttttccaaagagaattaaagattttggttgactccaactagggaaaaattagaatttaacgaatttttgggaaaaattatccattttccctcttgctttttcataaacaaaaactacttttaaataatttatatttaaacaatcgcttcaataaaaatttctttttaaaaatcttatcaaaaattgccgcggattcaaattgccgcgttcgcgaatcgcggaccgaggaaaaaaatgccgcgaatcgcggtcgcgctccacccctggtctctaatgtttatatgaaaaaattactgcaccatcttctgcttttttttgttgagtattttagctatctaaaaccnggtaatatttttttacctttttttggtgcctttttgggagtttttatttttgttttgtatctattttgcggtttttcttactttatattcagggaacggatttatatgttgtgtttttttttgcgcatatgctatcgcatgaaaagctcaaaaatagcatttttacctgttttcctttcaattagagcgagtttttagcacatata

SEQ ID NO: 42390 - DNA, 1418 bp, Heterodera glycines
tttttttttcttctaaaatggtttttaataccatatttagccatttttaaagttttactttttatttagcgaattagaaaaaattttacgaaatttagacctcaatttgaaaaatttatgtccacatttttcgccattttatccatattttgtggtttttggtccatgttttatggccatatttcgcgattttatttatacccatatttttttatgccctagttataacagtttctttcttggtcaattgcctacattcttggtatcaatcgaaagcttaaagccccgggaattcataaacacaagaaaataacaaatactgacattaaaaaaaaattacaacgagaaaacacatcgagtacattcaagaataattttttgtattgctcttagcccagaattttgggttcgaaaaaaaaattctacaaactataagccttcgtttgataccaagaatgtaggcactgaccaattaagaaaaaaatgatgaccaaagaaaaaatatggattattccaaaatccctaccgattatccccccccccccccaaaaaatggatttatcattcatatatactaatctacctatttccttttttcgtatagtggccttgtgataactcaaataatgcacgaactaatggctaccgacaatccgagtgactatctggtggaacagtttgagtcgaagaagaaaagtgccaaaggtgagcatttggaagatccggataaaaaaagtggtgccaagaaagggtcaaagaagaataaaagtgccaatgagcaacgcaaagacaactacaacaagatcatgaagctgttgatgcagcagaagttgcacccgttcgactttttggccggcactgctcaaactgagcaaggggcggaacaatttcaaattggcggcatacagtatataattagtggacagatcgcgaacaaaaaaaaatgggagaaaaaggtgaagggaaaactgaagacacaaagtgaaatggacaaagcgaatgatacatgtggtcgattggccaaattggtggcaaacacgctgtacgacaacaacacggacccgcaggtgctttaggagtacgaaaaaaaactaagaatttcaccaagcgatgggtgcggtttcggatcaatgatcatgcaatcaaaaatctatttcggctcagtcccaaaatccgtgccgaaagcgaagaaaaagtcgagtttttctcaaaatcagcggtgccgaaaggcgccgttgggataaggacagatacgaacccttgtttgaaaatttatttttccaccgttgactcgaattcgagtcccgacctaggaaatatgtcgaattgattacagatatgcgatcagcgacacaatgcatattggtacatattttggattttttagctcctttttctacatttcttcagttttttga

SEQ ID NO: 42391 - DNA, 789 bp, Heterodera glycines
tgtttggtagagccagactagagaaggcaaatgttggcactaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagagacattttttctgcaagaatttttttcgctagcatttcacatatcgcgtgagagtgtgggagagacacactatagaaagcgaatgttgtgaccacgtttgcgctcacatccccacgagagaaaagagatagacattttttgtgcaagaatttttttcgctagcatttcacatatcgcgtgagtgtgtgggaga

SEQ ID NO: 42392 - DNA, 895 bp, Heterodera glycines
ttgtgcaaagcaattattttcttggaggctgtaattttctgtagtcatttgatatgcatctgctatttttctagtcacaaacaccaatatttttcggcccgaattttataggcgtgaaaagtactgatttccaacttctttcgtttcggagacacccaaaatttgaaaaacgtctgtaatttagcttttttaaatcttaattttttgaaacccgaattgagaaaatatgaatgtatttctgcgacgccttctatacttaattcatccataatgggccaaaaattcataagttaagaccaaaagagggattttagtttcagccggaatttctataaaaatgttcgtgtgtaacctatctttgtctattcggataagtaagaaattgaaatattcatattactttgcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtttaattcggcctttcctataagcacaatgtgtttgaggggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggagacatccaaaattgaaaaacgtctgtaatttagcctcttttagatcttattttttgaaacccgaattga

SEQ ID NO: 42393 - DNA, 896 bp, Heterodera glycines
  misc_feature (727)..(727): n is a, c, g, or t
  misc_feature (755)..(755): n is a, c, g, or t
  misc_feature (757)..(757): n is a, c, g, or t
  misc_feature (801)..(801): n is a, c, g, or t
  misc_feature (831)..(832): n is a, c, g, or t
  misc_feature (839)..(839): n is a, c, g, or t
  misc_feature (853)..(853): n is a, c, g, or t
aaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaatttttttgaataaaaattatttaaatgaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttattgaataaattatttaaatgaactgactagataatatttaaaataggttatttctcttcctttcagtatccctgcaaagtttggtgcgcttctgataagtttctgaaaaaaaagttaaacctaaactttttttcctttttaaaaacaaattaaaaatttttaaaaattttattcatctccctttttaataaaaaaaacatcatactncctaaactaacatataaataaaatttcntncttttcatatcaatttctataaaaatacttattaattaattttntaaaaaaataaaaaaataattcctctctcnncttttcnaaacttttttcctnaggagatagctcggcgctcatttcagtgtaaattagtccttta

SEQ ID NO: 42394 - DNA, 1169 bp, Heterodera glycines
  misc_feature (1143)..(1143): n is a, c, g, or t
attccaaccgcattctcagaataattacgccgatactaactgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatcgaccttttatttttgagggaatttttaaatttatactctatcccagaaaaatggctatctctttttttgataaattttatacacatacaaatgctctcgagcatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgataataggaattccaaccgcattctcagaataattacgccgatactaattgttctggaatttgtttctcggcgcgtttgtttgggaaaaatttggaaaattggctatctctttttctgctgcacagtaataggaattccaaccgcattctcagaataattacgccgatactaattgttctgggattttgttctcggcgcgtttgtttgggaacatttggaaaatggctatctcattttcntgctcacagtaataggaattccaacc

SEQ ID NO: 42395 - DNA, 1172 bp, Heterodera glycines
tcactcattttttaattttacattttgacgtcatttacccaaccactgattcaaaaaagttatgaccaaaaatttttgaaactttgtttcctggaaacttgtcgaaatttttaaattttataggctaaaagagaactgtcaggctaatcgcgtatatacatcttataagcattttctattgcctttaggccgaaaaaaagcattatacccaaatttgtcggtgaaaaaccatggcaaattcaaaaaatttctttctagggagcttgaaaacgaaattagtatgttcaaaaatattgccaaatatgatgaaaaggtattaaaagcttgttcttgacacagcaagcaaagcggaaaggcaagaaggacaatcggaggaggagaagaaagtgatcaatagtggttatctgatcaccgctaaccagcaaattgatcagcctcaattatatgtgataggtgatgatcctgatcagcaaacaaaaaaagcgattaattgaaaataagacatttattttgtgccttttaaattccatttaagcaaaattacgacagagcaaataaccaataatgaaagaattgtaggaaaatatcattgaaaacaattgggagagatgattgacgatcacaaaactcaacagaagtaaagagacggacgaagggaggcaaaaaggcaaaagcgcaaattttgaacgagaaaatttttgaaatcgtttaaatgtgaatttgtcgtcaaaaactttgatacaaaaatttcgataatttaaaacgaataaactgggatgtaaacggcaaaacatgaacagattttcctgtcaacgcacgggcatccatggcacaaaagcatcgcctttcgtcgcctataaaaaaaaattaaaaattagcaaaaaaaatctaggaatttgtgtaaacatttgactcaactataaaaatttccaattttgagcatttataaaattttacgagcatatgaatattttaaggccgggtaaatttttaattttagataataaaatttgcattcaattcatttttgttcagtgcaaatggaaactccaccttcacaatttcgttgttcagcaaacccatcacatagaacagtttttgtttcacttcttgatcagacaaagtcgacgcaaaaatcagacggaccctttccgccagctaattataagaat

SEQ ID NO: 42396 - DNA, 1052 bp, Heterodera glycines
cagcgaacgtaaaaaattaaaggaaagaaagaagcgccgttcgctgcattttttcctccgcagaaagagagtaccctaaagagagatgggaacaaagaaaacatacaaaaagagaaatagaacgaaaatttctctaagtgcccctcctctattaaaacccatcataaatttggtttttcttttccaaatattctcccatttcacctcccatttttatccctggtccctttgtattcggacgatgaaatctttcgccttttactaaaggtttccgtgcagggggacgcttatgggttaaacccaatttttggacagcgccttctccagggagggcgcgaaaaattgttcaaggcgcattttatcactctaggaaaaattaaaatttatttttcgtcgggaccaaaattctacacaattgccggtgcctggacccagttgaaaaaattggaccaggatccgaaacccagcgtttcaggaccctccaatgtccggccctatttttgcctaagtatccttacctggcatccagcaccctattaataggtcttgtaaatcccggttccgacaaaacttcatccattttctaccaacgaaaataaaatggcggacaattccaacgaagcgaaagaacaaatggcgaaagcaataatgtattgtttgtatacaattaataaatttatttaattaattacaaagaaatgtcttaaaaaagcaaaaaattaaattttttcgaaattttgatattttttaaaatcaccaaagaccgcgaggagaaagcctaattgacgcgttattttcgcaattttacgccccctttgtcgattttttaaaaattcaaaatttcgcccaaaaaaagcaataatttctttgatttctttcgagaaaaagtttattaattaaacagcaatatgcagagccaaaatttcagctcaatctgtgccgattgttggctcaaagagttcaatttttcttgcgccctctcacctgggcctcgaaaatgctctggcccaccatccgatttgactggttttgtcgaccaacattttaaaaca

SEQ ID NO: 42397 - DNA, 1259 bp, Heterodera glycines
tttttggtttaatttccaataaactgatcaattacccactaaaagtgctttgatcactcaaaaatttttatataaacataggcattctttacattctcgacaattttgtctcgtctgacattttgttaatatttgcacaattgactacttttaagaaaataaattccataataaaattaaaattttcgaattagaaaatattgaaattcctgactgatcggaacaacaaattatgtggtgtaaatgtgtgaacaaattcagcacagttcgctccgaatagcgatcggctgatgggcggcaacatcaataggttctggaaattaattttttttttttgttgttaaattttaattttaatttgtctaaaaatttttttttaaatatttaaaaaaaacaaaagtggacacgcattggttgaccaacctcaatcaaatagtaggactgcaacagcacacgacgcaacgcaaagtttggagacgaacaaaaaagacagaacaaataaaagaaataatcaatcaaaaataatcgatacaacagcgatatacagagtgagagagagagagagagcacaaaattgaaggacagcagagaaaaagagcaacaaagagactacaaatgtacggtaatgtagcgactagcagcagcagaacaaaatacggtaatgaaaacaaacaaaaagcatggtaatgtggaactaagtcggacgagatgcagtgagagtgagttatacggtactgttgggtactgttcactgtaattgccagtgtgaacccaactaggaaattcatgtcaataattgatcagtttctaccattgctggaatgatcaccaaaaataattattctgatcagtccgaaatgggttcacattggcatagtaaataagtccaacaagaatgggcatactgtataactaggggtaccataagatactgtacccaagtggtataacataacacatgaatgggccaaccattcatttctgatcaacatagtaaaggtggcgcgagattcaaaccaaaaaaggtgaaaaaagtgcgcaagggtaaaattgtcaaaaaaatagtttaatattttggacaaaaaaaatcgggacaaattgccaaatataagtaaaccgacaaatggtcaaaaagaaagcaatgcgaaatttggccaaaagcaggggaaaatgtccacattccagaaaataaaaacacacaatatggtacaaatggtcaacaagacagatgaccaaaagtgggacaaatggtccaaaaa

SEQ ID NO: 42398 - DNA, 933 bp, Heterodera glycines
  misc_feature (925)..(925): n is a, c, g, or t
cccagagaaacggagaccactttcaagcaaccatttttcttactctatcgactggtatttttttcggaaaaatttctgttttttcccggaaatagaaaatttttttggcctgagcgggacatttgagtcccgggtccataactcgttaggggttggttttatcgaaaaaacgccttagtgcaaaattgtagagcttttaaaatgctatcgaatagtgtattatatggccggaaattttcaaaaattttcgagctaggccccctagaaattttcggaaaattttttttggttgaaaaatatggtgaaaaatttttttctgggtatttttaaggtgctgagcacgaatctgatgttcattttcagtttaggaaattttagaattttttaaaaattcaaaaatatttggcaattttttggccctcgggattttgggtaaaattttgaaacttcgtaactcatttcaatttaggatgaatttcatgcaataaagctttaaaaatagagaaaaataaggagaattttatgggatttatctggtatttctatcttcaaaagaaaaaaagttattccagaatttctggaaaaattcgaattttcagaaaaaattgcataactcagttctgaaaagccattctgtaaaattaaaatactacaaaaatccgcaattttttgctcgattttatgaattttattttacatttttatcacttttttgaaaattgttacaaaattaaaaatgattttgagattcgagaccaaaggggggtgcacatgatttttgagtgggaaaattttttttcacaaaaatcttccaaaaacatgtctttagtggttatttgggccgctgatcacgaatacgtgatcagatttcaattattacatcgttaagccctcagaatccctgtgtgattggggattctgaggngggggggg

SEQ ID NO: 42399 - DNA, 1653 bp, Heterodera glycines
acacgggactcgtcgtccaaaacaatccgtgagtgatcttctggtcctcgttcaacttaccgaccgcaatttcggtacttgacaacctaacggttggtcgtttggtcgttgttccgctccgtctttgcccattcccatcaatatttttaaaatttttgagacgggatattgcccttctgcaatatccgacgggactgaaagttcaaatgcctgttctctgaaagggagacctccgtaattaggaattggaatcacattagattccctttcatcaagaatggattcccaatcttcccattccctgtcgtagccctttttagcccgccgatttgttgttgatcaaccattcgaaagagacgcgttgtgcctttttcaaatttgtttgcacttcatccggtcgtacttctggtctctgccagacgagttggacattgacagtttgcttcgccaatttctccatttcgaatgaacgttggacagcggccgcagctcccatcaatcgcactgaaaactggttaaggggaaaacagaaagagtccagactttctttggcaccaattaccaccgtttttccatgtgaacgaatttcatttccttttagaaaaggagttaccaggggtaaaatgtaattttcacccatccaccattcttgtggacttgtgattttggccaaattaaggtaaaggagttgattaagcataattcgacctggactgatttcggttaattgccgggcatagatggtttgggggcgaagcatttgcgcagaaatgacggtggctgatctgaaatccccacctctgtatcgttttaagtcggttacaaaaccgggttgaaatgaaccaataaccaattttatcacctccacctttatggcaacagcttgaacgttgatcctgccttgtacgaaccacgagcgcaacgaatcgaccgggtttaagtcataggacaatctttcaaatccctccttccactcaaacttactgaccacaactgtgtctcccatttgaaggcgtctctcggcacttaccaaagtatcaggaattcccataaaaaatggaccttgtccactcattttcccacccacgacacttttcacgtcggtttgacacaccaaatacttcaaaacaccgccttccgcgccatgttcttcatttgaagacattggcacaggcgaagcgatggcacgtggctctgaccacgagacattggagaattgagtcgcagtgaagtcttgaatagtttcgatttcaatattttctgtgtttctttccacagactgaccttctcccaattccatgcctcgttcaaattcttcttcaagacctgcggaaataccacgagttttatcggtttcaattactttctcgacggctaacgccgtttccatgatcaatcctttctgtgtagctgacgctacttcaaatgactccaaattttgcggaatagtctccgtctcaatcaattcaatttgctctgcggctgacgccacttccaaagatcaataaatccggtgtggctgacgccacttccttaccaccaacagctgcgttcgaggcggccatgttttcgttccaacgatgggctgaacgttttttgaccattagaattagaattgcttggattagcacgaatgttgcttaaattgtttta

SEQ ID NO: 42400 - DNA, 1362 bp, Heterodera glycines
aaaaaatttgtattttttaatgcgattggtaaacagaaatttgtaaaaaaaaatgaccaattgattaagttctggggtttttaggatgcttaacatgaaagaaaaaaggttggaatattttctaaaattaaaattttaattaaaataatggtaaagaaaatgtgagggaatattctatccaagtggggaattgaacccaggcgaaaaattatgaaaggtagaaagtttatccaccacaccacatgtgcatgtgtgtaatcacatgactaaatgaaataaataatttaatttttttttctcaaaaaatttctccttcttcaccaatttcctactcttttcttgaccagacccccattcttaccagtgcaaatttttaccggcggtaccggtactagacaaaccggtaacggtaatttcatttttgaaaaaaccggtaccggtaacggtaccggtaccaaaaaacccggtaattaccggccagtaccggtaccggtaccggtaccgctcaaccctagttttgaccgaaaaattcggggtcttatctccgaatagttaatcaattattttgcccaaatttattgcccaaaaattatcggaatatcatttccgatttcaatttaatttgtccaaacccatattctctaaaatttcagaatttcatttccgagtcacattttttcgtccaattctcaaaaaatcttggattcttattccgttttacatttatttgggtccaaattcattttgtcctcggaatctcatttccgagtttcacgtttattttctgtcccttcccatttgtcccaaaattatcggaatctcatttccgagtttcacatttcttttgtccaatccaattttgtcaagaaatttcggagtctcatttccgagtgcctaaattctattttatttttctcctctcataaatgtttaaaaatcgagtaagcccaatcgaaatcccagtcattcccacaaattagggagaatcgtggtcggcctaaaatttgagtaaatttgtgagtttcagagcaattttctgtacacttcaacaatttaccgatttattttttgacaatttggagtctcaactccaattgtacgtgctaaaaggttggttttaaaccgcttttcaccccccccgccggttaagtgttcaaaataagatttagggtcaaaaataagaacattttacaaaatttctttaaaccggttatttttcggtttattcgaacaaaaatgtattatatttatgttttttgtctccccattatcgctttttacaatttttgggaggaaattagcaagttagtgcgttcgtgatcaaaaaactagattttttaaaaaaattttgcggtgaatttt

SEQ ID NO: 42401 - DNA, 904 bp, Heterodera glycines
ccctggattgcatcacctattttatttattggtggtctccgccttttgctcgccctttttgaatttttttaaagttttggcttgtagtcgcataacaggaaagtaccaaattgttttaaattttttaaatccatttttggttaattttttcaatagtcctgaatttaagtcatgtttagatttaaagcaaaaattcgaatttaaacattatgattttcgctcaaaccaggctcggggttctaatttggccaaatggatcgagattcgtgcccaattgaccccgaaatctcaaaaaatatatatttttttgttgatttggaaataaaaaaataatttaaaatatcagaaaattactaatgttaaaatggggctttcctatttactaaaagtctgtccatccatttttacatgaatcatcctctcttttctgttcccttcggtcttcgtactttccattttgtgctccttcccacacattctctgcctcctatttaaacaaatttccaaatatgcactcatcacattccaatcggggataaagcatttttctctaactgcctgctcttcactctcttgctcctgctctcatcagtcggtcgccgcccccctccccccccccccagtccatccctccgccgtgcccgcctctctgtccatttcgagccgtgtactattttgcctatttttctctgaggcgccaaacgtcgccctcccccctccccatacttgaaccctacataagcgataaagatagggctgccagatgagcggatttgtcatcattttgccgagttttggatttcacgcgtgacaaatgatgaagtgggatgtaaaggatggtgaattgaaacggaaaaaagtgaatttaaacatttgcattgtgacaaatttttagatgcaaaaa

SEQ ID NO: 42402 - DNA, 1137 bp, Heterodera glycines
  misc_feature (42)..(42): n is a, c, g, or t
agttgcctttatttcgagcctactctacttgtgcatctttcncaatatggcactgctcccgaattatgaactgttcacgactgatgttgagatattttttttccgattccttatctccaagcatgagccttataagtgattgttcatatccttctcttgaaaaaaattgtcactaaaaaaaacacgttttctgaatattaacaacaaaaatttttagacagtttctaaagaggaagaaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtttacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatcctaaaaaagaaaaaaattgtcagtaaaaaaaacacgttttctgaat

SEQ ID NO: 42403 - DNA, 951 bp, Heterodera glycines
atcgtagattgacacaagttcgtcatgggactaaattttttaaaattatttttctgcgtttaatttaaatattttaattattattttacttgcaatggccaatcccaaagtttggtgctttcttcctgatctactttaatttgattcatttaaaagaattgttttttcttaaatttaaatattttatttaaaataaaaataaaaatatttaaaataaaaattcttttattatttatataaaattgactattttattattcattggccacttttatataggccaaattttacgagagttcatttgagtaaacaacattttccatcaaagaatttgctcgaagctcttttgtggccataaacaatcaacaaaatttggccacgatcaacataccctaattgttgtcgttcagttcagcaacaacagttgtggacctaaaataacaaattttttttgtttatgtttaacaaaaaaaaaatgtaacgaaataatgaacagatttcaaaaagaaaattcagcaaaaaaaaataaaaaattttgttttcataaagcttagcatgttgaacagaaacaactgctgttttattttgaggatgagattgtttgtgtaaatatatattatgtccaaaaaatttttactgatcacgggagttttttttattttggcaaatttttttgatatttttgcgttatttttgggggcagggtcgttttcgtacgggccgatgtcgtacgagcacaagtttttggctataacttttttatttatcgaccaaatccaacattgttggtgtcattcgatagccctatgtatcctctattagcctgcaaaattttgaaaaatttcgttaaggttcaaaaaaagttatggtcagaagaattcaaaaaaccagattttccaactttttttgctcgaacttttttttaaactgaacaaaatttccttggaattt

SEQ ID NO: 42404 - DNA, 1485 bp, Heterodera glycines
  misc_feature (103)..(104): n is a, c, g, or t
  misc_feature (113)..(114): n is a, c, g, or t
  misc_feature (124)..(125): n is a, c, g, or t
  misc_feature (139)..(139): n is a, c, g, or t
  misc_feature (141)..(142): n is a, c, g, or t
  misc_feature (150)..(151): n is a, c, g, or t
aacagaatgagcagcatattctgacacattttggcacttcctattggcattttgtttcgttgggcaatgatgttgcatgcatacctttaaaatgaattcattnntgacattcnngttttcattnntaccgcaagtttantnnttattgtnntttactaaatgtaattgtactcttgcgatatgaacagtcggagagcattgtgtcgaaagagtttcgctttgacttgttacagaatataatctatagcgtctaacgttgtctcgtgctgctgttccagcaagagatgcagcaatgttgccacgccgcttccgcgcgacatatgatgcgagtagagatgcagaggcgacgtcaaacacctgcgaagagtgcgccatgccgcattccatgagacacaccactgtgtgcaatgtgacttatatgcaacggaagttagtattgactaagctacagatcctcgcacggagccaagactcttgaactacatgatccatcggcttatcagtggatctagcgtagaagattacccatctctatttcttgtcacatcatgttctatatttcggaattgactccctctcgcctgaacctgaaacccagaaaaccccgaaaattgatgctattgtcattcaaaatgtccacaaacatttaaagtttaatctttcgctccgttagaattccattgaggaagtaataccaatggaaaacgaatcccgcccaaatttcctcaaattaaactaaccaataatgcccccacaatggaatcctcccttcccccaacctaatctgaaaatcctaagcttaatccttctacaccaaataccgactattcttcatttccttccgacacggctccagtttcgaaaagcaccgaatttgttgtcactatcccagccatgggaccgaccgaacgtcccaaaatacgtgtaccatcgcccagatgactcctcgcccatttcaagtggttactgggattactggttaccaacccaataattcaaatgattttcctttttttccaacacggcacatcccatgtacaccactccccaacgtcgctggcgaagctcgaccgatagcccgtgccgctcaattcgattcgttttgacacccctccccacatacccgccgggcggagtgtcgcacttgtgaccggaagtgttgtgtaaagagatccgaattttccccctctcccgtttgcaactcccctccctcccccgttccttttttcattacgaagcgatcatcccagctttcagttactcacattaaggatataatttttgctttctctttttcatcgccaataaacagcaattccttttgtgaaataaattggggcattcttcgtaagttacgagacttcttcgcccctgcgcttaaaatttgaaaaataacaatgaagaaaaatttttggcttgaagaagcaaaaaaagctcttcgggtatcctcaccgaaatttttttctggatacgggcctgacactg

SEQ ID NO: 42405 - DNA, 653 bp, Heterodera glycines
gtcttgctactcccccaagtaaactcgtatttcgtttccgtacccgcccggggataaaatgaacgatagacgtatctgtggcatctttgcgcatgtgtgctcccaaatttaaatattttttgtcttaatttctagatccttacgaaaaaaaaatttcgagtggaaacgagctgctctcaacccctgtccatgatttccgtcgacattttgcaaagttctctgctcaatatctgtccgatgcatcaacttgcctccaagtcgttcattgtcaccgcgttgtccatgagcccgcgctgcgccgcctccatgtacggacatcgcacaatgctcagctccacgttcaggtctgtccaccggccgccgctccaccatcacctcgcactgtccgctgagcgatctcccgagccaacggtacggcaaccgctgccccggctctcccccccccttctctccccaaagagaatggatgcgattggatgctcaagtgagggaatgaatgaatgttcgggaagaactcacacatttccttgcccaccccattgcttgcttttgctgctccgtttgttttttcccacctctttgttccctacggcggatccgaggacgggagagaaatgattggaaggacgggggagggggaggggggggaagcc

SEQ ID NO: 42406 - DNA, 1343 bp, Heterodera glycines
aaaaacctaccgtatccttcaatgtttttcagagagagaattattaaattaaatatgcaaaattgttcacttgtcagctaattatctaaggtttagttaattttccttaccattagagcgccaaaaaattggaccatttccaatttgaagtgttcataaattttgtcgacatttgcttggtttttatcagtcagaaattcgttttttgttaattgttggccattttcgctaattagttgattaatggcaacattttgtagcaaatttgtcaccatttcatgcacattttctaatgttcgttcaatacttatgccattttcgatttgctcgcaaaaattttgacgcaatttttcaaatttggcaggtattttcttctcatatttcatgctgcacataatgccaaatgcctgtttttcagcccgttcatttgacatttgaccttcaaatattgccgaatttattccattatgccatgagaccgagtctaataatccatagacatacacaaataaatcttaaaatatcttttttaattcgttttaatatttttaaacacttccgtgccattcttccgcttttggcacattctgcggctgttcacaattactttttgaaagtataaaaaataaaaatgtgagtttccagttgagcgtattcattaccactgtcatttaatttgtctaaaaaataaataaattttttagtaattagtgtttttatctaaaatttttgaatatttattcattttattaatttcatttaaattttttcattgtaatataatttgtatattttttcttattttaaaataaaataatttttttcaatttccacaaataaaattatgtgcatatgtattaacgatttacgtattgattatattaagtaaagcaattcagaaaatagggacaatccttgaaaatggatccgctagaaatacctacggacatccctgaattgtccttgaaaatgcgtgcttttcgaattttttaaattttttcaacactcaccttgtaatatgtatatttttcggtttcaataagatttattgcttcctaactcatcagagaaaatttttatgccattcacccattttttttcatcatttgaaacgtgacatgtgacgtaaaaaattttatatattattttcatagtattgaatttttgcaattggttgggcatcttcccatttttatttttttataaataattaatttttattaatttatacaaaaaaagcgaaaatttcttcaaagtttaacaatatacaaaaataaaacaaaatttatttgcctatttataaaagcataatgtgccctatttgttaaagcgatgaatcctac

SEQ ID NO: 42407 - DNA, 791 bp, Heterodera glycines
aaaaatgtctatctctcttttctcttggggagttgaccgcaaacatggtgccaacactttccttctctagtctggctctcccaaacactctcacgatatatgaaatgctaacgaaaaaaattctcgcccaaaaaatggctatctcttttttctcttggggatttgaccgcaaacttggtaccaccactttccttctctagtctggctctaccaaacactcacacgatatttgaaatgctaacgaaaaaaattctcgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacatgatctaggataggtctacgaaacacacacacgataaatgaatggcta

SEQ ID NO: 42408 - DNA, 1080 bp, Heterodera glycines
  misc_feature (15)..(16): n is a, c, g, or t
  misc_feature (55)..(55): n is a, c, g, or t
  misc_feature (65)..(65): n is a, c, g, or t
tcctcccgtaaaagnnttggtccgttcggtgcccaacactcatctaaccatcggnacatatgagntggttgtgtacagtttcctctgggcattgttgaccaggaacagcagcaacaacactgccaccaccaccctcaaaacgcaaccgcccgctgccgccgcctgctgaaggaggaagaggaaaagccgatgatgcaaacaaaaagcaattaattactataattaatcatcatcctctctctccatttctatgtccatccaaccattcatttgtttatttatttcatttcaatttgttttaattgtcttgacaaattgtgaatacacactcgcgacatattaaaaactcgctaaaaaaccacaacaccgccaccttttactttagagcaaaaaacactgacatgagagaagaaataaaaaaatgcctggatttccgacgtttcctttttgggcgtcagaattccatccccggtgaacatgacaacaacaaagggtatagatggttttcatcaagtatttgattttttccaaaattttaagaaaattaatcgggcgttaaaactcatacacagatattgtagagctcaaaaagagctttcgaatgaactattaatttatggagaaggcaaatttaaagttttatatgattttttgaaatttttgatctgggagccctgcttatagtattacattgttagcttttagtctctaataatttagaatggaacgtaattggagcagatgtgctgtgtttttaattattaaattaaacactcaaaaaaagtttttttttgaatcaaactttttttcaaatatatccaaattaataatagttcagttaaatttttataactattttatttaccctgttgtttttaaatgtttattaattaaattatacgttgaaattaagcgtgctgagtcgtttcctaaaaaccgccacccgaagtgaattaaagacaataaatataaaaaatagttattgttatacaacatttataataaattaatataaatctctgtatttttaaaagtttcttattctttaaagtgttcaccaaaaacatgaactgtcaagca

SEQ ID NO: 42409 - DNA, 959 bp, Heterodera glycines
attttcggcactctgataattttagcgttcataatgtcgatttataaaggcgattgtagaaggaattggatgcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattggttgagaagctttttgagcgtagttacgatttttacttacaccatttttttctaggcgtagatcacatgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagatggaattggaagcgttaaaattgtttgagaagctttttgagcgtaattacgatttttacttacaccatttttttctaggcttagatcacatgcgatttttggcactctgataattttagcgttcataatgggatgtataaaggcgattgtagaaggaattggatgcgctaaaattggttgaggagctttttgagcgtagttacgatttttacttacaccatttttttctaggcgtagatcacatgcgattttcggcactctgataattttagcggtcataatgggat

SEQ ID NO: 42410 - DNA, 1003 bp, Heterodera glycines
aaaaaaaaaattaatttatgtgtctattttcttattaaatattttttttactttcaaatctataagatttatttaaatttttataatccctacgaacatttacaacccttctcgtaccccaggcaaattcattttgcgatgtcacgtatatatttattgttcgagcattttttctccctatactttaaaagtatgaaatgatctactaattattatatattttttcctattttttccagttcaaatcggatatttagtctagtatttttattcgcaaccattctttgatattttttcaatctctgtattaaaaaatgataaaaaattatctctttcctcaactaaaatatctttaaatccgtgcaatgaatcaaaatcaacatattttatactgtttttttctttcttttcattaaataaaaaaatttttactaacagaggtaaaaaactacttttttaggattttcttgtaacataaaattttttacgggaacgagaaaaaggcgggaatccctttcgggaatcccgccccattctttttcgtttcccgttgctgttccccgaaaaattttttacaggactctatcacaagttctttaacaaaaatgtaatgaaaaaaattttttgacgcatctcattttttatcgactgttcaaaaattttcaaaatttttccacaaaatatgttattttctttcttgataaaatttgatttttgaaattttatttatgggttaatacatggaaagcaataaatgtttaatgcgaaaaaggggaaaacgggagaccaaagaattggttaatgaaagtttaattctttttacaaataacaaaagattaagaaatttttatttttttccaaataacaaaaaaagataacaataataaagattaaaaatataatgccaaatgtagcaaaaagcttatacaaaatgaaaatagaaaataaaatctggtaaaaagtaatataatatttgcaaaaaggaattttaataaaaaataat

SEQ ID NO: 42411 - DNA, 952 bp, Heterodera glycines
  misc_feature (868)..(868): n is a, c, g, or t
  misc_feature (924)..(924): n is a, c, g, or t
tgctatttcactctgatcagtaattaatgatcagctactcttcctgagagaaaaaattccaccctgctgacctactatacttactgttgatcagataatcaggaaaaacgcacccgacgagtcggcaacatttgccgtcactccgtctgtgccattgttgttgttgctcgtgatgccgttggtgccattattgtgttctgttgtgccgttgttgctgcgcaacattgtcgcaagtgcagcagcccgttgcgggggccataaggcggcagccaacaaaagttgttgttgctgctgttgttgctgatgaaaatccatggcgcaaaaattgctggaaataatttaaattgaaaattttaattaaataaaattgaaaattgcttaaattacatggaataaataatacattaaataagaagaatatgaagaatagaaaattttacaattgatttaattattatgacagcgaaaaaagttgttttattggaatttaagaaaataaaggttcaccatttttctagggggggggggcttatgccagtaaatttttgtaaaaatttcgtcaaattcacccgaaaaggattttcatgggatttcgccaaaaaaaaaaaattctcaaaaatattagtttcaagaaattccttaaatttatttgcatcagttttattcatttcgccgattattgcttctattgcagggaaagtaccaattaagcgtaaaaattaggaaaaatgtgaacaagttaagtttttttaacgaaatgggtcataagatttccaaaaaaaaaccccaaaaattccccagggtataaggttcagaaatatgaaaaaaattccccatcggttccgtaagtaaaacgcgccacaaaaanttcgggggaggggagcacaaagtatgagcagtagcaggcaagctgagctgagctgnagaggtggtggttccggctgcacgaccc

SEQ ID NO: 42412 - DNA, 655 bp, Heterodera glycines
aaataaattttgttttttttccttttttccgatacgagaaatacgagaagaattgattttgacggacagcatatggaatagtaatggaccaaaggtacagtctaactaaatttataaattattgtaatataattgccaaattaatagtacataaaataagtaaatatattttttacatggatcccaattttaaatttgagaaaatcagcgaaattaaaaaaaatatgtttaaaaatcaaaagttaaaaaaaaattggaatttgaattaaaattgttgtaaaatttatactgtctataaatttgtctaactgtctaattcagacaaatcttaaatcagtacacttggtagtcgttatttattacttaaatatataccattttataaatttattttttacagggctcccgtttttttttaaattcgggacaatcgcttaaaaaattcagattttaagcaaaaattcaattttttttttcaatcattttttacctttaagaaattaaaattggtagaatttttgataagacagatcagtacacttggcagtaaactgaatatttattctttcaatagtccagaatttataaatcttttctatacaattttaaatttaagctcatctcattaacgaaaaatatcatcacaagaatttcg

SEQ ID NO: 42413 - DNA, 828 bp, Heterodera glycines
ggccctaaagttatggattgagctcacaattaaggcacctaatagcgcaaaatggcactgaaaaaaggcacaaaaatcccgacttaggcatgaaaaaaggcatttaaatttttttattaatgatttttagggagtaaaacacgtaaaaactaaccaaaaaactaaattttgctgatttattgataattcaattttataatgtttttcaataaggaaatttttaatcaagaaaaaaaatgaattttggcgttcaattcgtaaaggtatattctctgaatttttttagatcatttcttaggggtgtatttttccgatttttttgaatttttaatggaatttttcgggaaaaaacgccaaaaaaggcaccaaatcgctaaaactaatctttgtggtttttttagaatcaaggagcaaacacatgttttttggctgccttttctatcattttccaaaccgtgattgttgttgctgttgtgccaatttgttgggatgaatgatcattgttgttgctttggcacatggctgtgccgaaaatggcattcgaattggtgggaaacgcggaagcggatgacgacgatgatgaggaggaagatgatggcagattgaatgatgccaatgaatgaacgggcgcagactgttgattgcctatgtgaaatgatgaggaaataaaattattaaaaaattgccataaattaatttgaatttataattttaaatcaaatgattttatggaaaattacattacaaaaaagatttagaaaaaaaaatatttccataaaataaaaaataaataaatggaaaaaattaaatattttatcaaaaataaaa

SEQ ID NO: 42414 - DNA, 1264 bp, Heterodera glycines
tctagagtcaaaatatactggcgtccaaagtgctccacacaaaaatgacccccctccactcccccactaataatagacaaaaaaaacctgctgattctgctgattctgctgctgaaaaacctgatgattctgctgattctgctgctgccgctggtactgctcaatctgtgcccgagtccgtccgcccactgtgtccggaataagctccgaaaaacgttcaccctcaccaccgccttcgacaagcgcctcgttaatccaagaatacattaaagtaatttccgctgaactttttaatagggagagttaggtatattgagttgtgtctcataagtagtaacgtttttttatacttcttttattttttgcatgagtgtgtaacagacaaacaaatactcaatattccccctcattgtttatgatctcctcccaatgggggcccatattcaaagatcaataacttttttttaatggacgaatttcgctgattcgacaattaaggaaagggctcgaaatgatggatagcatgcaaccaataaaatataaaatcttactaaaacgctacgaaattatgagaaaatcccataccaacctacatatgtgagaaaatccgataaatttattgaatggtgaatcgccaagagctacataaagttaggcctaaaaaatagggacatcgaccggatatatagcatttgccataaaacgagtctaaaatcttcttcggattgactgtatgtatggcgcgtcaggaaattcaaatttaaatttaagagccaaatgtcattttatagtcacaaataaattgacatttccattgataggctatttttctacaacttgatttttctgaacctgtaatattgtggggtgaggaacacaaaaataaagaattttaggaaaattggtcaattttgaaataatccatcccctgagtttttaaaaaagtggaattggttcaatccaccccaccctgtgacactaaagaactcgctttatgtggtttgtggattttatgatttatttaatgattcaatttcgccgctgtttcgtttatcgtctggagcctagcttttataaaccgaaaacctgagaaattttattcagttttgttccgtgaagcgagaatgtccgttatcaaatcgataaacaaatgcctgtgtcatttttgacactaactatgtacagtatgtattcaaaatccgagtcccgaatcgaaaaaaatttagtcaatttttccaccattcgatatactctactcacaatc

SEQ ID NO: 42415 - DNA, 636 bp, Heterodera glycines
tcaattttctctgttaattttaagatttgaaaaagccctttatgaaattatatggattttttatattgattttttacccttgtcttttaggcacaaaaaaataaataattaattatgcgaatgcagtgaagattttaataattctgtcaagaaattgccaacaaaaatttctcccacaacgcaacaaaaaaaaagaaaattaaagaaattttaaattaattaaaataacactcgttcagcaggtgaattgaaatcccaaaaatggagtgaagtttcttaaacacaaccaaattaaatataatcgtggtgtcattgataaagaattattgtaatatattacaaaaatagataaatttaaaaaaatgttagcgatttgacgctcaagcgactccaaccgaatgcgaccccttcggccatatcagctgcattcctgcagagtagagagcgggtacggaccggattcgtatacggatttttacggatccgtagtccgtaatccgtatttttttgggccgatacggatttatacggactacggattttccggatttttaattcgtaagtccgtaatccgtatcgatatcaagtccgtatcctgatcctgatccgtataaaaattatgctacggattacgga

SEQ ID NO: 42416 - DNA, 997 bp, Heterodera glycines
aagtcaaacaattactcggggagcaaaaatccaacgcagaattaacgtcccggctatagggaagctattcccgaaggattcggtctccccataaatctgggcgcatcggttcggggggactcgccccgaaaacaaaaaaatcgattttttcaagtgtccgtttggggtactcaaacaattatggggagcaaaaatccaacgcagaattaaagtacagactatagggaagctattcccgaatgattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaatttacactaaaaaagttaagcctacattttttggcatatttaaaagcaattaaaaatttttaaaatttataatttcctgca

SEQ ID NO: 42417 - DNA, 1266 bp, Heterodera glycines
gctaactctaagggatataagtgcttaatagcacgttcaataattgatttttccgaaattctgactcttgcggttcgttgtgataaaatttcttctattttccccaatttccaacaatttcttggagtttgtggttcagaaatgatcaccacgtccccaagttttggtgcttttcctggcgtgtgtttgttcccttgatgacgttcccttagacccaataaattggaatctttccaattttgccaaaatttttcagccatattcattgccttttggtaggtttgtactagattggcagtgttggagttctcaaaaatatgatcactgtctaagttctcaacagatctagtgtttatttccaatttatctttgccaatgttgggtaaaattaaatcaatcggtcttaagggctgaattggatttttcatgcagctttgtatggcaaacacattggttgatgtgttttcttgcttctcagacgtggtggttgcgacttgtcctctggccattagtttccgtttttcacataatgctgggtgatgtccggtacgttgacaaagaaaacattttctaagttttcttggacaatttcttgccatgtgattattgaataggcaaatgtagcacattgcttttgcttctatttgttttcgcctgttcacaattgaactaaatttgtcacaatctaaagcgaagtgtttttcagcacaaaactggcatggaaatcgcgacggacttctgcttcgactcgggcttgggcttgatgaatttgattctcttcttcgactttcattgggccatggtgaaccgggttttcttcccggagatcgtccgtatcggctcgattgtgaggatgagcgtaagcttgatccttccgatgaagttgaagttccacgccatggctttggcttaacagcacccgatgattgtcgattatcctttttctcttggtctttgtatctgatagccaagtttaaggttgattccttttcttcactcttatgcttctctcttttggatgtgtgatgagtctgttcgggattagccctttgaactatgtcattgatttgtttaagctgctcaacagccgctttaaatgtttccctaaataggttggttgaccaatccgaaccatgaggcattgtactcagcttgacgttttttaagtctacatatctggtcaacacctttttggacaatttctgttccagactcatataaatttaaagggaactcaaatcctgattataatgctcgagttgtcgg

SEQ ID NO: 42418 - DNA, 1353 bp, Heterodera glycines
tcccttcccttcccttcccttcccttcccttcccgtctcattttgttgttttaaatcagctgaatatatttcgcttttcagccttcgtaatatcaagttttgtgatggttggacaggcccataaccagataaaaaattgttatcctaaagttgtcatttagctgtttccagcaaggttttctgggcagctgattacgaatatgttttacacagcatccataaatacaaatttcctcaaataccagggttagggattcggaattgggtcttattcgtaaatagtagcgatcctgaataattctgaggatttttgattaatattgaaaaactcatacgaagaaaatttaaatttaggagaattagaaattgcagcctaaccaatagtttttcatttcaatattcccgcttaccccccattagttgcgagattaggcctttgactatttacgagcctgtgattgatcaatttttgtgattttttgcctcattgatcattttcatgcttgtaattatgacaattaagcagcgttttatatcctgcctttttccatgtgtttagtataatttacttttggttcaaaaaattgaatttttatttaagttggcggtttaataataaatttatttaaacaattaatggcagcggcaacaacaacaatgccgtcattttattttcacaaacatttttttcaacgaatttttcctggcaaaccttttttcgtgcaagtattttcggcaggttaaaaatgccaatgaaagtgtaaaatcaaaaaaaggtgaatttcatttgaaggcgttctcgcagcaaccggcgacattttgtgccaaaaattcattgaaaagcgcgacaaatgggacccatttcgcacgtcgcgctttgctctgacgacagccattgtcattgtatgtttagtttaagggtacttgcctagtttgcaggacagattccacatacattttcaaatgcctatagatgtgtttttgaaattaatgaaaataagttttaggggatttttagggtcgctgattcgaacaaaaataaaattaaacctcgccaacgtgacccttgacaatactgattttgccgttttttttcaatgcacttttatttaggcacccatccaatttcattggtttcgcttcatggaccgacgtattggcaaccccaaaagggagggcccggctggcaaagtgacccttcagacggggctcaagcgggtgctggtggatcagagtctgatcggttggtcaaccgttgggagactatttgaatttggtgtccttttgttgacagtgagacatcaaaagtttcacagttcgaattccttccatttgtttttgaaaatgaaagta

SEQ ID NO: 42419 - DNA, 898 bp, Heterodera glycines
tggactcatcgctcggcagagaaaatgaggcacccgccccaagttcgagacggttagattgcccccccccgcctcctcagctactccggaaagccagaggactggacgaccttttggggctacccgacatttgaggatttaaaaaaaatttggacaaattttacttttgattttgccagagttaattcaattttgtgaaaataaaagtatttttaaaatacctaactctgtttccgggtcaacagcgaggaggtagcagttaggagcagcgatcacaattggtaaaaatcaaaagcaaccgttgggttcatgagaaagcatttagaaaacagaagaaagaaaatatgagccaaagatcggaattatataaaaatatttttgcttatatgcatttaagaaaggagctcaaaaaattatattttttcatttcagtgtcgttaacaaaaaaaaaatatatttttggaaaaaaatattgcaacacagacttatacgcaatgatttgaaaattgtgaccgatcctatttaaaaatacatttatttttcacaaagttgaattactctggccataattaagagtaattttgtagaattgggctgaatacttaactgtttatattttattttattttttcattaaaatcccccagtcgttttgtacccaaaagtagagtctccaagttgagtatccgcacaagtctcttacacgcttcgagttatacttccatcgagtccatcgtcgataaggcatcccatctatggaaaagtagtttctcctaaaatagtcacgtggttccgaagtccccaccatgaaaattgtgacatttctaagaaaacttccatattaagtatgtttttagtggtggggagaggtaagtcgacgcaaaatcattcaaagagt

SEQ ID NO: 42420 - DNA, 1045 bp, Heterodera glycines
  misc_feature (1043)..(1043): n is a, c, g, or t
ttttattagtgtaatacaatatattaccattggattgtcccacataaagctggaccatgctggaataaagaatttagaagtgattattcaaaaagatgaaactcaaatcaatttggatcactgatgagaaaaaggggttggtcaattgttcaaataaattcaaaataacttaattcatcttatttctgagaatttttttagggtttttcgatatttttttgaattttaattcactttaaatccagaaatacaatattaaaaatctcaaatttaaaacaaattttactgcctccgggatgccataaaaaagctattttttagcacccaaataatttttaaaatttttatgtaaatattaccgaacgagttttgagggaacacgtgggcctggccgaggaacggaaatgtgtccgggatgttgtaaatgccattggaagtgcggatgaagcgcaaatgggtggaagaaatggcaaaaatacgccaaacaacgaaaacgagcagcacaaccgcaacgaagaacagaagcatttataataatgataattataatataaataaaaatcgaaattattaaatttttaaatgtgaaaaatcattaaaatcatattcaatttatttaaaactgatcaaaaattaaatcgaatttaataacattaaaatcctcgtcggtaaataattttaccctttttacagaatgttcattttgaatttaaataagaattagtttattaaatttaaaaaaaaatttttttatctataaattggcatttaaaatatttttaataatttttcccctcatattaatgaatgagtcttaaaataagacatagcgaaaattgaattaacgttattttggcgttgtactgtttttttgggttaaatccattaaaaattgttgtaaaaatggcattgcccttccccaagcaacaaaactaatttttgcgcagagaatacgtcaatttaaaaaaaattaaaaacggaaaatgattgtgtaattggcgaatggtgggcgaaacttgctcccccattttttgttgcaacanaa

SEQ ID NO: 42421 - DNA, 1572 bp, Heterodera glycines
tctgaaacgcaccaaattttatttacatgttagttcctccctctgatgctttttctatcaaaaagggagatgaataacatttttaaaaatttttaattcctttttaaacaggccaaaaagtttagacttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgctccaaattttaatttacatgctagtttaggcactctgatgctttttctatcaaaaagggagatgaataaatttttaaaaattttaattcctttttaaacaggccaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataaaaatttgagtaccccaaacggacacttgaaaaaatagattttaatagttcggggcagtccccccgaaccgatgcgcccaga

SEQ ID NO: 42422 - DNA, 934 bp, Heterodera glycines
caaattttaacgcatccccgtgcccccggtgtgcattcggccgtcggtggtgtccaatctgaaggcgggctccaacgagggcgacttgaacatgaagttgacggagataaagctgatcaatgacatcctgaagaagcacaagcgcagcggggcaccgataaaaccattgccgaatcgtaaaaattttcagtttttggtttttcaaatgccataaaatttttcctcccctcccctacttgtccacctatgtcgtgcactacacactgcccaatgttcaacaaataatccgttttaagaaccgcttaaaaatattgtcgatgtttttttcactcaaaataatcgtattactcgacagaaaatttaaaaaataaattttatggattaattttaagaagtggatacttttttttgttaaattttacattaaaaatctaaattatcttagatttataggaattttccgtggcggcgcctgctggcccgcctgaccaaagccaaattgtgtggctaggctcatgtttttaaacgcataaaaatcccaaaaagggcatagaatcctaaaaatactgataaggcaacaaaaaaagagcatgaaaaactaattttaggttttctgttaacagatgtcaatggggccaccctcattcaccatgttcggtgatgcattattgtcactgcacagatcagcaccggtgggttgtgtactgtttgcaatacgactcggcagaactcatgagaactgcgtcttccacccgctgttttacctcccagagattttttttttaattctagaacagaaatttttaatcatagaaagttttttataagaaaattcaaaaaaaattttatgttgaattactaatttcttatgaaaaaagactctaagatttctttatgaaaaatttctatttgggaattttttaaatttctgaat

SEQ ID NO: 42423 - DNA, 1241 bp, Heterodera glycines
cagatcagtcttctgtcaatgcatttcggcgctgagcaggtgaacagacgcatctacggcttcaaaggccgacttttttcgcaaccattgccaattcgttggcgactgaatgcgtctttttgggacggtgcgtcgcattcggtaggcattggcatactgtggattagttccccttaattcttcacaataagtcaatttttgttttaatagctctacaacacttttttgcacacaaagaatccgttaaatttggattgataattaatgttttataattgccctttatctctcaaatttagccaacggatgccatcgaagcgtgggccgaactcgtggaaatgatgttcagcaatgtccgcgatggtctgtcccatttctcatttgacggtttttgacgaatttttaggcattgccctttcttttaaaaggcaaattcaatataaattgcaattttttggtgggttttcgttaattgcccatttttcttaattaggctattacgcggaggtgcgtcgaaggcgccggtgcagcggcggcgcctccggagagaccaaaagtggccaaaatgaaaagatcataaaatgaaacacatttttttcactttgttgttgattaagagaaaacgaaatttttcagagaattttacctaaatttgaagcattccacggattttcgggtttcaagtcaatacggcacaaggaaaatatattaatcaaaatgctaaatgatggaaggaatccggactactgcttgagaaccaaatgcacaatttatgaatccatttttaactgaattattttttttctatatatttagtacttttcgtaccttttcaaacatattcatatatagaaatttctaatagattaaaaaataatttttgaatggtgccgtttagaagctgttgacaagctacttctaagcgattgaacaacttataagaagttgcaacatgaatattgtaaaaaagtccgaatttttgcatgtttttatttgtaacttttttacatgtcggtatatcgtcgtgatttttggaaagccgatagatcttgttaagctttccaataataccaagtttgttaaaatggtcaacaaagaaaaaagttatgattagggcgaggatttttagtggcaaaaaatcccaaaataattaactaaatagtgacaaaaaaaatggcaaaatagtggtggcaaaaatagaggcgaacaagttccaaatttaggggtgtaattttttaaat

SEQ ID NO: 42424 - DNA, 1211 bp, Heterodera glycines
  misc_feature (90)..(90): n is a, c, g, or t
gcagaaagccaaaatgaagtgatcatcttagacttctcgcgaaaagcaggatcagtgttgtaagcctaaactactaagaaaaaaaattantcatctgaaaaattcaattgacatgtgtgaggccaaggattctgatctgcctcttcatgttgcggacaaggtgaaaaaaacagtagcggacactgcatgccggaagcactgtgcggaccgcaccgaccattgccaactcgaagtccatcgaaattgtctgcggcgcgaaattcggacatcgttccaaaagaagctgtaacatgcgcgtataaattgcggcacacttcgatgttaaaagacagtagcaaattggaaatacccaaccatctctcctaaaaagattgaacattgtgataacacaattaactttactttgccaacaacacataaatttggctgaaaagcgatggcgtcaatgaaaacgtgccgtccgcgtaaatgtaactcatctgatgggcccaatccgccgtagaagctcttccaaaaatgagaatccttaataccggttcaatgatcagcatttaatgtataaatgatgtctcaccgttggggtccattctgtccttgaatttgaaaaacgccggtgcccgccaatagaaattgttcctcgtcaatttcagttcgcttgtaaatacgataggtatttggaatttacaactgctccaaattgagaggttggactcgcggtgcattttcatcacggcgcaaacgtttgattacctaaaaaagaaaataatagcaaaattgtttttggatataaacccactttttttgtggcgtatctgctcggaaaacctgataacacaggtgtgcatgtgttttgcagcacttgagcccgtatagtcccacatgcttggcccgtttcagcaccatgtttaatgagtccaggggcattcggccgccttgcggcatcaggacgggcgattcgcgcccgttttttaattttttgggggaacattcggccgcttcgcagcctcaggacgggcgcttcgcgtccgttttttaattttttggggggaattcggccgcttcgcggcctcaggacggtcgcttcgcgcccgttttttagtttttgggggacattcggccgcttcgcggcctcaggacgggcgcttcgcgcccgtcttttaattttttggggggaattaggccgcttcgcggcctcaggacgggcccttcgc

SEQ ID NO: 42425 - DNA, 1306 bp, Heterodera glycines
  misc_feature (1292)..(1292): n is a, c, g, or t
cccggcaggtcaaacaagctctctgatcctccgcgacgagaccggcaccgcgatcggcgccgtccaaatacaccctaaagccctcgacatgatctgccaccagcagtcggaagcctggctacgttcctaccacatcgaagttttgtcggtcaagcggtgccccagggccggatcctgtcgtgacgactattgcggccttgtccgtccataaacacccgtcccgtaacttaaatcagtccaccgatttcccggcaataccttctgtcaagactcaaccagtttttgggggaatgattgtggtctccccacctcggcctgtctctattaccggtatttcgccaggccgactagcgcgcgaacattcgagctgatcagttgcccatcctggggagtgcagctcgatattcatcttgagatggagtcctcaggcggccaaactcgacagatcggcttaactcttcaccccggcatcaccacccattggggaaatttttccctcacccccctcgccatttctcttccccccctcccgactctcggatcgaaattcgtgacagacggtcgctcagctgccatcgccgatcgcctaccgacagacctccattgcttcgacgaaacggcagccgtcgattttaattgttctgtcgatggacacctgccaagaatgcttctccgatcactcggcaggaagcgtcgaatgccactgtagggatctcgaccttgactagctaatggaaaacccagaactacggctccccattacaacggcccgagtccgacttcataaccggggcccggccatatttgcgacacacgcctattcgccggttcagctccacctcgtcatggaaaacgtcacaattcagctccaactcgccaagtcgctgtgtcgaatagaacagcctaggctgattggatgcttcagctgctcgacgggggcacaattcgactatttttgcccctccgatttcgatcagtcgttggccaccgtttcctgcactgatggccaactctttgtcgttaactgcgccccgactggtaccagggggaggcaaattttgtcttatgaccattccaacattgccactgaatgtgtattgagatgccccgcaggggaaacccgattttggctgaacggaacactacagtacattctcgccgccgccattgtcgcggcaattgctcttattttgttcgtcaaattttcgcccattttcgccacttatcgtctaatttttcgaaattgtgcgggagtactgcttatcccgtcagtcaccccccaaaattgtcgntcgaattaacatgc

SEQ ID NO: 42426 - DNA, 1066 bp, Heterodera glycines
tcaattcctgagataggtaacactgggtacaaaaatgaccccccccgaaaataaggacagaactcgttcaaaaaatcacaactttcaagccggacaatcaaatctttcctttgaaaaagtcattgcttgccttttattggaaattggccttttttggtctgttaacaaatcagttttccgccggaccccctcccctcgcccgttcaccagaagttttatggaaaaactgcacccgcaaaaaattgttaaaaatcttattgtttgatcccgaatgcactgaaatttacgattttgcttatttcctccccaaaaatcgttaaattcgacaatcggaggcgaaaaaaataatacattattgatcgaataattttaaaaataaatctgttctgtttttgaaaaattgtcgatccgagccctgggtttaacgactttttaaaattttcatttttttcgaaaatggggggaacaaggtaaaacaattcagggggatgacaaaaaggataagtaccgtatgtccaacggtttctgtgatgacccgctaataggggacgaatgtttaaacgccaaaaaacgttatgccatccaaatgtctacgtcaaacagagagagggagggagggagggagaggaccaaatttcagttaataaattgacacacgcttaatgaccatcaattcaatttatttcggaacacagatggaaataaagtgataatacacagcaaatgatatatgcatacaaatgtacaatacatcaataaatacagatcacgattatgagacatcttctttatctttgcataaagtgaaaaacttttaccttccaatgggtttttcaaattttcaaaaaattcacaaaaattgtatttcatttaaatcaagtccgggcttcgcaattgtcaaaatgaatacaatattcgtgatcagcgactcagaaaactgacgaatacatattttcatttattcaaacatagacaaaatttaaaaacctgaccctggcgccaaaacgtgggcgccaaaacgtcggcgccaaaacgaccttggcgccaaaacgtgggcgccaaaacg

SEQ ID NO: 42427 - DNA, 665 bp, Heterodera glycines
ttcaaattttacaaaaagtagagtttcaaataagtaaaactaatttttttttaaggggggaaaatttatcttttattattattgcccgggtccgggtacccgaccgggtcccagaccttgatacccggttttttcaataccccggacccgattttttgaaaatccaatactcgctatccgacccagtcaggtctgggtacaacctggtccaaaagtatactggtaagaatggggtattgttcgatttgttgatcaaagtcgcggaaagaaaaaaaaatacaaaaaaaaaattaatgtttattgaaaatatcataatttatcaaacatgtggcatccgtcagtggacaatccgtcagtgaaggacaatccgtcagtgaaggacaatccgtcagtaatggacaatccgtcagtggtaatggacaatttgtcagcaaatttttttagcaatgatcaaaattttgcaaaaatgattgttaaatttaataaaaataattattaatagatttttaacatttctaattactttatagtttaattaattgaccatcgcgagaaattatcatttagttctttaaaaatgattattcataatttttataaaataatacaaattattagccaagcttttttagcgacttaaattaattttcacatgattttaaata

SEQ ID NO: 42428 - DNA, 853 bp, Heterodera glycines
  misc_feature (13)..(13): n is a, c, g, or t
ttcaaaaaattgnatcgtccataaataatttgtaattgatcagggggctcaccaaatttttgccgccccccccccccccccgctcagagcacgacatatatttcaacaaaaaatttgaaaaattgactagagaaatcgtacgctaacggatgacctaatggaaaaaaatccccgaaggagagaatttaattaaatccattccttcgggggtccgtgccgtgtgccgcggggtaagcagtgctggtttcgtttcatcacggcccccatccttttgactagtcagctagcgttgcttaacttgtcagatcggacgggtacgcatgtttccacttttccaagcaccccaccgaaagttgaacgaaataaccaaaatataaggaaaaatttaaaaaattttttattctttagccttattcataatataagcctaagaggaccttgttaacatgtaaataaaattaggtgcgtttcagagcattttctgaaaaaaatatttatgaattaatttttcaaaaaattggaaaagtacgcaaaattgcaatgtctaaaatttttaaagaaacattatgggacagttaaataattatatgaataagcattcttctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgtaaatagaatttggtgcgtttaagagcactttctgaaaaaataattatgaattaatttgcaaaaa

SEQ ID NO: 42429 - DNA, 202 bp, Heterodera glycines
tttcttgaaatttctcaagaaaatggtccggctcgttctcccctaatagtcatatttggtagcagtccgtttccgccctcatggaaaattaaaaaaattcaaaataaaaattgttgaaaattttcagagatttaaaagcatattcaatgaaatttcttataaaattttttttaatttatcggacggggggggggggggagag

SEQ ID NO: 42430 - DNA, 945 bp, Heterodera glycines
tgctcagcagtaataggaattccaaccgcatcctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggatatctcattttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatt

SEQ ID NO: 42431 - DNA, 949 bp, Heterodera glycines
accagccaagcgaggcggcccgccaccgacacattgccacgcagcagccatacacagggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaattaagccgcaggctccactcctggtggtgccttccgtcattcctttaagttcagctttgcaccatac

SEQ ID NO: 42432 - DNA, 815 bp, Heterodera glycines
agcatttcaatcactggcactcaattctcctacatttcaatcactgggactcaacccaccaacatttcaatcactgggactcaacccaccaacatttcaatcactgggactcaacccaccaacatttcaatcactgggactcaacccaccaacatttcaatcactgggactcaacccaacaggatttcaatcactgggactcaacccaccagcattccaatcactgggactcaattctcctacatttcaatcactgggactcaacccaccaacatttcaatcactgggactcaacccaccaacatttcaatcgggactcaacccaccaacatttcaatcactgggactcaacccaccaacatttcaatcactgggactcaacccaacagcatttcaatcactgggactcaacccaccaacatttcaatcactgggactcaacccaccaacatttcaatcactgggactcaacccaacaacatttcaatcactggtactcaacccaccagcattccaatcactgggactcaacccaccaacatttcaatcggactcaacccaccagcatttcaatcactgggactcaacccaccaacatttcaatcactgggactcaacccaccaacatttcaatcactgggactcaacccaccaacatttcaatcactgagactcaacccaccaacatttcaatcactgggactcaacccaccagcattccaatcactgtgactcaacccaccaacatttcaatcggactcaacccaacagcattctaatcactgggactcaacccaccagcattccaatcactg

SEQ ID NO: 42433 - DNA, 963 bp, Heterodera glycines
gttttcggcaaaagagtgcatcacagcaaaaatggcggagtttgaacgacacttctctagggtttgaggtgttttgagtcagaagtttcgcttttcaaaaagctcgttaggatcgtacgttttcggcaaaagagtgcaccacagcaaaaatggcggagtttgaacgacacttctctagggtttgaggtgttttgagtcaaaagtttcgcttttcaaaaagctcgttgggatcgtcctttttcggcaaaatagtgcaccacagcaaaaagggcggaggttgaacgacacttctctagggtttgaggtgttttgagtcagaagtttcgcttttcaaaaagctcgttaggatcgtacgttttcggcaaaagagcgcaccatagcaaaaatggcgtagtttgaacgacacttctctagggtttgaggtgttttgagtcagaagtttcgcttttcaaaaaaatcgttaggatcgtacgttttcggcaaaagagtgcaccacagcaaaaatggcggagtttgaacgacacttctctagggtttgaggtgttttgagtcagaagtttcgcttttcaaaaagctcgttaggatcgtacgttttcggcaaaagagtgcaccatagcaaaaatggcgtagtttgaacgacacttctctagggtttgaggtgttttgagtcagaagtttcgcttttcaaaaagctcgttaggatcgtacgttaaaatcattgggatcgtacgttttcggcaaaagagtgcaccatagcaaaaatggcggagtttgaacgacacttctctagggtttgaggtgttttgagtcagaagtttcgcttttcaaaaagctcgttaggatcgtacgttttcggcaaaatagtgcaccatagcaaaaatgggcggagtttgaacgacacttctctagggtttgaggtgttttgagtcagaagtttcgcttttcaaaaagctcgttaggatc

SEQ ID NO: 42434 - DNA, 1011 bp, Heterodera glycines
tgaaaatatttttaacaaatttaattaaaaaaatacatccttttctatcaattaaaaaaataattaatttaaacttataaaatttatttatcaaaaaaaaattaaattaaatataattttttatttattaactcaacaaaatattttattaattaaaatcattgaaaataacgtaaaaatgcacaaaaaaataatgttacaccgtccggattcgaacctgcccccccccccctcaaaatgatgcctcagaatccccaatcacacagggattcttaggtcttaacgatgtcaaaagtaaaatctgattacgtattcgtgatcagtggcccaattaacccataaagacatgtttttggaagatttttattgaaaaaaatttttcactcaaaaatcctgtccaccccctttggtcccgaatcacaaaatcacttttatttttatatctttttttaaaaatgtgataaaaatgtaaaataaaatttatattatagagaaaaaaattgcggatttttgtagtattttacttttctcaaatagcttttcagaaggcagttacgaatttttttctgaaaaatctaaaatttccagaatttctggaataacttttttcatattgatgttagaaaacctaaataaatcccataaaattctcctgatttttctctatttttaaagctttatttgctcaaaattggtcaacccttaggctagatatgaattttccaatattagcccaaatttccaagggccaaaaaattgccaaaaaataaagaatttttaaaaaattccaaaaattttgaaacgaaaaataaacatcatattcgtgctcagcacatcaaaatagcccagaaaaatatttttcacaccctttttcgacccccaaaaatttttgaaaatttctagggggcctagctcgaaaatgtttgaaaatttacatcatgtaaaacacaattcaatagcatttaaaatgttctacaaaaatgtctaaaacatttttccttaaatcacccc

SEQ ID NO: 42435 - DNA, 757 bp, Heterodera glycines
gttggtgggttgagtcccagtgtttggaatgccggagatttgagtcccagagattgaaatgctggtgggttgagtcccagtgtttggaatgccggagattgagtccgagagattgaaatgctggtgggttgagtcccagcgattggaaagcctgagaattgagtctcagagattgaaatgctggtgggttgagtcccagagatcggaatgtcattgaaagttggtgggttgagtcccagtgtttggaatgccggagatttgagtcccagagattgaaatgctggcgggttgagtcccagcgattggaatgtcattgaaagttggtgggttgaatcccagtgtttggaatgccggagatttgagtcccagtgattgaaatgctggcgggttgagtcccagcgattggaatgtcattgaaagttggtgggttgagtcccagtgtttggaatgccggagattgagtccgagagattgaaatgctggtgggttgagtcccagcgattggaatgtcattgaaagttggtgggttgagtcccagtgtttagaatgccggagatttgagtcccattgtttggaatgccggagattgagtcccagagattgaaatgctggtgggttgagtcccagtgtttggaatgccggagattgagtccgagagattgaaatgctggtgggttgagtcccagcgattggaaagcctgagaattgagtctcagagattgaaatgctggtgggttgagtcccttagatcggaatg

SEQ ID NO: 42436 - DNA, 914 bp, Heterodera glycines
ttaatgacaaaaatgaaaagccgaaaagaagaccaaaataaaaaataaaatatcgctagcaattttaaaatccaatttttaattcttttgtgcggaagctacgaaatggaaatttttgaaagcatttgcgaaattaaatcaattacttttcgtcaatttctgtgtttggttttatttgatcagatgaaaatttttgacttttttacaagcaaaaaaaaaactctcggtataattattttataattgttttataatttccatatttttatttcaatttaatttggttatttgttaaaaacattagttaaaagggaaataaaatggaaatccacggaaattataaataaaaacatgtactattaataaacgtaaagatgagttgccaattgaacataagtattattgaaaatccatttatttggaaaaacttaaaaaatttatcttgacatgagaattgtcttgtcaaaatcttgtccttataaatccgaaacctaaaaaatattaaactacaaagacaaaggattcaaaacctttcctgttattaagtttgaaccgcaataatcagaattattctgagacatcagaatactactgaacatgaattgtaaatcaaaaatacattctgattttgcaatgaaaatcacaactttttcggttattaagtttgaaccttaataatcagaatattctgagtcatcagaatacttatgaaatgaaaggtaaacgcaaattattttgtaatgaaaaccagaattattccggttgttattttgaacctcaatatcagaattaatctgaggcatcagaatactactgaacatgaattgtaaatcaaaaatacattctgattttgcaatgaaaatcacaactttttcggttattaagtttgaaccttaataatcagaatattctga

SEQ ID NO: 42437 - DNA, 1381 bp, Heterodera glycines
  misc_feature (1279)..(1279): n is a, c, g, or t
  misc_feature (1300)..(1300): n is a, c, g, or t
ccctatcaattggaaaattttctcaaaaatttatccccaaaatattttttttattgacaaaatttttaattttcccagccctattaatcatagtataaattcggacaagggaattttaagctaacttttgaaaaccgaaaagaatcggcacttttggtaccaatttggagttttaatgccatttattaataagatttttttcaataatagtggttttcaagatttcctaaaaacaaagaaaaagtcttaaattttacaaaaaccataaaaacatacagtaaaagcctcatttgaaatttagcctgccggcttctcaaaaactacaaaatgaggcaaggcatcacgctgggagccctggattataagttagggtgtcaaattatatgcaaataaaatcgtaaatatgcgcgtaaaatatgcatcaaaaatggcaaaatacatatgcacataaatttttccaaattgggggcaaaatttttacaaattcttcatattcattaaatttaagttaaaaacctcgaaaatagctaaatatagtatgaaaaatcatctagaagaataatcgcaaaaatatagctaaatttattaatttttgaaaatattgagttaaaaacagaaaattgacttatttttgcataaatttccaatttttaaaaaagacattttctaaaatattttcgaaaaaccctaaaatgaaatttcttggaaatcttttcagtccttagaggtcaaaagggccgcttatgcacaaaaagccaaaatatgcaaaatatgcatatggtagtatggcctagaagcttcaaaccacaagctaaaacatgtttttcatgcgtttcaggcctcccgcagttcaggaaaaaaaaatgcatctgcatataatttgacaccctaattataacctttattggttgtcttttctgtcgtctgtgagtgtctcttgtcagggattaattagttcaaaagaattccgcattttgaaacgcttcaaaaacggcttacctaaacgcgttgtgctgattttttagaattttccaccgttttcatcacctaagaaatttagaataattaattatctgtttttggctcggtcactctttttttcttttgtgtaagcaattcttcaagagcattgggaagccagagaaaaaaagaaatagtattttatagtattaaaagggaaagagtaatgcaaatcagacactgaaaggaagcaagacaatgcagagaaaagagcccctcggggccaaaaagctagagaagcaagaaattgaatatatancgagagaagtgtaaggagaanagcgagacagtgtgttagcagacactacagcaccactgcagagacaaaaagcgactgatcactgtgttggagcacagcaaa

SEQ ID NO: 42438 - DNA, 942 bp, Heterodera glycines
  misc_feature (921)..(921): n is a, c, g, or t
tgtccgattgtctgtctatctctgtctgttgttgtgactctgtttttgtctgtcctctcaccctctctctctcttccttactctctgtttttgtctgtcctctcaccctctctctcttccttactctctgtttctgtctgtcctctcaccctctctctctttttttcttactctctttctctctcattgtccttgcggtttttccctctccccctccctctttcgtctcccctctccccccgcgggggcgccattttggacagagccaaaaacaccgcgaaaacacgccgccgcttcacctctctcgctcccccagcagcagcccctaattttctgtgtgtgtagaaaaagcaagtctcccccccccaaatttgccgtgtctccttttttggatgctttttcaaaattagtgaatggacggaccaatggcggaacactgttatgcatgtgatgtgatgagctttttgccgcttcttctgctgctttttctgtaattagttgcgttgttttcgttcatttcgatgtttttttgcccatttcctcccttcccccccccgccgccgtcgcccaatgatttttcatttccaattttcctcactccatttgtatgcacagaaaaagcgcccaccgtccgaaacaaagcaaaaaaagcggattttatttgatacatacataaaaatgctgctgctattggaatatttatgaacgcaaaacgcgtaaagctaaacaatttttttcgttttaaaataatttgacgaattcaaaaaattttattttcagttaaatgtcaattcgctcggtttcgaaactgataaaaaatacgaaaataaaaaatcctctttaaaatcataaatagggcgaggatttttatttgtttattattttttcagcaactttattttagccgaaaatgtttcattnttacgtcaatattcataaata

SEQ ID NO: 42439 - DNA, 996 bp, Heterodera glycines
  misc_feature (103)..(103): n is a, c, g, or t
  misc_feature (111)..(111): n is a, c, g, or t
  misc_feature (116)..(116): n is a, c, g, or t
  misc_feature (120)..(120): n is a, c, g, or t
  misc_feature (185)..(185): n is a, c, g, or t
  misc_feature (220)..(221): n is a, c, g, or t
  misc_feature (242)..(242): n is a, c, g, or t
  misc_feature (248)..(248): n is a, c, g, or t
agtttatgaaaaaaaagttaagcctaaactttttggccctacacagggggaattaaaaatttttaaaaatttattcatctccttttatgatagaaaaaggatnagagtggntaaantagnatgtaaataaaatttggtgtgtttaagagtattttctgaaaaaaatatttatgaattaattatgnaaaaataaataaaaatttgtaaaaatttgatagtnnataaataatttgtaattgatnaggggntcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctagacttttttggcctgttataacaggaactaaaaatttataaaaattttagtcatctccctttttgatagaaacagcatcagagtgcctaaactagcatgtaaataaaatgtgggcggtctcagagcattttcagaaacaaatacttacgaattaattatgcaaaaatcaataacaatctgtaagaattggatcgtccacaaatgctttgtaactgcacacgggctctccaaattcggcaggcaaaggtagaggtgcgaaacatggggggaaaatgggggggggggggcaattggacggcgccgaaatagaaatttctgaaaatttagctgaatttactttacaaatttcataaaaaattcccaaaaattttccccgaggcgcctatcgccaccggcggatccccattttaccatatttggcggattgaagggtgggaggcgaggcaattggacgccgctgaa

SEQ ID NO: 42440 - DNA, 640 bp, Heterodera glycines
accgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaatttaaaaaaatttttaattcctttttaaacaggccaaaaagtttaggcttaacttttttttcagaaactgatcagaagcaagccaaactttgcagggatactgaaaggaaaagatccatctgttttatcacattagcttgtcatcagtttttataaaaaattttcaaaattctgagtctcctattattttatttatttttcaaaattttgaagggcggggggggg

SEQ ID NO: 42441 - DNA, 611 bp, Heterodera glycines
accaaaaatggtcctctttttggtccaaaacggtggcatttgccaactcggccaaaatgcccgtgtacatcacatcctccagaaaaagcacattgattttgtgagtttgggctaagatagccttgacagtttctggggttgccatataaccgccaccgatcacaaatggcgggaacattttcggcgcgtacatttcacgggagacgtacctgtggcaaagtgccaaattttttttacaagattttcaaaaaatattgccaacgaataatttcaattaaatttcgaaaaactggaatgataagttacggattttttttaaagcccattaggactgaaaaattatgggttcttctttgacctatcataattacggatgaacaggatttccgtaatcccaaatccagtaatatataaccctgctgacggtaaggcactccgttcactgaccatttcttgtaagggccatttgagtcccgtacaggattacgaaatccaccaatgccaacaaatagaagcggttttttggtggcaatgtgacggaatttatgttcaatccaatggtccatcaggcgcagatggaccaccgtgtcgtcgtccaccttaaacagcca

SEQ ID NO: 42442 - DNA, 708 bp, Heterodera glycines
accccaaacggacacttgaaaaaatcgatttattttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttctctataatctgtactttaattctgcgttggatttttgctccccataattgtttgagtaccccaaacggacacttgaaaaaatcgatttttttgttttcggggcagtccccccgaaccgatgcgtccagatttatggggagaccgaatccttcgggaatagcttctctatagtctgtactttaattctgcgttggatttttgctccccataaatgtttgagtaccccaaacggacactcgaaaaaatcgatttttttgttttataaatatttt

SEQ ID NO: 42443 - DNA, 769 bp, Heterodera glycines
attccagcgctcggacggctgctcatggccaagcggacttcccgggggtgcatgaagaatgctgatgcagactttgccactttggtcaactgaaagaggggtgggggttgctggaatttgatgaattgttgcaccagccgctttccccactgttcggatgaagaatgtcggtgagtaaggtcattgtcggtggatcatttgggtacgaagccgggaaatggagcagtgccgtgaatttgcatcccgcgctaaaaaaattggggaatttgaggatggaaacatcaatctgcacttctccatgaactcactaaggcgttcccggcagcccgtcgattataatgcgccatttgaagagctgaaaaaagagagagtttgtgggactgaaatggacgggtggaggggctactcaaccgattactattctcgcttcgatatagagaattgtcctaaaaagagatagccatttttctgagaattaattcacaatttccgcagctcttgcggtaatggaaaaaattttgaagaggctctgcggaacgtattagcatcggggttacgagatagaaaattgtcctaaaaagagatggccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaa

SEQ ID NO: 42444 - DNA, 1007 bp, Heterodera glycines
aaaaagagaaaaaagagatttccattttttggtcaagaattttttttgtttgcgtttcaaatatcgtaagattgtttgataggaccagacaagagaaggcaactgttggttcctagtttgcggtaaaaaaatgagaaaaaagatgttcctagggccagacaagagaaggcaactgtttgtaccaagtttgcggtaaaaaatgagaaaaaagagatagctattttttggtcaagaattttttttgtttgcgtttcaaatatcgtaagattgtttgatagggccagacaagagaaggcaactgttggtaccaagtttgcggtaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagatgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagcctttttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaatttttttttgtttgcgtttcaaatatcgtaagattgtttgatagggccagacaagagaaggcaactg

SEQ ID NO: 42445 - DNA, 1127 bp, Heterodera glycines
  misc_feature (54)..(54): n is a, c, g, or t
  misc_feature (88)..(88): n is a, c, g, or t
  misc_feature (139)..(139): n is a, c, g, or t
  misc_feature (144)..(144): n is a, c, g, or t
  misc_feature (196)..(197): n is a, c, g, or t
  misc_feature (257)..(257): n is a, c, g, or t
cccaaacgacacttgaaaaatcgattttttgtttttcggggcagtccccccganccgatgcgcccagatttatggggagaccgatccnttcggatttagcttccctatagtctgtacttaattctgcgttggattttgnctccncataattgtttgagtaccccaaacggacacttgaataaatcgattttttatnntcataaatattttttcagaaagtgctctaaagcgcaccaaattttatttacatgttagtntaggcactctgatgctttttctatcaaaaagggagatggagaaaaatttttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgggggggaaggcccaccacgaggccgcgaagcggccgagtgagtacgttcggtgcaggaaaattattaaggaagagagttcattatttatttgttttttgcaaaattaattcataaatattttttagaacgtgctctgaaacacacaaaactttatttacaggttagtttaggcactcagatgctttcactatcaaaaagggagatgaataaaaatctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaaaattatttacaagttattttaggcactccagatgctttcact

SEQ ID NO: 42446 - DNA, 1006 bp, Heterodera glycines
ttaattcgttccagcattctgtgcttcatcctttcgaggattgctttgttccgtatgttcagaagcattgccctctcattttgcacttccttcggctcgttcgtcttcatttcacgccaaattgaattgggaggtgcgagccattggtctccaacagcgaatctttttcgactattgttttcacattcctttttttccagtgtactctctgccaaaggattcttctttttcccttcgggcggaattgcttcatccttttttgacaaaatgtttgtctcagccgcctttatttcgtgataagcaattttccatggattcgttggctttttctccaccttttttaaggttgcttcgtattccgactttgatttgcttttgttgacgcatgattcgtaaaatcccaatgctccggtcacgaaagtctttggaaattcgagaattctctcttcctcctcgagatccaacgaaatgcaatcctctggtatgacctttccttctgcttttttgacaggtaatgagctttcgtttttcgcttccctctcttcaaatggctttgtaacttcggcacttcttttggcctttcgcccattttatcctccaccgcatgaccttttatcccttcatctggcattcctttgtcgcccatttcttcagccttttcgctcatttgttccgaattggtcagcgttttattggctctttgcccattgaagccttaaacattcttttgcgccgtttgaaggttgctcagaggacccccaagacagcgtcttataaatctcttgttactggacgggggggggggggcctcgccgactcacttttggttttaaagttggcgaaagttattttaaaaagttttgttgatgtttttttaatatgcttgtgttttttttaaatatgtgatcgttaattttcgggaatttttatttccctgaaatttgtccattaatcagaaattttgtcacttatgcaagtacaacaaatttaatttttcttttataaa

SEQ ID NO: 42447 - DNA, 531 bp, Heterodera glycines
  misc_feature (509)..(509): n is a, c, g, or t
agctgcaaaaatctcaaaaaaaattattttttatgaatgaccccacttggctccacattcctttattcgttgatcgccttgattctatttattttgacataaatagcacagattttgactaaaaaaaaccaaatttaggaatttttgggtaattttttaagaaaaaaaggttgtttttttttggggccagcatgccgataggggcgaattttaaatttatttctaacagatattcaccaaaaaaattaagattttcccgataaattttcgtttttttaactatattaaattatcatgatttactcaaggaaaattaaaactcagattttttaaattttttttttcttcggcacatttttccaaaaaaacttgatgaatgtgcgaggggagaggtccggcggtgccgataggcgccgccaggaaaatttttttttaaattttgaatgcaatttgttaacaaattttgtacaaaaaatgagcaaaatttgcgatcttgggatatttttaangaaaaaagataggaatttgggg

SEQ ID NO: 42448 - DNA, 973 bp, Heterodera glycines
  misc_feature (959)..(959): n is a, c, g, or t
tctagagtcaatttagtcgaactatataaatttttcaaaaaattattcatcttttttatggttagcgcatatgtctctagctttatagaaacggtccccgaatctgcgaggaactacttttttgagaatttctatagattattattctgcatgaatccttcgcttaaattcccatttatctcataaagtcagattaaattaattactccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgaccccaaaccattcgaatagcaatcgattgggctgactagactccatatttgcaggaatagcaatggcaggtctatcttaaaggcctgacgagttatgtttcgacaaacatcctgtacaccataaatcgattttcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccatttatctcataaagtcagattaaattaattaccccgatttgttttagaattggtccaaacacgcttgctaatagcttttcttttcgaaaagagaggcgaggaaaaataaaggttgcatccaaatgtaatttttttttacattgaagcatttggatggcttgctgtttacagttggctaagtcttctttgcaagaagcagcacaacttttgtttgggccaacgacccccaacattcgaaatagcatcgattgggctgactagnactcatatttgcag

SEQ ID NO: 42449 - DNA, 932 bp, Heterodera glycines
cagcagcggaaggttgaattacaaattaaaccagaaatgaactttatttgtttaggcgcttgggcatatcacaccgcgcgccatgcgcaaagctttaaatcggccgattgtgtctcagatttgttgtcaaaaatttttcctgattcaaaaattgcggcaaattacggatcaaaacaaaataaatgcgcagcaattattacaagttttcataaaattaaaggataaataaatcgagaattgccgtcaaattgatcgacttagaggaattggtggagagacttcggccgaagtttgaatcatactttattttttggctattactttgatttatagatttataattggataattcaaattttggagaggcacaaattggattgtggcgacaatgtgaatgcaaattttgggggcgctgcacttgctggacaacggaatctgtggtcacttttctcagtgtgattttgccgatattcaatcactcaatcgatgttttgcaggcacaattaaaacgcagaacagaagtggatgaaggttttcgaggcggaattacccaatcttgtgttgctcgtcagcaaaattctttcaattcccgtgtccaatgcatgcgtggagcgcgtcttctttctttgttcagctcagtggactgatgtgcgcaatttattgaaagttgaaaccatgaaaagtctggcccaaatcaaatcgaattatgatctcacttgcactgaaatgtacgatttgctcatttcctcaccaaaattgttaaaaatgatcatgggaggtgaaaaatataatatttaatacatttttgatcgaataaattgtaaaaataacgatttgaagcaattttgcaaaatgttctgattttcgaccccaaaatctgattttttggacccgatgttctgattttgaaaatttttcgatccgaaccctgc

SEQ ID NO: 42450 - DNA, 1254 bp, Heterodera glycines
tttaattgattcggatgtttttatcgcggttaattaccgccccgaaaactggtttgaatcgtgaagtttatcatttctaactcacttctcaaaattgttgataaattgcaaatatatttttccaaaagtctgttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctaaagcaaaacgcgtgcatgtttggaaagtatcgttcataccaataattgagggtttatttttaaatgaaattttatgataaaccttattatctcacaagctatttaattgattcgaatgtttttatcgcggttaattagagcaacgaaaattggtttgaatcgtgaagtttatcatttctaactcacttctcaaaattgttgataaattgcaaatatatattccaaaaatctgttgacactttctgaaaatatattgtatactcatgtattttccactcattagatcttgcaggcagagagctaaatgttttcaagccatatataaaaatatattattgtcattttatcgtgaaaattcagcatattatttgtttcgatcatttctggattatgagatgataaatatctgtatagaaaaagggtgacagttagtgcaagtaatataaaataaccaaaacaaatacaaaaatgtccacatgaatttgatgaaactgattgataggtcttctggttacaataaattccaggaaagacattaagaaaggatttaactaccaattcattaatgggtaacgatagactatcaaagtaatcgaccttcttatttaatccattaacaaatattgcaacccaatgagagccgggaaactgatgagggtccaaattaacaatcaatgatgccggaaatcgtatggccatcggctcaggtagttgatcgcatgagaagcatccaaggaacttgcggctcgttatttcggacgacgttaaaattctggtgatttggttgctgtccattggtcttactgtaccgttccgtcaaagtgaattttaaccaaagaattgagcgaaattggtagataattagacggatcacggacaatccgaaaaggataatcattgcccaaaaagaaatatgtgaatacacatttgcctcttttggtaattct

SEQ ID NO: 42451 - DNA, 1057 bp, Heterodera glycines
aaaaatttgaagagtctctgcggaacggattagcatcggggttacgagatagaaaatgtcctaaaaagagatagccatttttctgagaattaattcacaatttccgcagctcttgcggtaaaggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggtta

SEQ ID NO: 42452 - DNA, 1013 bp, Heterodera glycines
agccaacgcaacaaattgaaattggtgtcatagtaaggagtcagctgatcaaaaaaaccgacatttggacaattcgtccgttcgacatttacctgatctttgaccatttcacgaagagtttggattttgtccatctcttcgggcgaaatgttttgactaattgaactcattagtatttaagtgatctgttgaaaataataaaatatgagcagaggaggggggggggagaagtgatcggcgcgagaaaagtgcgattttgcggggaaagaaaggtcaatcgatgcgacggattatccgccggcgtttgctgagaattgagaagcgatgggcgcccctttcacttcacttcgctgcactttcttaacaaacgcaataaattcatctccttaaccgtaaataattgcaatttcaaataacagaaaatgagaaagaaataattgaaaatgaacgactgatgggagaaaagagggagagaatgggggggggggagagatcggccgaaaaaaggggaggggagggcggaagatgaaatgaaccgataaaaaagagaagacaaattatgacgaatgtttaatctttaaatatgtatgctcttgaaagttgctctgcctaatgcgctgcccgtcaaaatgtcgccgcgtcgaaatgtcgccgcgtcataatgtcgctgcgtcgaaatgtcgcccaagccaaaaattagtgaaaaagtcgaaaactacattttaaaaaattataaaaaactaagttcattatcaatttatcagaatcgcataaacaaataacaaaaataataaaatttgcatgaaaaaggaatatttcaaaaagcgaatgaataaaaaaagggtgaaaattgggattcaacaattttaagcaacatccatgcttgaatcttcctgtttttcgagtccttcaattttctgcgatccttcacctgcagaccaagatccggaataacatcgtgaattccgcttaattgtcccgcccaaaggcatgttggcctgtttttgctcaaa

SEQ ID NO: 42453 - DNA, 1037 bp, Heterodera glycines
  misc_feature (56)..(56): n is a, c, g, or t
ctccctttttgatagaaaaagcatcatagtgcctaaactaacatgtaaataaaatntggtgcgtttcagaacccttctgaaaaaatattgaagaattaattttgcaaaaaataaataattaatgaaaaagtcagaatttcgaaaaattttaaaaacaacaagcgttggcattttttcaggttaagttagtcctttacaatggagaaggcctgcaaaattaggagagattatatcgattttagtgcgctaggttcgatgaaactttttaaaatataagcctaaactttttcgcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaattaggagagattatatcgattttagtgcgctaggttcgatgaaactttttaaaatataagcctaaatagggaagctattcccgaaggattcggtctccccataaatctgggcgcatcggttcggggggactgccccgaaaaccgggggtatcgattttttcaagtgtccgtttggggtactcaaacattgttgctttattgttgcgcattttcgcacagacagtagccaagatcggattcgttgtggaccgtaataatcctcggaaagcatcacgtcgttcaccaacttggggaactcgttcagcagtcggatggcaactccgttgtggatgggcccaccctgcatcagacaacagccaacccaattctcgccctttgccccaattggtccgcttttcctttgctttctgttttcctccccacctccctcctcattttcccacaatctctcggtacttcgcgtcccttttaaaatttgaaattttt

SEQ ID NO: 42454 - DNA, 592 bp, Heterodera glycines
atggaaaaaattccccgaaggagagaatttaattaaacctcctccttcaggggtccgtgccgggtgccgcggggtaagctttgctggtttcgtttcatcacggcgcccatccttttgaatagtcagccagcgttgcttaacttgtcagatcggacgggtacgcatgattccacttttccaagcaccccaccgaaagttgaacgaaataaccaacatataaggaaaacatttagaaaaatttttattcttcacccttattcataatataaacctaagaggaccttgttaacatgtaaaaaaaaattggtgcgtttcagaacactttctgaaaaaattaatatgaattaattttgcaaaaataaaataatagaagactcagaattttgaaaattttttataaaaactgatgacaagctaatgtgataagacaggttaattcttttcctttcagtatccctgcaaagtttggggcgcttctgataagtttcacaaaaaataataaaaaattaattttgcaaaaataaataaataatgaaccctcctccttaaaaattttccctgcaccaaaggtactcactcggtcgctttgcgg

SEQ ID NO: 42455 - DNA, 1661 bp, Heterodera glycines
aggattggaactttttaaatggattgtcattttataaatcagttttttctctataattatggaaaatggcgatttttaaaattaaaattgtcgatcgatcatttcctttcgacgaagtgaagttactttcctcaatttcaacggcacaaaatgtacagatctttggtcccggctcatcaatgggcactgggccgttgtcggagctgatgagtgcgttcgaagtgctcatcttcaccaccgtgtattcccatatgtttgccaaggtggacaatttttcattttattttgccaaagaatccgtttcaaaaaatgccaatttcgtccttttgccgattcagaagggcccacccgtctctctggtcgctgctcaaaacaaatttctgtcgccgtttgccaatggcgcgccgaccgctgccactcgaagcagcgacatggcacagcagcaccggcggcacagttcgcgcccttcgataaatgtgatttcttcgtttccgtccgcctcgtcagtgaaggcgtcgcgttggggcgcggcggtggcggcacagccatcgtcgtcgacgtcgacggcatttcgctatggcacagtgtcggcaagggcggtagcgcatgcacagccgccgtcgcaaatgaacggactgagcccagtggaaacaaagaattaattaattgacagtgatgaaagagagactcattaaatgagttgaatggagccaatttacgctaattatttgatctaaggcaatgataataaataaagtccttttaaaatatagcgatcactcggttcaattggttattcaagcgattacagtggttaaggagaagctttctctaagcaatttgctgagcgattgaatcatcaaaacaaaaatgatataggccttgaattttttttcctaataattaagtgataaaataaacagaacatcgatgcactttttttctctatcattattagagaccggacaactggggtcggagggatcccgagtcgggatcccgactgaatcccgatcaatcccgaatattttggaaaaacgttcgggacggatcccgagtcgtgatcccgaccgaatcccgatcccgatcaatcccgatgaatttaaaaaatcgctcgggacggatcccgaggtcgagatcccgaatttaatcccgcgggatcccgaagaaatcccgcgggctcccgatcccgtccggtctctaatcattatgcataatttcgtgcaaattctaactacagaaaaaagtttttgtgacgaatctttagtagcggggatgagaaatagtttgccaaaatgtgaggtgatttttctgcactctctctcttagggttcgattgttttaaaaaaagttataaatgccaaatctctccaatttttcgttttgaaccagtccattttttgttagcgtccaaatgtgatgcagacaatttttgaataatttcgtttggactctgctggttaaaatcccttttattaatctgagctatcttatccacatatcgctagtgatttgtgagaaattatccatagcaaattcaaacccacagaatcgagcgagttacagtattgtgaaagttttgaatttttttacgacacgatagcattatacaaaaattctcattcgaaggaattactttgctttgggcagtttcattttat

SEQ ID NO: 42456 - DNA, 448 bp, Heterodera glycines
agggatactccccggtaaaggactaacttacactgaatcgcccgccgagctagcttggctcaaaaaaattttcgaaaatctgagtctttcgtttttatttattttttgcaaaattaattcttaaatattttttcagaaagggttctgaaacgcaccaaattttatttacatgttagtttaggcactctgatgctcagttcatttaaataatttttatccaaaaaattttttttgggttttcggggcagtccccctgaaccgatgcgcccagatttatggggagaatgctcagttcatttaaataatttttatccaaaaaattttttttgggttttcggggcagtccccctgaaccgatgcgcccagatttatggggagaaaattttcaaaattctgagtctcctattattttattttttttcaaaatttgaagggcggggaggggggg

SEQ ID NO: 42457 - DNA, 1241 bp, Heterodera glycines
aatggaaaaaaatccccgaaggagagaatttcttttaatccattccttcgggggaccgtgccgggtgccgcgctgtaagcagtgctggttcgtttcatcacggcaccgaaccttttggctagtcagcaatcgttgcttaacttgccagatcggacgggtgcgcatgattccactgttccaagcaccccaccaaaagcgaaacgatataaccaaaatataaggaaaaattttttaaaaaattttttctccatcttcctttttgatactaaagcatcagagtgctaaaattaagttgcaaataaaatttggtgcgctttagagcactttctgaaaaaaatatttatgaaacaaaaaaatcgattttttctagtgtccgtttggggtactcaaacatttatggggagcaaaaatccaacgcagaattaaagtacaggctatagggaagctattcccgaaggattcagtctccccataaatctgggcgcatcggttcggggggactgcccagaaaacaaaaaaatcgattttttcaagtgtccgtttggggtactcaaacaattatgcggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccgcgaaaacaaaaataaatcgattttttcaagtgtccttaaagggactcaaacaattatggggagcaaaaatccaacgcag

SEQ ID NO: 42458 - DNA, 947 bp, Heterodera glycines
aacatctaccgaaccgaaggaagatgaggagaatgctgacgatgttgaaatattcgaggaattgcctctcacaattgccacaccaaagtaatatttaaagagatacaaaagtaataatttctttttcaaggcggaaggaacgaaatgttttctgcgaaaagcatttcccaacaaatgcgaatgccgttttcgctgtggctgacaatgaaccgcttgaaacacatcccaaaactccaacagcggcccccgggggaatgaccccccagccgaatgggagagtatcgccggtggcctgtaatatcatacaaaaggggtaagaccatcaaaaggctaggaatctgtttcgttaagtattatgtaacaaagttaccttttaaggtcggtaaaggcgaaggattgggacagaatagtgaaaatcacacaaacgccgttgtctctgcgaaaaagtatgggcgacagcagcaaatgcccactcagacaacaacgctcttttgaacgagctcggactattttgtttccttgtgaaacgacaccgcaaaccacgggcaaaaaaattgttacgcgttcagttacgaaaaaattggacagaaaaaaagaggacgagggacaaacgacgccaacacgaaaaaagacggacgaagacagaccaaatgagaagtgcacgccaccaacaacaaatgtggacagacccaccgcacttccattgtccattctgaagtcggacaggaagagatcgcgtctccccacggactcattatgtatttctggaccaaggacaattcgtatcgtactgtcctcctttttagaaaatattcataatttttcgcaagtaatcagattatgcatttttgatatcattatataggactttgttcaactaatagacaagttaaaaatcaaaaagttcattgttcggggcattacgaattggcccagtacggattggt

SEQ ID NO: 42459 - DNA, 1560 bp, Heterodera glycines
tttttatttaaaattactggttcctaaaaaggcggaactcaccacaggataccaaatcatccaattcgttatgtaatcaacccctgaatttatttggtgacaaaaattactataattgcacataaatcggaaaccaaatttattaggcgacaaaataaaataaaatcggaaataaattgaaagagatttgtcttttaataatacaataccaagtctatactgagccaaacacaatcaccaattcgtacatggtagaacatcgaaatgtatccaactttcttcatgagatttgaattgtagaggtggtagacttcgttttcatctgaacggatttgaggatggattccaccgcgcaccatcactctcgccggctgcttcagacatgcgggtagatcggttggctgcattgtgcccaagctgatgcgtttgcggacgctgaatgggtttgatgacccaacgacgtactcaatcacccgcccacataatttcgagaccgcagcgcacttaaaaattcaattccaaaataatatttatctctcttccttacatcattatttgtcgtatgaattaaaatgtcgtttggagccaaatttttgttgtattttccaaagcataaatactgtagaatttccataaagaattcggccgaaaatacctgctcattgacagggaaatacgccgaatccaaatagtcttgctcaaagttcagtttcctcacttcacaagcagaattgaatttcgcattaatgacagacttaaaatttttttcaaaaatgtatggaaactaatgaccaaccagtcgattcttgaatttattgtactccttttctcttgactgacgcaaaatctcaaatttccaattaactgggtcaatcttcgaggaccatcgatttttttctatataattaattacaaaaaataaaataaaaagtcattaatacccgctattccgtcaaacaatcgcatcattgggaggcacatgatcagctctgagactaattcactcggaagttttttagacgggaaactctgatgttccattttgacaaaatattataaatgattcttgatttttgctgattgccgaaaaacgtcgagactggtacaaaagtgtaagctcggagggacctctaccatgaaaatgggcgtggtttatctttcaagacaatccgttctcgaaactcactcattttacacaccttgtctattcgagaaatcattttattttttttacacttgctcccgagtcatcttttcttccttccctccctctttctcatctatttatttaattattctttagctgataaatacagggaccatataattaataaaaacagaataagggaccgtataataaaataaatttattttttttttttttttgctgttaaccagggcgattgcttatttataaagcatcgtttatcctggcattagttgtcttttagaacttgaagtggatcagtttatcattattaattttcgagctgtttagatgccctgtcgtcttgtgcttcatgggtggcggtgtgcagctcatcaggtcaaggttggttt

SEQ ID NO: 42460 - DNA, 563 bp, Heterodera glycines
agctttttgcttggtcaaattgcgaccatcgatcgctttgggtcgcgtgcgcacgccgttggacgtgaaatattcaatttttacacaaaaagttcggctgccctcggctattccacaaatgccttttaccttcggcagtacactcaggcaaaaacaaattagtgtaattagctttaatcgatttatgatcccatttagctgatctccgacctcgcttttaatttgcccattatcaccgaattgcaacacaaatcgtcccggggttggcccattcgtttttacattcatggccatgtgaatgaacagtccttcccgcgcgaagtgccaattcacggtcagtgccctttgctaaattggtagtgtatatcattggtgacggcgggattaatggggacgggggataaaaagagcaaatacggtagattcagggaacaactgtaatttaaattttcaattttttttgccctttattgaaaatgcaaacataaaaataaatatccaacctccctcctccctgtacgagtaagtccttttacaatttattttcacttcactgctttgaa

SEQ ID NO: 42461 - DNA, 1089 bp, Heterodera glycines
  misc_feature (975)..(975): n is a, c, g, or t
  misc_feature (1053)..(1054): n is a, c, g, or t
ttgtatgagttttgatgacacccaataaatgtgaatgagtaactcacattggacagggcacctttgtacatgccagtgaaaagtccctcttttttgatgattttgatggcacagtccaaagtgtctaaaaagagcgaatgaaagagcaacaaataaatgatccattttttattgcttgctttggttttgttcaatttttaccattttttcttggaaattagcaaaaggaatcaagaaaaccctctgaaattcagaaatttaaggttgattagtgagggtgggtgataaacgagtttatcctgagaatagagagcacacttactcttgtacatgatgtccttgcggcccgactgcatcatcatacgacgacggacggtgtcccacgggtaggagagaacgccggacgacacggtgacgacctgcgcaatggcccagttgacgaagaagttcatctgcttgccctccggggagaagagcattttggcggtgtcgaagcagccgaagtaagcggcgcggtaaatgatgatgccctggacggagacgaagaagccgcggtagagaccgatgggaccgtccgacttgaggatcttcatgatgcagtccgccaaacctttgaactcacgggcatcggccctaaagggacattttatttaagtatttttaaaattttaatctcactttccaacatccgctgccaaacgcgttcgcgcaaagtccaaagggtacacaaaacacagcgaagtggcgccagcggcaccgcccgaagccaaattcatggcgaagaacttcaagaactgcttctccttgtccactctagatttaactttcatttaaccattcaatgttgaacatacccttgcgtgaagactcgcttataagtgtccttgaaggcgaagttcagcgcctgagtcggaaagtaacggatgacgttggccaggttaccacgccacaacgacagaaagccctgctccttgngaaacacgacgaggacgtcgatgatgcctttgtagcgcttgtccgcggtgatgtgaatggaagcatcttgcacctaanngcatacatagtttgaaaactgtgatacataaagga

SEQ ID NO: 42462 - DNA, 1458 bp, Heterodera glycines
atgttccttcattttgaccaccaattcttcatgttccattatcttttccttgataaatggtggtggcagccaaaaaaccggcacatgactgaaccgcttcaacagctgctcaagtctccccgctcgctccatcacattttcgatcgtctcatctcctcttatcgagtcccgcccaaccatcacgatggcaaccttcactttggaggagagaatggcgccgtcaaacgccctgatcacttcggtgattgttccattttcggcaccgataaattgcgatttgggccaaagtttgatcagttgtttggctgaggaatcgccgatgatcactgtcgccgtctcgaccaacagctgtttccggtggatgattgtggctcgcactttttcaagaatgaagttggcttttttcagcatttcgtgccatcccatcttctctgattcgggcaattcggcgacgacgttcggcattggcacttcaattggtgtgtagcccgtcttcatcagcttctctcgcgtgaccgcacatcgttcgacccatgccgtaaaggcactctcaatgtcattttccgtcgggaaaaagccattcttcaccaggtcttcgcgtccgccactgtaagcgatcagttcgaagccgacgggcgcactgatcacaagttgtgtcaacttttggccgccggcgactgatgaaactgcgcccgatttcagtaagaaattactgaggagagccttcattggcgtaccgatcaccttaaaaccaacttttccttcaacattttccatcttttcttctcttccaatcactttaaggcctaggccggccttctcaagcactgggtcgaggtcggcagccgttaattggacacaatttcgatgttccgtgccgagtccgccacattgcatctcccagaccaaaggatggtcagcgttgtccttcactctcacctcgccgtcagctgaatttgcaattgtcctcaattgcccaataaaaagctggcccatattttccgttttttgaaattcgtccatttttatggttccatttccaaatttaacactttttgtttgtgtaaattgtccattttcttcacacgtctcaatatccatttcacgatacaccaaacaaactacactcagcaatgcgttcaattggtttttgaagggatttttaccccgagggagagtactaatatccggtacaccttccggaactttcactagccgctcgattggaacacttataggttcaaaattcggtttatcgactggaaccaattttgctgacgaatcagagatatccaaaattttatatggaccgaactgattccaaagaagttttcggtgggctgcgcgggtatttacgcccggaaatatgaccattactctctcgccgattttgaatttgtctgctgtcacttttgggtgtttgtcatagtgatttttcatctttatgcgcgcaatttc

SEQ ID NO: 42463 - DNA, 1109 bp, Heterodera glycines
  misc_feature (119)..(119): n is a, c, g, or t
ttagtatcggcgtcattatgctgagagtgcggttgaattcccttgactgtagaccagaaaaagagatagccattttccaaaatttcacgatcaaatgcgctgagaaaaaaattccagancaaatagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattaatatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattaatatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcgggtggaattcctttgactgtagaccagaaaaagagatagccatttttcaaaattttcacgatcaaatgcgctgagaaaaaa

SEQ ID NO: 42464 - DNA, 1115 bp, Heterodera glycines
ataaacatttttttacttttaatcaaagtaatatgttcttttaaaagttttttgagtatttttggtcacagtttatttagaaacgaatgaaatttttgcaaataaagagaaagcatttagagctattaaacaacaaatgattaatgtttgattgcgcttctgaataaagtcatttcgaatttttaaagaaaaaacccaaggtggcagatgtgcaaacgacctagcaccctttccttagctctgctgggtgacccggaggaccaaaaaaaaattcggtagcttaaattcggtatttttttaatttttagtttttccaaaatgcgtcaacatttcattaatttttggcacactttttgccacatttgtgaacattatatgatggtccaacaggcgcctaccggtgaaattttaataaatttagttaggaggttaggagtgagtatttattaacaattttttatcgaaaaagtttgtttttcttttggaccatacataatatttgaaacacatcaaaatttggaaatcggaatgcggaatctcctgacccatccgctaattataaccacacaaaaaaaaagaaaaaccaaaaaatgaagatgaaaaaatttagatttattttttttattagaaatcttaaatttagaatataataaatatttatggaaaatgaatttaaattaaaatcaataaaaatgtgatgtcattttcaccctgattccataatattattgattattaaatgtgacataatgccactaagaagtgagtgtttaatcatacatacgtattcaattgtttattaaattaagaagaaatgcttacgttattgcacatttattaattttattaaacatacataattattacattttccctaagttctgttgtgtgtatttttttttttataatattcgtttatgaaaatatttatgaagtaagtgccggatatcctgtttttatgacattaaaatttgtcatagttcgtcatctctgtttctttttttgcgtaaatctttgcatatttaaaaagagtttcatattaatttttattcacaatttatcatttgttttcaactactcaaaagtattattaattctctaattaaggctttaat

SEQ ID NO: 42465 - DNA, 996 bp, Heterodera glycines
cctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcaatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgacgggcacaggtcgttcgagctgacttgtggacgctgcccaacattacggggcagctgcctcacgagccatgctttttggggtgcttccatacgtttggagctgtgggataccgctcagtgctgcacatgtt

SEQ ID NO: 42466 - DNA, 760 bp, Heterodera glycines
ctattccggaaggattcgagtctccccataaatctgggtcttcctggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccctcccacgccccttcagagcacgacaaatatttccacaaaaaattttgaaaaattgactagagcaatccaaacgctaacggacgacctaatg

SEQ ID NO: 42467 - DNA, 1036 bp, Heterodera glycines
  misc_feature (45)..(45): n is a, c, g, or t
tcaggagagagaccggcgatgccgaccgctgcccgtcaatttcgnacaggcgtcgcaaaagacatttcgccaaaatattaattttaaattcaggacagtttcagtgttgaaatttaagcttgattttagcccggccaaaatgaccgggaccgggacttctcccagtcccattggtttgtccaaaaaaagtcccagcaaaatcccggtcccgtccgggctcaatgaaaagcaactaaaatcatcaaatttgaaaaaatacaatttgtaaagttaataaataataattttggttttaagagtataaaaagcatttaagactttcggatcgttaacaaataattaattttagcatttggttaaatttcggtcaatgacttgagtctcccgttcgaaagttttagaattacatcaattcttcaattttatttgagatgaagagattatggctgataaaattaacaaaacaaaaaggtactgatcgaagggctcgacatggacctggctggattcaggcctggatttttcctttaaggccctttttggcaacctggattttgcatggaattggattttagtccagaaaatccagcaggtctaagtcaaatatgaaaaaattccaggtccagcaatgcgtaaaaaacctttattttctgcataatatttttgaatttgttatttcaagtgaactttctaaaaatccaggtccaggcctggttggatccaggccattacaagtctggatttttcctggaccaggattttcctggatttttgtccaggaagtccaggcctaacattaaatccagaccagtttcttaaaatgtagagctctactgatcagtgcaaattttacatttcgtgaaaattatagtttgaacccgattttggacatagacgcaaatgtccctacagataatcagaaataattaaatattttgctgtagaatttatcattggtgcaaattaaatcaaaaatcatttgagtggtgccgtccatttgttctctgattagaaaatgtgttctaagtttgctgag

SEQ ID NO: 42468 - DNA, 768 bp, Heterodera glycines
actatggggtcaagcccagtgttagactaaattgttcctcacgccaaatagcgcatttggcgtaaatttttgcgcgttatttcaaaatttacactggtaaatgccttttttgtattttttattttgatcagccataactcgcttcattcctaacgaaaccgaacaaatttggtatctaaaaaaagattttgaaaaggagaaactttttctaagcgaatgttaagtaatttgacatctcataaaaaagttacgagagtttcaaatttttatcacgttaaaactcagctcattgactgctgattttaaccaaaatgctaaatttattcttttttctattgattctaaatgttcaaagtgattttgtacccttataaccaaaattattagaattttcgaatttgatgttttttcatgtgttagagacatgaaaatagtacgccaaaattagaggaaaagaaatgcaaaattttcatcatcccttaactttaaaataggatagaaattcattaaaactttatagaacattcgatgcagaatttttttctcaatcgatatgcaaaatttggtgtggatttaacaaacagaaaaaaagttaaacaggatgaagtaaatgttgttttttacataattaaaatgaagagatagtacgccaaagagagagaaattacaaagaaaaagagaaacgacgagatagtactaggcttttctctgcacagtggagttgacccatagtgctcacttttctttgcttttggcattatgtcttaa

SEQ ID NO: 42469 - DNA, 722 bp, Heterodera glycines
  misc_feature (673)..(673): n is a, c, g, or t
aaatgaatgaatggggtcttacatagacaaaccccaatccgccttggacaccaaccattttgaaggatacaatggcaccgatcatccacggctcctccctgctactctccacgaacacttggtcgcccggtcggtagacgactccttcgtgggactgaaagcactcgtattccatgttctcgcgatgtttgtagatgacctaaagaggggaaaacattggggaaggaaagattgtggtgactttttattgttttgccccttttcaattttttaaatgacgcactttttcatttttataaaggatttgaattacaaattaattcggtttgtggggggtacctacagtattaaaatattttgttgtggggttgggagggcaggggcaccacgagggaattgaactaacaaataagtgtgaccatccgccgatttcggcgtgcgttaccccccccccccccccctctctctcccttttccgactcttttccgtttttttttgtccatctctgacccctctcttttgacgccttctcgtcgcttctcctccatcgtttggcgttgtgttgctgccgttgttcctggcactgttgttggccatggtgacgtaataaaacggctctgcgtcccattgtccgttcaagaagtcgtccgccagttctttgacccgtgtccnctgcccaggaaagtccaacatttgcttgtcaatctgccaacaacaaatg

SEQ ID NO: 42470 - DNA, 1160 bp, Heterodera glycines
agagaatcggctgattcgggttcatttcgtttgcctcatatcgccttttattgaatgttttatgtctcagaaaacattgtcgtttctttccacgccgtttctctctctgaactttcccttggcgaggcgccgtcggtccgttgccccgaggggacgcgagtggtggcattaagcgaattggcagagagacagctgaacgtccatccgatcaaatatttctctggcacaattggcgtgaaaccattcacgcagaatcgttttgagtatttggtcagtcaaaagggtttattgatagaacgtccaaggagtgtttaggtatttttcgacaatggaatcgacgaatacgtccgcccggaggacattcggttgcttacggaccaaccgacggaccaatccggcaaattccaaccacgccaagcgcacacgaaggtggagtcgacgaacccagcgaaagccaatttccttaggtaatccggcaatgtttttctgaattttgtcgtcccattaggcagtatttcaatgcttaccccgattggccactgattcagctgaagaaattggagaatacgcagagaataatggtaatattaattttgtttcgttaattttaatatgcaatttttcatttgatgaaattttaaacgagactatggcgaaaataattttattttaaaatttcttaaatccttgtctttttcactgataatttacccaagtatttattttcctatggaaaaagcccgtgccgatttaaaattcttttcaggcaattcgaaatggggtcaaagagtcagccttcgttttggatgtcgatcgccaattgagccttcttcggttccccgggacgaataaagttgcgtggcccttgacgaaaaacgcgggccgcgactgcgtcaatttgtcctgtcgaggtcggccccgtctttgtcaaatggcgaataacggagtatattttggtttttgttgcagagcattcgcatgtcgacgaatgggtttaccggggaaatgccgaccgttttccgactttggcacaggcccaacacaacagcggagccaaagacgcgcagaaagcacgcgcaagttgtgccgctggcgcttacttttcacttttagccgtcttcctggcgcattggctcgcgcttttcctccagaaactccct

SEQ ID NO: 42471 - DNA, 682 bp, Heterodera glycines
cggatccagaaaatccggtaccggatccgatccggctcggtctctagtaaaacccaaaaagaaattatttgaaattcaatattgacagcacatttatgccatatttcatacgatttttttaaattccataatttggcattttatgcaataaaaatttcatccatagcatatgcaataataaaatagaaaatatatatttcaaataaattaaaaaatagtcaataaatccaatccatgaattcataattcattggctgttgctttctgtttcgctttcatcagtttggctttcaatttgttgaccacaatgagtaaagtcagtgacttcgttagttttacgcaattcattaacattggcatgggccaacaattccatcatctgctgaaattaattacatataatatggcatatttgtaaatatattctataaaaatttcgaattaaaagggaaaaaatatttttgcgctaataaggcagggatttttctatttgtagaaaatgcataaagccttctaatatattcaaaaatatgaaatagaaacgtttattttcaacctgtaaatattaaaagaaaatgttttatttttttcttctatttaattcaataaaaatttcgaattaaaaaggaaaaaattgtttttgcattaatcaggcaagaatttatatttgtaagaaatccac

SEQ ID NO: 42472 - DNA, 455 bp, Heterodera glycines
  misc_feature (53)..(53): n is a, c, g, or t
  misc_feature (63)..(63): n is a, c, g, or t
  misc_feature (178)..(178): n is a, c, g, or t
caaacaattatgtgggagcaaaaatccaacgcagaatttatgcacggggcgancagggaagcnagcccggaaggaggcggccttccagaaaaccgggcgcaccgaggcggggggactgccccgaaaacaaaaaaatcgatttttgcgtgcaaggggccgaccggggcacgcaaacaanaagggggagcaaaattccaacgcagaacaaaagaacaggccacagggaagccaagcccgaaggagacggccaccccaaaaaacagggcgcaacggcccggggggacagccccgaaaacaaaaaaaacgaaaaacgcaagcgaccgacaggggcacccaaacaaagacggggagcaaaaagccaacgcagaacaaaagcacaggcgacagggaagccaaccccgaaggagacggccaccccacaaaacagggcgcaacgggacagggggacggccccg

SEQ ID NO: 42473 - DNA, 857 bp, Heterodera glycines
ctctttgtcatagaaatctaacaaaaattcaaccttttagtttctctattaatttttaaaatttcaaaaaaatccgatgtgacatattattttcgttacgaaaagtccaaaataatgattaataaaaatccatttaattgtgccaatcgaatacaaaaattgttttttagggattttataataccaaaattgttaagttctgttgaagcttcttatgctgagaagtatagagtttgctcagacagttcgtctttttttcatttttatcccattttttaaaaattctttgttttatattttcgtttttttcaagaaatttaaaaatatttctaaaaatttataatatctgcttactttgcatatattattctgcttctgctgttcacattctactggtatgtgcaatttgttcatggggttttcaaaattgtcatcacaaaattgcgcgtcagtttttggcacttttttttggaaatttgtttgtggcattctgtcttcctgtttaacaagtggttcaattttaattttccctaattgaacttcattatcgggttgctgctgttcctctttcacctttcttgcttttgcctcctttccatcgctttgggtggcttttagttttcccaaattctgcgatttcgtgcaaaatacccttcgccatatttcatcaaccaaatggtcgttttcattttctccaactccgccaattccatcatctcttatataaaaaattataataataggaaagaattatattttggcggcctaacatttatttgttcatagaggttatataattataaaaacaatggcgaggcaaaattatttattttccatcactgcgattaatatttgta

SEQ ID NO: 42474 - DNA, 919 bp, Heterodera glycines
cttggggctcgggctcggcagctttccactcaaaaaacttagtttggctactattttctcacaactttggtcatccttttttttaataatcattaaattgacattgaagatgcgtcgccttcctcttcgagcagtgactttcgcccgaagtacgaccaaagaattggcaatgtgcgcggcgacttcactgaaagggatggcatcgttctgtttggggatgatgaacattggtacacattgtcctacatattcaggtgctcatttatccattcattaattccctccccaaaaacgtcatttttaacctttaattcgtcctttttaggctgaaggatgccagggcacggggctttcaccggtactgttcgctggtcgtgatcagtgcggacaaactgttgctcttgcgcaattacgacttcttggtccacaaattaggagaaatcattggcgatttgcaggcgatcattcttttgttttttactcctttattttcgtttttagcatcggacgggtgcctttttcgcattggaacagcaaagggacagcgaattgcgactcgcctccaatgtttcgcactcctccaaaggaccgcaacattggctgccgcaccatttctacccaatgcaacacaccgtggacactaagcgaagtctgaaggtgatcaccgactcggagcagatctttgagcacctgcacaggtaaatcaaatttgatcaagcgaatgagaaagagcaaaaaatggcacatttcaaaatttgtttctttttcctcggaaaaaagggggaggggcggcacgtgccccccccccttcccctcccactggaaacggtgctgagattgatgcatatccaatcatcaaaaggactgaatgggataaaggtcactttaagaatatttatgcgctccttagatttagaaa

SEQ ID NO: 42475 - DNA, 1451 bp, Heterodera glycines
tgtcgttccattgaaattacccgaattatgtcagggtccttagccacttctaaacacatttagaaacatgggacgccacgacatgcggcgcagtacacaacgtccgtttcgccaggttttgccccaggtttgcaacgagggcaaaaccaaaacttgtcgcgcgagtgcacggtgtggccgctggcacatgaatgcatcaatggccacagatgtatgtttttgatgactcgattaatgcgttctcgcttccacaatttgaagccgcagcaggcgtagttgtgatagcctttgggcggggtgtcgcgatgactccgaggcagatctttggcggccatgcggcggcgccccttgcctttttgcttggaagcctaaattttttaaattgttaagtgttatcattccttacagatagtagtatttgtgaccaaatgtaagataagcttacactggtataaaataccaatgagcgcaaatatgctatagtacctttacggcggtcttttttcgcttgttttttggcggctgctgcttcgatgctgctgctgccgatgtgctagcggtcgatgtcttcgcccttttgctcggaggtggcgatggtgatgccgacgccgaagattcagaggaggtggaggaggagacccggtttcttgccttagccaccgccacaccggcgccctgttcactggcgttggattcagtgtcagacgattcgtctataaatataattgttattaacaaaaagcaatgatcccgttacactcaactgtaagcattgtttacagttgagtttttataaatcttattacctgtaactgcttcctcgccacgctcttccccctcttcttcctcgtcacgctcctcctcctcatcttcttcctcaacctgctcctccgagactcgctcctcctcctcgtcttcttctctgtctcgcaagtcctcggcccgctgacgcaacaccataagctgggccatgcgctgaggcgtgagctgcagtatgttgcggaatattggctgctgctcaagctgacgcctgggtgcaggagtctgaacaacgatttgcggagtgtggaactcgttgggcagttccaagtcgtgcgcttgttgcaccaaaggagagtctcgaagacccgctataagtgtaagctttagttacagatgcaaaataataagcaaatcacatccaacaaaccttggttctctgcaaggacttgtgcattccgtgccagcacttgctgacgcagatcttgctgctgtggcgatggcgtgccttcagatggagtgtagacgacaacgcggcggcccatgtcctgttgttgttgtggcgctaagggcggctgacgcaaaagcggtgactgatgcggcggcggcgaatcaggagaatcgaagttgaggggtgttgtcattgacgcgtcgcggcgtcggtgactgatcacgcaagaggaacggacgcg

SEQ ID NO: 42476 - DNA, 980 bp, Heterodera glycines
  misc_feature (823)..(823): n is a, c, g, or t
  misc_feature (955)..(955): n is a, c, g, or t
ccatagtgaaaatgtttgtacaacaatttcatgccgatctttttcacattggtcatggaagttgaactgttacaaatcgcagaaagcgctgatgacgaagatgaagaggagaataaaaatcacaaagaaaaattggcaaaaattcttaatgatttaactcaaacaaatgacattggccaaatgcttctcgcggcccatattaaaatttacaaaaatgaattggatgcaaaaaaagcacttattgatgaaatttctatcaatttgaaccaaatcaaagcaatagccggcatttttcagcaaaaatttttgaaaatccgagaattgatgagctttgtggaagcagaatctgtcgtatattttttaaattaaattttatagtaatctttttttctatcattttttaggaaattaaacttaagaaattgaatgaattggctgaaaaaacacagaaaatagtaaaacaattgaaaattgtgaaaaagttggctgcggtgctaagtaaaaaaacgacggaagattcactgagcaaaggttagttttcgcgatttacttaaatttaatcgtttttttcaaagaaaaaaaaacattggaacagtttcttccctgaatcggcgatttttttttaacaatacaaaaacggagaacctttcgaaaatattttttgcgcattgaaattaataagaatttctaagacaaaacttttaattcgtatcaccaaaatatagagaaaaaataattattatttttccccctaataaattttctttaaaatttcatgtttaaggtctttggatagtttaaaaatttagtctttataatgcancagaaatcctgaatgccgacccaaaacagaaagtcaaatttatttcgtgtcgaattttgtgttcggtcaaaattggtctaaatggggctatgaatcttgatcacagattttggaaaaatacatatttaacgntctacgtcagtcggccccgcacggt

SEQ ID NO: 42477 - DNA, 1093 bp, Heterodera glycines
ttttttgaaaaatttccgatttcttgcaccgcaaaaaagtggttttgaaaagaaaaaaatagtcaaatttatgaaccgttaataatttgatttccgatcaactttttaccgtcggatccaatcgaaaaatcttagtcgacccatcagccccttttaatgcatcccgccagcccctaaaaatttatttttcagcattttttgatttttggaaattttttgaatttaattgaaattttttcgaattttccaaaatcccgcaatcccgcacgggatcccgcaaattttaaatgcgggatttgcgggattaatcccgcgggatcccgtcccgcaaaaaattttgagttccaatcccgcagcgggatccgcaaatttgaaatttccggtctctagtgaccaccctcacttttttagatcataacttttttatacttggttaatccaaacattcttggtatcattcgagagcttaaagtttagggaatttataaatacaagaaaatagcaaatacttatattaagaaaaagaattacaatgagaaaattcgaaattcataattttcgcgtatattcaagaataattttttgtctattgcctttatccgtgatttttgcatacaaaaacttccctaaactttaagctttcgaatgataccaagaatgcatggattgatcaagtaagaacaaagttatgatctaaaaaagtgcaggatggtcactcattggacgcgtaaagtggaatagagccaaaattaacaccattgttctgaaaaagggtaggaaaagaaatacacataaaaaatccgcaatttttcagtaaacagttagtaaaaggatcagagaaaccattcgtttcttgactctcgacagagggaaataagaaaactgagttgcacggttggttaaatagggccatgtgttcgaatccatttgccaacaaatatttttaaaaattgtttctcggggtttttgggaccactgatcaagaatttaacattcacttcgccaaattcagaaccctgacccgaactagaaacccaaaataatttttttttaaatttacaggcaatataagctgaacccttggccaaaaacc

SEQ ID NO: 42478 - DNA, 933 bp, Heterodera glycines
gggggcgaaggcccaccacgaggccgcgaagcggccgagtgagtaccttcggtgcaggaaaattattaaggaagagagttcattatttatttgtcttttgcataattaattcataagtattttacagaaactgctctgaaacgcaccaaattttatttacatgttattttaggcactctgatgcttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttga

SEQ ID NO: 42479 - DNA, 903 bp, Heterodera glycines
atttttaattcctttttaaacaggccaaaaagtgtaggcttaacttttttagtgaaaattcgatcactcatattttttgcaaactgatcagaagcgtaccaaactttgcagggatactccccggtaaaggactaacttacactgaaatgagcgccgagctagctggctcaaaaaaattttcgaaaatctgagtctttcgtttttatttattttttgcaaaattaatttttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttc

SEQ ID NO: 42480 - DNA, 1071 bp, Heterodera glycines
  misc_feature (983)..(983): n is a, c, g, or t
ctcaaactcggccatcgttcaatttttaaaaatttcatctcccccttggctgtaaaaaatatgttgatttggcgttagataaaatatgtccagtcaatgtttttttgttaatgtgttcaaaagaaaatcacaacgaattagaaatatatttaaatataaaatttaatcaattgatcaatcatttaattcatcaatcaataattaattccaaaaataaattaattaatgaattttaatatgtttttaagaatttaatcataaatgaaactcttacatgtaaataaaatttccaacaatttaattaaaaataaattaagttttactttttggtatccgaaaagaataatgaaaataattttaaattggatagaaattatttatagttaattatacgtaattttgaaatattataataatttctaaaaattaaaaaaaaaatttgaaaattcttattaaatagtaattttataaataatttatacataaataattttacaattgaaaattgaagaattaattttcgttcaaaattaataaaattttgatatgaaaatagaaacaaacaaacatttaaaggtaattaaaacaaaaaattattttaaaaaaacaaattctcaaaaattttaaattagcttgaatcagttttaaataatttattatttaacaaaaagctttcgttgataacaaaattattcaaataaattataatcatttaaaataattgaaacactcaatgtatttatacgaaaactagaaatcaaattttataaattgttccaaatctaaactaacaatatataacaaaaataattaactaaaaaataaaattataataaaaatatatattatccaacgacatgaaaaagaaagcattttttaatctctaataaaaaaacatcgcgtactcaatagattgctgcaaagtgacgttagataaattaagcaaaattataaaaatatgaaaataaatttatcgaaattanactaatgattatacataaaagtacataaaacaaagctaataaccataccccgccgcaacacatggtcgacgtaagctcaacgcgaggg

SEQ ID NO: 42481 - DNA, 1713 bp, Heterodera glycines
  misc_feature (1504)..(1504): n is a, c, g, or t
tatagcatatatccaatagaattaaatgattcttcggctccaataatttcatccggaaatgggaaagcatttggtgagaataaagttttcgtaatagtaaaattaaattgaaaaggtttttattaagcctgacatcaattaagaaaaatatttatatctaattttataagaaaaggtgacaaaaacaacagtcttgtgaacttaaaattaattagggctaaagcgaaattttaatcactagtagcaatttcttatttgtaatatttttttccttgtttgagcaaaatatttaatatttaaaaaatttattgtcttacatactgtgtgtttataggcatgaaaattatcgaaaatatgctaatctttttattcttataagaaaatactatatatccaatttcgtttcgggaattatcgtgtctctattgcaggcatttaacattataaatatttttatttttaaaagcatggaatataaattttcaaatggcaacaagcggctgcatacaacagtggattcctggctgagatactggagctatttgtgattttcaaaaaaaatttagagtcaggtgcaaacgcccgcaggaagctaaaggacagtcgaaagaaccccaaaaaagattttagaaaaatcataagtagcttcaatatcttatcgccagaaccaattgctgcacgcatccgcttgttcccatttaaaaatttatattccatgcttttaaatgcaaagatttttataatggtagttgcctccgatagacacacgataattatcgaaacgaaattggattatagtatttcgtcataagtagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacacaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaacattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctagtcataagagtaaaaatatttagcaatatttcgatnaatttcatgcctataaacacacattatataatacgataaatcttttaaatgaaaaaatattttgctcaacaataaaaatattataaataaaaaattgctattaattgattaaaattttcctttttaccccgaattaattttaagtacacaaaaatgtttgtttttgtcgccctttcttataaaaattaaaaaaaaatatttttcttaat

SEQ ID NO: 42482 - DNA, 449 bp, Heterodera glycines
tgcactcagtaatttttttactttttcatcatttataaaagcatcaaagctagagattcggcttccaccaattatttccggtgagtttggttttcggttttttattaaaaagaaaatcaaaataatagcaactatataaatccttccttttggaatctccatcctattagaataaattaatttgaataaaaatttgttgtaaaaaatatataataaaaaactaaagccaataaatattatggaagcatttttacattaatcaatgaatcgattttacattaataaatattttattatacgaagtgtttgtttactaatattaaaatttattgctcgataattttatacaaaataatcagtaaaagacatgagaaaaaataacgggtctagttaggcggttttttgactaacgccccattgtggcggtttttgactaacgtctcagcacc

SEQ ID NO: 42483 - DNA, 1471 bp, Heterodera glycines
  misc_feature (36)..(36): n is a, c, g, or t
  misc_feature (46)..(46): n is a, c, g, or t
  misc_feature (132)..(132): n is a, c, g, or t
ttctatcagttttcgggtttgatttaaacacgctgncctatgaaanaatggagtttatgggatgtcaaattttgggacttttcttcgacgtggccatcagcgggttgtttcgtgacaaaaacaaaccagttntgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcctatccttctcttgaaaaaaattgtcactaaaaaaaacacgttttctgaatattaaaaacaaaaatttttagacactttctaaagaggaaggaaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttgatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaaaggaaaaaatttttcatttgcc

SEQ ID NO: 42484 - DNA, 1019 bp, Heterodera glycines
ttttaattttagcgtactgttaaagatgatgatatcggaaaatttttgaataaagaatattttttgacacgaatgtttcaagcgctaaattaaatttttcagcaataaaaaatccctttttatttttttcggtttttgcgtaatttttctttgttcacaaaaattcgaatacatatgtatatttaaattatttttatttagtatttttgttggagggttaaaaaaatgcgttccgccgccgaagagtcgcagcaacggacagcggccgattggagggcgtccattttgccaattttcctcgttttttactcctttctcaaggaggtcaaagttggcgagccgtatgtacgtttaaagcattttgaccgattcgggcacaccctttttcattgcagctgtacaaataccagacggactacctgaatttgaccgcagctcaaatcactggcgaagtgattggaaaacatttgaaatgattaaaaaacccaattttcagatttatcccttcacgccgtacacttacatggtcgcactaattcccatctttctgcttaccgacttagtgggtttttttagaaaaaccaatcaaatactgggatgtttctgggaaatcgaaacccgaaaaaattttgtgggccacaatttttggacattaaaaatttgaaatcaaaattttgccaccaagttttgactgtgcccttggcgcaattttgaaccatttcaatacaacatttgccaaacagctgctctacaagccgacaatgttcaccgaagtgctgggccaaatcggcttccgtctttccctcgtcttcggcggctccgtcctctcccaaatccttggccaaatggcctatggcattgcgtccgcctcggaggtggcatttttctcctacatttacgctcgtgtggagaaatctcagtacaggaggtgggcacaaaatgggagcttttgtggatttttgacaattttcattgacttaaacgaaggctgaccagtggacccgagcggggacaatggc

SEQ ID NO: 42485 - DNA, 772 bp, Heterodera glycines
tttaacttttaattaacatttggtgcgtttcagagctccttgctgaaaaaatacttatgaattaattttgcaaaaaatatataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaagaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatttggtgcgtttcagagcagtttctgaaaaaaatatttatgaattaattatgcaaaaaacaaataaataatgaactctcttccttaataattttcctgcaccg

SEQ ID NO: 42486 - DNA, 785 bp, Heterodera glycines
acttttggaagaatgtgtatttaagcatcaatttaatttaattttaatttatttataatttaataaatattttaggcgcggatttccggaaatggcccttaataaatgaggcacaaatgtccaatttctcttcttttttttcgggaacagaaaaaggaaaaaagcggggcggaattcccgcttttttccgttccgtaaaaaaccgtaaaaaatatcgtaattccgcgccgggaagggaaaaatttttttacgaaaaaaattttgattatttaaaatttttctttattatttttaagtaaaatattatattttaacattttaacattgtgtctacgtaaatgctaaaatacagttttcaatggacaaaaaataacaaaaaatttaattaaattgattttcgaattaattgtataaaaaataagcggtacaaaattctcaaacgataccacaaaaactggtaattttctgaatataaaatttttttataattcatattttcgttagcctattttaaaattccaaaagatgcgaattctatgccattttttgataaattttctgttttttgattaattggcaatcttacaatctttttatatgttctgtgtgtgtatacataaagaccaccttcctatctttaattaatatcaagggaatataaagaatatgaataaaaatgtaaaataacgttaatgcttaacataaacatttattattaagtaattgagctaattactcaaagctaatacaaaaatacccaaaaatgaacaaatcccgaaattgtc

SEQ ID NO: 42487 - DNA, 956 bp, Heterodera glycines
tgaatttgtaaatttttcaagaatttttcctaaaaagatcgttgaaaaactatgaaaattttaaaaaaatttaaaacaatttttcgggggaactgacgggttgagggacgagctgttcgcggcactgatttccaaaacccggaaaatgccagattttcgagacaaaatggcaacaccgtgtttctgtggttgtgcccaaattttaatgccaatgtatgttttagctgtgtgtgctgcactcgttcattttgttgcccgcactgttctcgttgatccattgcgcgaccaattgcaacggcattgggctgtgccaacggcgaacgatgccgacaaagtgaacaatggaaaacggcggcggcgccattgatcactttgatcacttaccaatgatcttcttttaattatgatcgatcactctttggttcactttttcgggaaaaaaatcattcttaaatcacattcttaatggtattgtcattccctgatctgctggacacattcatttgacatgattagagatcggcacgttcaatttatcggttgaatatgtcggttttcaaaacgatttttaaataatcttattgtaaaaaatcgatcgagaaattttcttgtttttttttcggtatcggttttttcagtttttattgaaaaatttcgatcgaatcacttgtccaatctttagatatgattatgatgccaaatttccatgcttttttacactttgttatcattcattcccaaacaaaacatatcatttgatcggtgctaggtcattatttaaaaaaccatcattattttttatgtacaaaaacggagatagcattcacaccccagcgacgttccaagtcatttttcatcgcattggacacacaaaagttaaacgaagaccttcgaccgaaaaatccttcgatcaaaccgaccaaataagatatcctaaaaaggaaacattttcggta

SEQ ID NO: 42488 - DNA, 1454 bp, Heterodera glycines
aaatgcagatgatggcgaggctcgtttttaggggcgataaattttaaattaaaaaaaaaaagttatcccaactctcaaaaacctattttttactaaaatagaaaatcttgaaaattaaatttagcataattttcttatcatatttcattaaaatttccaaaaaaaaatttcagggcgcctaaaggacaccgccgaacaccttataccttatttttttttgaaaatttgatttataaatggcaaaaattgtctttttcgatgcaccactaaaaattcctgcttttctccccggcgctgaaattttttgtaaaataataatttcattttaaacaattatcagccatttttttacttaaaataattaaagattggaccacaatgtgatgagtcatgaaaaaatttcgctgatttatttgcatgcatgtgcacttagactgaccacagaactcggcattttgatcaacgagttggaggaaattggcacagaatggacgagtgccgacgcaattgacgaggtgttgaagtcggctgctgagcttgaaatgaatcgtcttacaattttaaaaatgtgataattatgcttctcaatttattagggattttcatttttaggattggataattagtacagttcggcctggatccaggtccagttcatttttcggcaacctggctttttcctcgatttttgtccaacaaatccaggacaaatatgaaaaaatcccggtatgggtccaggttatgccacgaaaaacctggatttaaatttcaaaaatccaggcccccaagcctcgaaaagctttgtttttcctggacctggtttttcctgcgtttttgtccggaattcataaaatccaggttcagatttttcaaaatgcccagctctactaatgagttgttaattgaaatgtgttgtgttcaaatttgttgaatcacatttaatacgctagtagattgttatttaattgatttgatttttttttgatttgttgaaaaaataaaaatatataagtataaaaggaaatattttaatatattttttaaaattaaaattaataaattaaataaatcctttaatttattcctcttttatcatttatgtaatttttcgattttttttataaaaaaatatatacattattttctaattcccttgaattcatcagacacctcactataaatgtggtcggcgattttcgtccaatttcacgaaaaataaaattttaatgtttattggtgtgtgtctttgctcgtctctattattttgaaaatgtttttaagtgagtttttattagttttttattttttaatgaattaaaataattaagtttttattcgatgtatgaaactaaacaacaaaacaattaaagatttttctttttttcatataatttataatgacatttcacagtttgttcaaattaaaaatatttattaatttaactaaacaaatt

SEQ ID NO: 42489 - DNA, 1213 bp, Heterodera glycines
aggccgcgaagaggccgagtgagtaccttcggtgcaggaaaattattaaattttaaaaattttttaattgctttttaaatatgccaaaaaatgtaggcttaacttttttagtgaaaattcaatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcgcgattagcttgtcatcagtttttataaaaaattttcaaaattctgagtctcctattattttatttttttttcaaaattttgaagggcgggggggggcggcggttgtcgctcgccgagagtttgccccgagggatgaaatttgtgggggtggggacaccgacaatttagttattattttttttggctaaatccgcaaattcaaagacaccttctaattacgggtcattcttttctccctttccctctttcccttttgtcatttcgtttctttttaattgcccctttcttttttttttcttttttttgtatttactgtaattacggttttatgtcttttggtatttatgtgcttattaattaattgtttattatataaagaattttttcatctttcgtttttgcgtttgtttctgtttttaattaattttgaaaatgttttcccgtgtcactcttttttttttactttttgccattgcgcgaatttacgccatcgccgccactaatggacatccgcccaccccattgggtgccgggtgtttggaacgggtgagaagcgaatgggactgccaaataaaatccgcctctttggggcaataattttttttctcacatcattttatgtctgagagaggttttatcatttccttggacaaaaaatgggcccaattaatatggattaatttaattaatta

SEQ ID NO: 42490 - DNA, 707 bp, Heterodera glycines
gaatttgttagacgatgctcgaaaatcttttgagtccttcttggagaagtgtttcccaattttttgttaccgatcccgctccccatttccataaattcccgaccctcaagtcttaatacaaataaagtaattactttaaatccctacattgttctcgacccttttttcccaccgaccgatcccgtttaacgttttaaatttgtaacttcaattctcgacagaaattaccggtcacagcaggtccccccggtttttgagtcccaagaatctcacaaattatccgttcacagcacatgattgatcgctcggcaggactcttcttctcacaattctcccatgttaattaaattatccaaaaccttttaaacaaatattccccacatttcccctaattaccgcctaattacccaaaattaggtagttagttgcttttgcggttgcccttttccctcggtccaatccgtcccattgttatggcggcacgcggactttaagcattcattcttccattctccgtcgtcctccgcatgctttttgccgcccttgctgctgaagggcaagttcgttttcggttttttgtttttgcccgccctttttcccttcactttgtgtaccaaaatgtcggctaaatccttcgcccctttgtcccccgccgccccttccgccgccggcgttaatctctcccgccagccgactcctccgcccgc

SEQ ID NO: 42491 - DNA, 778 bp, Heterodera glycines
cgaggacccatgccattaaaaaaggagtcatgaaggaattttgtgactcaaatagattttaaccccataaacattacgttttttgagtgctgtttctcgtaattcaggtgaatggctagaaatttttgtagtaatttcagttttttacgtttttggataatatgaaaacgaaaaatttggctgccgcatggcgcccaaacggcggcgcccaatcggcggcgcccaatcgtacccgcgcccaatcggcggcgcccaatcggcggcgcccaatcgacccccaccgccaaattagtcaatttgtctattcaacggataattatttcattaattagttaattgaaggtcggcgatcggagcgactcgtcctgttacatcagcagaaagatgggcaaagcgaaggaggtcggcatcgatgccaagctgtacaagttgagcagcgacagcaccgaagctgagctggtcaacctggtcgagtcattgaacacggatgccaaaactgatggcattattgtccaagtaaggcccgagaatttgttatgcatttctataattggcacggaaacaaatccagaaaaggattttacaatgatcataaatagatcactttgattctatgtttttttttgaaaaaaaaaataatttttcgggagggggagggcgtagccagcccttggctttggggggggggctgagtaaaaaattcgattttaggggtgtattttttggtttttgaaatccgattaggggggggtattttacaaaattttttcgccaaaaa

SEQ ID NO: 42492 - DNA, 509 bp, Heterodera glycines
tagagatagacctggacctggatccaggcctggatttttcctggatccaggtccaggccatttttcggcaacctggatttttcctggacctggattttcctggatttttgtccaggaaatcagggtccaggtcaaatgtgaaaaaaatccaggtccaggtccaggcaaaacaggaaaaaacctggattttcctggacaaaattttagaatttattttttaagtgaccgatgttttttcaagttttcaaaaacagattaaataaatttaaaaacacattattattattaattagatatttagatatatctaagcaattaattcactttttcaaacacttttttgatttttaaaataaattccaaaaaatccaggtcaaggcctgaatccaggtctcgaggagcctggatttttcctggacctggattttgtccaggaaatcaaggtccaggtccaacatggaatccaggtccaggtccaggcttttttcaaaatgtcgatctctattcaa

SEQ ID NO: 42493 - DNA, 902 bp, Heterodera glycines
tcatggatcccttcaaaaaaacaattgacgcaacaacccttcttggaactgactgacgagtcaagttggtgtcgacgtccttctcctcactccaattggggctaatgctctccaaagcgagtgaatacagcttgaaaaagacgaacaatgggcaaacaataaataaaaaggagcattcttacgctaatggagccgccaaagtcaaagtccgtgccgctgtccgactcaaagaaaatctcaactgactgaacataaagactcagtgtttcgatcacccggtcagcaaaagagtaggatttgcttctgaaaatggccaaaaagatggaatgcaaaacttatgaactgagaagacgcggtttttggttgggaattgcaagtgaatgcgggcgaaaccaaacggacggtgacacgaatatcgtcgacatacttaaaacaacaggataaaacggaatgaaatctgttagtccgatcggtaccaattggatgggagcactcctcagtttgttccaacttggaattttaatgctgactctaaacaaacccaaatataaacgcaaatggccaatgggaatacatccatgccaaaaaatgacctatcgcaacgagcactgacaatttttagccacgggggcaactctaatttttcagccaacacttcctcattgagttccaagtctcgcagttggcctttcccccgtaacaattccatcgtaatttgttccggtttcaaatttcgcgcaaacctaaacaagaaaaaaatgttttgttgaaaattaatggcatctatcaacttacgccgaaagatgcttaatgatttgattcttcaaaatcgaagtcatttcacaaagagataaagcataaaatacaaatgaaatcttatatttatatgaaaaaataaatgg

SEQ ID NO: 42494 - DNA, 1273 bp, Heterodera glycines
  misc_feature (29)..(29): n is a, c, g, or t
  misc_feature (1152)..(1152): n is a, c, g, or t
  misc_feature (1198)..(1198): n is a, c, g, or t
caattaatgtctcagtaataatattattnattaacctattttgggaacagtttatttaccccaccttcacagtgttgcacatattccgagaacaaatgggcggtcaactcgcgcgccacaatggcaccggcatggccttcgatgaagcggagcaacagaatgccatccggacgcagtgccaagttggcaaaacggtgcagcatgggcgccgcttccttggaactgaccaggtcctgttggacaaatcacaaaaaattaccgaaaaacttggaaattttcggttttccgaaaatttagaagcctaggtttcttaagtgatagaaaattaaataaattaaatttttaatttaataatttttatgttcattaaatattgcaaattggaatattttgcaattttttattgccacctggaattttgcttgtttgagcagttgacgaagctgacgttcacgggccactggtggcaccaacgagaacaaacagtaaaagaagttgatcagagttgacttaattataatttttaaaaaatagaaattgaatatttaaattaaaaaaaaattaattaattcggaaattaccacagccacaagcagaaaccaaaaccaaataaacaggtagattttctaaaaaatttgaggattttataaaaatttatttcactaatccacctcattgaacatgttgatcatcagcacacattgaacctaacaaaaatgaaattgaaaaactatataggtaattaaaattgaggggggaggagattatccgaactttttggggccataatttaaaaaatttaaagaattttagtgtccggcggtgccattcagctggcgccgattttccccttccctccctcttttatagccccccgccctttttaatagaaaaataaattaaaatattatataattaaattccattgatatctcatctgaccgtgtatcggtgcatattggccaaacgacgaacacgaaaatcacacaaagaactgcaaaaaaaaatcatattaataaacatttcgcaatttaaattttgttgtaagttttaatgaaaatttctaagctatattttctttatcaaaaataatttacaaaaatatttgtagaaataaaataaaaaattacgagaaacgaacgaactacatanacgaaaatagaaaagtttatttgctaataataaatatgacaaattntctcgtcgttttaatttaaaataaaattttaaaaatttttatactagaaagtaacaattataaaattaattcggc

SEQ ID NO: 42495 - DNA, 945 bp, Heterodera glycines
agtcgttggtttttgtgtggtcgttgtaaatgcagcagttgccgttttgcgaccgaatgatcattgcttttaccaggaattattatgctgcttttacatacattaagcactgctggacaaatgtactaatctaaaaaatcaaaatttattaaacacagtcagtttcaaaggcacgcaatttgagaaacgccaaaaatttggcatttttatggaggctgcaatttgaacttattagttggatattttctaagaaatatttccaaagctttttattagctggtaacgaaaagaacattcgcaagaaatccaatttacgtgaaattcaaaaaggtaaatttaaaaaatgccataaattgtgcgcaacattccatttggcaacaatttaaatttgttgcactttgttgttaatggataaaattgttcctcccaaaaacaatacacataaaaaaaaaatttgtgtggcactaataaacaggcaaagcattcattttcattcattcattgttgaggacccacgaaaaaagccaacatcaaaaggggggagtaagaggagcaaaagcaatacacacataaatgggcgaggacgacagaagaaaagagagagagaaaggggagggaagagggaagaagacgattttttgatgaaggtgaagtgaaatgaagtcgggaaatcggtcgataaatgggaaaagacaaagaaaaaaggggaagagagcgcgggaataaagcgaatggacgccggaggggtgggggaggggttggatcagttcagagcgagaaacacaacactttctctcccacctccgtccatggctatgtatgctgctgatgatgatgatgatgatgaagcatctcaccatcagcggcagcaggctcatcctcctcaaaaacggcggcgtgccgagccgtaagtacagccgccgccgtcgtcgccaaaaatcattc

SEQ ID NO: 42496 - DNA, 898 bp, Heterodera glycines
tttgaaacgccaaacaaaaaaaatttcttgcccaaaaaaagttcttttttttttttctcttttttttcccacaaaattgtacccaacagttgccttttttggtctggccctatcaaacattcttagaatattgaaaacgcaaacaaaaaaaattcttgaccaaaaatggttatctcttttttctcatttttttaccgcaaacttggtaccaacagttgccttctcttgtctggccctatcaaacaatcttacgatatttgaaacgcaaacaaaaaaaattcttgaccaaaaaatagctatctcttttttctcatttttttaccgcaaacttggtaccaacagttgccttctcttgtctggccctatcaaacaatcttacgatatttgaaacgcaacaaaaaaaattcttgaccaaaaaatagctatctcttttttctcatttttttaccgcaaacttggtaccaacagttgccttcttttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaatgtctatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttctcttgtctggccctatcaaacaatcttacgatattgaaacgca

SEQ ID NO: 42497 - DNA, 865 bp, Heterodera glycines
ttcataagaataaaactgctcatatgtttatacatgcttttatggtaatttttctcactaaaatctttcgttcaattttctatgatataattttttaaattcctattttcgatatctaatattccggcggttttcatttttcggttccccctttttcggggccgtttatctaactaatcgatattctcgccgcgtggtgggttttcatcttgccacaagatttgtccggcaaacaccctttcactaattaccactccaactctcttcttctgttgttgtctctccctcccctctcctaatccattttttcttctttttttgtctcttctttttccccctaatccccctttccgctctcttcttctaccttgtctctccttcctctaactccgcactttcttcttctcttgtctctcccttttctctaattgcctcgccattctctctccttatcttgtctctcccctccctctaactgcctccccactctcttcttctgccattggctctcctcagccccacccccattacgaaggtgaatgatgcttctcctcgcgtcctcgctgcgttccctccctcctcggctttttccttatttttccaacacttttcaaaaggctttttccaacgcttctgtcccccgtccaccaatgtctccagcagaaccctttttggaaagcggcgagtccgaccttttcgccatggccgtcaaattccaaacggacaatgggcaacccattgagctgaaggccgtttaccaagttgccttatctctttttgatggattattcccaacgattcccaggacactgacccatcgccgaaagccattccgacggaagggaaaagccgacagagtccgacg

SEQ ID NO: 42498 - DNA, 958 bp, Heterodera glycines
  misc_feature (914)..(914): n is a, c, g, or t
  misc_feature (919)..(919): n is a, c, g, or t
  misc_feature (953)..(953): n is a, c, g, or t
acagagaatttttaaatttatcttatatccaagaaaaatgattatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagattttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagaggggagggcggtgcgcaatcgccatttaatttctcagagaattttttaatttatcttatatccnagaanaatgactatctcttattttgagaaattttatacngtaca

SEQ ID NO: 42499 - DNA, 924 bp, Heterodera glycines
  misc_feature (804)..(804): n is a, c, g, or t
  misc_feature (806)..(806): n is a, c, g, or t
  misc_feature (832)..(832): n is a, c, g, or t
  misc_feature (849)..(849): n is a, c, g, or t
  misc_feature (864)..(864): n is a, c, g, or t
aaaagaaacaattggtaacccgaaggatgtgccaaaatccaaaatgaaaaacccattcaatatgccaaaaccaataattgccaacccgaatgatgtgccaaaacagaaaaatgccaaaaagaaagcatcaaaaaatgatggggggcaaaagaaagaaaaacttgttgttagccgaccatcatcacccaatggagtgccaattgagtttgaattggaaatcaatgaatacactaatggacaattgatcaacaaaaacactatttctggacaatgggacaaaaggaatgagaaaatcattgatgaaatgttaaaaaataaaaaagttggtgtcacacaattggggcccattcagtcaaaagcaggtatattagcacaaagatgaaaatcagaaaagccgcgtatctcaggcaaaaaagccatttttcagaaaaaattatcatataaccagatctaagatggattttgccgcttaaatggcaatctttgaaagttttttataaatttttatttaagccacaaatgagggcaaaacctcttatattggggcaaaggtaattaccgaaaaacaatatttatatttccatgtttcacgggaaaaattattttttaaagtataactgattgataaactttttagacattttgccattaaaaccaggacagttcgaaactgaatcccattttttctctgataaccatgcgaacagtcagcaatcaactgttgcatcaacatcgaaaaatcaagtcagaaatttttaattaattaaaaaataattattttagaaatctaaaaaagtccctgancntctattaaaacattccaagtcaatgnccgaatttaaaagaacncaacactcaaatgantcaataaatgtatccgagtaagcaaataatataaataaaccattggaattaattgagtaa

SEQ ID NO: 42500 - DNA, 838 bp, Heterodera glycines
acgcagaattaaagtacaggctatagggaagctattccctactgattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactatataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaa

SEQ ID NO: 42501 - DNA, 1182 bp, Heterodera glycines
ccccccccccctcaccatccattgttctttttcacatttcaaattcactttcttcttttgaattttaaaatgagaagtgtaaaaagatgggaaggatgaaggggaaattgtgaggaagaagagaaaaaagacacggaaaaaacggaggactaaaatggcgggggaaagtttggaatttttagattggagggataatatttagaaaaaataatttacggccaattttcggttttaaatttgtcccctttgtgaggggtacgtaccgagctggttgtgagtcgttcgtaaatccgccaaggggtataaaacaaaaaatttgacacaaaaaaaattcctaagaaacgccctagcaccggtacgtacgtacgtacgtactccttcttgtgccccccccccccggtcttcttcccctcgggtgcgttcgttagagcatttctttctctaaattttcttccattttcatacggttgacactttcttgcctttttgtttcgccaattatgccattggatgtgtcgcttctcatttttcccatttttcaacccaatgaatgatctctcccctccctttccctctttttccaattaaattaatttgcattttcctaaaaaagaaggcatttatttgatgggcaaaattcgaatataaaccatagaaacaattacataataaacacaacggacatttattatttgtgccaatatttccgaagcgaatgaaaggcatcgaattgctaacggacgaaatcgccaaaagggcaatcgccgccaccgcgggaacgccaacgacgtcggcgactctcgccgaaccgcacgtttatcgagtggaggaagaaagtggcgaattggagggggacgaagtgtgcaccaattcacatgtgagcattgacttattctgatcatctgctgatcagtcaatcactctttgatctatcagtcctgtctatcagcctacggcatttggttgctgcatttcctctcttatcagtcggtctctctctctctctcctctcctctctttctctctctctcttctctctctctctcctctcctctctttctctctctctctcttctctctctctcctctcctctctttctctcgctctctcttctctctctctctctctcttctctctctctatcgtctcctctctttctctctctctctcttctctctctc

SEQ ID NO: 42502 - DNA, 919 bp, Heterodera glycines
  misc_feature (306)..(306): n is a, c, g, or t
aaacccaatttttattcaaatcctaactccaaagctcgaagccaaaaaacccgaagttttcgaagccgaagccgaagttttttcaaaatttttttttaattccaaaaaattttttcatcacaaaatttcgattaaatatcaaatagaccaaccaacaacccctttcgataaataaatataattatttttttaacaatgtattttctaaatttttataattcttagaatactcacagtttttgagtcaatttaaaaaataaagggaattttggaactccggcggtgccgattggcgccgccgggtgnaaaatttgaaatttaagtgacagatttattccaaaaatgaaaagattttgcgattttaatagttaaatttatattaaattttcgtcgaaaaaaggaataactttgaaaaattagaagaaaaacaagtacttggatgggaactgatccaaaggaaacagaaacataatgaaaagagccaagagcaccactcgaccatgcgtgtgaacaaaaaataaaaacaaaaaattaataaatatatattaatttaagtttatcaaaagcccatcactaagggtgcattttcacattgaaaactcaatctttaggggtgtatttttcccgaaacttcgggtaaaatagccgaagccgaagcacgaagttcgaagctcaaaaaacccgatgttttcgaagttttcgaagccgaagtttcgcccagccctgctcccaactgaaaaaccagcggtgccaataggcgcagcgggaagtattttcaaaattgatgctattttttaagagagattttcactaaaaaaagcaaaaaaaaaaaaacaaacaaccatcattgaccccatgaaaagcatcaaaatcattgggaaggcagagtttggagccctgcttatgctgctgcttttgt

SEQ ID NO: 42503 - DNA, 1141 bp, Heterodera glycines
  misc_feature (16)..(16): n is a, c, g, or t
  misc_feature (28)..(28): n is a, c, g, or t
cgcccctctgcccacntgctgggaacantttgtatgcgtacctctccacgggcaaaaaagagatagccatttttctggcatagagcttaaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaattccctgtagaataaaatggccattgctctccgcgcccctctgcccatgctgggaacatttgtatggtacaaaatttctcgcaaaaaagagatagccactttttctggcatagagaataatttaaaaaattccctgtagaatagaatgcccattgctctccgcgcccctctgcccctgctgggaacatttgtatggtacaaaatttctcgcaaaaaaaaaaaacccatttttttgggaaaaaaaaaaaaaatttaaaaaatccccgggaaaaaaaaa

SEQ ID NO: 42504 - DNA, 741 bp, Heterodera glycines
atttcaatcactggggactcaaaccaccagccccttaaagggtcgggactcaacccaacagcattccaatcactaggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaaaccaccagcatttcaatcactgggactcaacccaccagcattccaatcactgggactcaacccaccagcatttcaatcactgggactcaacccaacagcatttcaatcactgggactcaacccaccagcatttcaatcactgggactcaacccaccagcatttcaatcactgggactcaacccaccagcatttcaatcactgggactcaacccaccagcatttcaatcactgggactcaacccaacagcatttcaatcactgggactcaaaccaccagcatttcaatcactgggactcaacccaccagcatttcaatcactgggactcaacccaccaacatttcaatcactgggactcaaaccaccagcatttcaatcactgggactc

SEQ ID NO: 42505 - DNA, 1029 bp, Heterodera glycines
ctgtgacaaattcccaattatcgaaggcatttcgcccctccccactggcagccccgccccgagcaatgggacgagggacgactgaagcatgtgcagcagcagcaatggcgtagcaaccgaggcagaggttcctctgggttttgtctcgtttaaaatgacgctttttaaggagtccgaatcggacaccgccgcgttgcgaaaacgtcgcgaggacgcgtcgacgccacggccgcggaacacggaggaagaaacggacgattgggaagaatgtgagggcgaggccgacaatgaggcgaaggcggcggacaaagcgaacgacgggcaatgaaaggcacaaaaagcggtgaaacgaattttggacgctttcccctcaaaatcaacgtaatttcgtgtaattaaaattctattcaaagttttgagttgaattttcgaaaaataatataatattgattttaatgatttaaaaagtcaacaactcaacatccatccatctatacattaattaataagtccattcctatttttgtgattgaaaactttcaataattgttttaatgaaaattatgtacacgattatttaactgaaaaatgataacattaatttaacttattatacgacaaaaattaaaggaatatttggcaatataaaaagatcaaatgaataaaaatgagagagaacggaaacatcgggggatagtgagggtcaattcgagttgagttgagcgatgctaatttatttgtgagtgcttttgcgtggcttttccttccgctttactcttcgtcgattttggccctttcctcgaaatactgcaacaattcctctttgtaagtgttgcgcacttcgctgtaactgaggcacttcactttgtcaccgcttaaattgttcttttaaaacacgacttgaacatgatttgaggagtggcacttgcatttcaatggcgaatttcgtctgatggagcggaattctctccttcggacttagcgaccctaaaagggtcgaagattcgctggtgaccaatgggccgagga

SEQ ID NO: 42506 - DNA, 1436 bp, Heterodera glycines
  misc_feature (21)..(21): n is a, c, g, or t
ccgggcatgccgaacactccnggggtgaatgccaagccgccttcgtcgagccgaagcagacggatcatctccatccgagtgcacagcaccgggtctgaggagacactccaagtgacctaattggtggaaggccaatcaatcaatcaatcaaatcaaccaatcaatcaatcaatcaatcggggaatgctctgatcaaaagcattttgatcagagaatcgttcatctcatttaaatataattagttaatgatcacaaataaataataaatatttgcgagcttcgtattacttttttattccaaaattcattttatgattgatggaactgaatagtttaaactgttttgctaattgccattgccatggcccacccgtgccaatttaattttcttgccaaattttggcccgtccgaagggccagtcgttgaacacggaggtcgccttccgccgcggacgattgttgcgtctccgcctgctgccgttgcttctgtctcggcctttgtgtgccgtgtccgccggcgccgccatcgccgccggcaccaccgtaactttggcactgtgcgttgcgcacgcgcagcagagagatcagtccgcgactatcccggctgatacggtaacgaaactcggcgaagcccggacggaccaaatgcagcgcaatgctaagcgtggactgaaggggaaagaaggccagtggatgaaaacataaagcatcataaaaggacaatttaattataaaataaaataaaaatggaaataaattgaattttaaaatttaaataatattaattaaaaatatttaaaactgaattaaaagtaaatgaaaaccaaaatacaatttgctttagcccatcaaatcggttttatttattccccgcaagaagtgccactctcaaccatgatattgatcagtctcgaattgttgccccaattttgccgttttcggaatgccttcgtttgtgccccactcacttcgcaatgggtccaccgatagcgcagttcgccctcctccaccgcccatccgcctccgttttggcactgtacgcccatggcaccgccgctggtgaacaaattcgcaaacgattcgtctgccggcgaattttccacggaaaatccctccggcaatttgtccccttcgaattgttcgtagcgcaatcgatcacccaacgaatacgtgcctgagggggaagggagggaggaattcgatggcatttttttaatcgaaaatgccaaaaatgatgaaattttcaaaatggatttttttcgcaagagaaatcaatcattaatcaaataagcatattttgtgctattccttctttacccggtttgcattgttcacacttttgcgaatgcatttcaagaaaatgacccgccggacaaattacacctgaaaatttttttaaattgaaattaaaaaaaaaataaattactgcaattgag

SEQ ID NO: 42507 - DNA, 1016 bp, Heterodera glycines
tattaggaaaaatgtattatctttaaataaaactaatattcgttgcctaaatgctgagaatttatctttataatttgtgttttcaatttattcaaaaaaccggtaaaaatgacaatacttttaactataattttgatggaggtgtgatttttgaaaaattgtgaaaatttgttccccaagagtctaaaaatttttataaaccaaaaaaatcccctttggttacaattttatttttggacattttgcaagtagtataaaaaaagttgtgaaatctttattttaaagatccaaaaacttaaaataaaacaaaaaagaatacgtccggaagctcagttataagatcgttttcaattataaaaaaaatcacgaatttttattattattcattttgaaactataaatatgaattgccaagtattttaccatactttggttttgtttcatcgctttgaaacattggcttcatagctgaaatgccaaaacgcattctgaacaaatattcatacacaatgcccaaatatcgttcaagtttttcgcattcatttccaattttaattttggcattggcacaatgccaattttttttcatcaaatacagaatgccaagatgtctttcgaatcggttagtgaaatcttttgttgttttttcaacagtttctttaaaaatggattcaataacattcacaaaattttttctatctttgataaattcaacaaataatgcctcatcgatctaaaattttaaaaatttattgcttcataaatttaaatatttttaaatgtgtgtgtgtaaaaatatttaaaaaaaatcaatggtcgaacgatattcattaggatgcggattttcattttaaactactttttgtggtttcggtaggaactgctaaatcccagaaaattttcattttgacgattattagcaaaagagaataaaaaaaatttatctaatgaacttaagtttgaaaatctttaaaacgaaaaataaggcaaaattccggcgcaaaaaatggctgaat

SEQ ID NO: 42508 - DNA, 1283 bp, Heterodera glycines
taatttttttgacaatttttattttaaaaaccactaaattcttaattttaaaaattatttctttttaaaaaaaattttccccaaaaaataagctaattcaaatgaaaattttttatttattattaataaaataaaaatttttaattaaataaaaattaaaaataccgtaaaaatccacaaacaaataatgttactcctgcccagattcgactttcccccccccccccctccccccctcccccctcaaatgatgcctcagaatccccaatcacacggggattctgagggcttaacgatgtcataattgaaatctgatcacgtattcgtgatcagcggcccaaataacccctaaagacatgtttttggaagatttttggtgaaaaaattttccaactcaaaaatcctatgctcacccctttggtcccgaatctcaaaatcacttttatttttataaaaattcttaaaaaagtgataaaaatgccaaataaaatttatataatagagcaaaaaactgcggatttttgtagtattttatttttccagaataacttttcagaaccgagttatgaatttttttctgaaaattcgaatttttccagaaattctggaataacttttttccttttttagatagaaattccaaataaagtccataaaattctcctgatttttctctatttttaaggctttattgctgtaaaattgatcaacccttcgatttgttatgaattttcaaatattaggccaaaatcccgagggccaaaaaattgccaaaaaataaagaatttttaaaatattccaaaaaatctgaaacttaaaataaacatcatatttgtgctcaggaccctaatttaccccagaaaaatatttttcaccctctttttcaacccaaaaaaaaatttttgaaaatttctagggggcctagctcgaaaatttttgaaaatttcccttcatatagtataccattagatagagcttaaaaagctctacaatttttctctaaggcattttttgtctaaaaccgacgcctgacgagttatgggcccaggactcaaatgtcccgctgaggccaaaatttttttctatttccgggaaaaaatcgaaatttttccgaaaaaaataccagtcgatagagctcgaaaaactatgttttggaagtggtctccgtttctctgagaaaaatcgttaaaaaatcctaaaattcaaaaacccgaaaaccgttttttaggcctaactcgaaaaatttgaaaattttcgaaatttaaaagactctagagatcccc

SEQ ID NO: 42509 - DNA, 947 bp, Heterodera glycines
ccctccctctgctcctctccaccttcatcacctctctttttcttgaaaaaaccttctcaagtttcgttcatccgcttttccgggatctgtcacttcccttcccccgtcggcggggagagcattcccccccctcgggcagatttcgcggcgaatccctccggggggcggggggggggggagcgaccgaccaccgccagcgactgactgaatgagcagcttctccacctcctcccttgagccaatgtgcacaggtgtctcttatccgtccgctcgccgcgttaagccgctttatcataaggctcgaggcggaaatttgtccatcgcaggcggacgtggttggccaaattccctcgggctacattttggcctgccaatcaatcgcgtgccattttccctcgctcagccatttttgcccggctgactcgcccgtacattgttcttgttagttgaaggtcttccgttttcggcactttttcagcagcactttccgccgttggcactttttaattattttttttctaattttttatttcttataatttcagaaagaaatagcaacaaaataaaagaagaattgtgcctaataaaatatttttgtaaaggattttgtcgttttttacgaattccccggctccgacactctctgagcagcttaaagtgtttgtttgccttatgctcctcccccgtcgttatatcattccaatttttcatgagacctttttaaggatttattttctctcgtcaaattatttcaaatgacttccgatttttatttgattattatttttaaattattttattatttgcaattgcatctccagaaagaaagttaaaattaattttatatctcatatatacaaattattttaaataaaaaatcttaccaataaattctcatacatcatatacaacaaaatagtcttgtcgatctctgaccctgaaaatgc

SEQ ID NO: 42510 - DNA, 1113 bp, Heterodera glycines
  misc_feature (47)..(47): n is a, c, g, or t
  misc_feature (50)..(52): n is a, c, g, or t
  misc_feature (54)..(54): n is a, c, g, or t
  misc_feature (57)..(59): n is a, c, g, or t
  misc_feature (64)..(64): n is a, c, g, or t
  misc_feature (66)..(66): n is a, c, g, or t
  misc_feature (91)..(91): n is a, c, g, or t
  misc_feature (103)..(103): n is a, c, g, or t
  misc_feature (114)..(114): n is a, c, g, or t
  misc_feature (133)..(133): n is a, c, g, or t
  misc_feature (182)..(182): n is a, c, g, or t
  misc_feature (185)..(185): n is a, c, g, or t
cgaacttcgaccaattccacgccttttcgtctactttcctgctgatnggnnntnttnnnaaagngnggcgggtgttctttggggtttcggnatgttgaggttngggtttgtttntcggattggatttttaggntattttgttttaatttttgattaagaattaaaaatgtaattgtgttttnganataattcttgtcgagattacctttttcatttggcctttggtcagtttgagttccttaaaaaacggagtcccttctcccatcgccactgtttccgttgactgcttgtcctgcccttttgctccgtcttaatcagttgtcccattaaattggtgtcctcctttccccaccttcgttttgttcctctgccctttcttcacttttcgcccccttttccattttaatctccttcatttggcactccaattgttccatttccctctcgtgtcgttgcctcagttccgtctccattttttcgcttttttggccgacttccttcttccgttttttgtcattctttgtcagtccatgttttaaagccgttattttcgcttaaacttctctcattagttttatttgactgtattttcaacagtataacacagacccaaaagttccttcctttctctgttgtgcttcgattttagttcttccaatgcgtcttcggtgtttaaatccccactgcagcccattaacattaaattatttgattgttaaaataaaaatagtctagaaaaatgaaaatgtaaacattttaaataatgaaatacaaaataataataacaaagaattacctatcatagaatttattgaaagacatactggagaaagaataaacatctgaatattatgaaacaatctgagaggtaaaaaaggcaaatacacaaaagagcaatgagaatcgaagaagataagcggcactatctacacataaaagactccatgctgttcatacatggcattcaccagcagtgcggcacggcttgcaaccgtattggcagattcggggggagccgatttgaccaattcggcccagtcgagcaggtcaaaaaattgtgaactgaaatttaaggtatattgacgtaatctcttctcaaaaggctcattatga

SEQ ID NO: 42511 - DNA, 808 bp, Heterodera glycines
  misc_feature (360)..(360): n is a, c, g, or t
attttattcatctcccttttggatagaaaaaccatcagagtccttaactaacatgtaaataaaatttggtgcgtttcagacccctttctgaaaaaatatttaagaattaatttcgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaatgtccgtttggggtactcaaacaattatggggagcanaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaagttaagcctaaacttaaaggcctgtttaaaaaggaattaaaaatttt

SEQ ID NO: 42512 - DNA, 788 bp, Heterodera glycines
tatgtgaactttcgattttttgtgcgaattcggatctgggtttaggaattggtcgtaatggatgtcatattcgtaatcattgcaacgaccccgataaccccataaaacattttttggactataattttaaaaaatgaaaaaaaaacctgatgaaaaatcatatacttgaaaaaaaatcatgattagatagatgatgtcatatggaaattctgatgtaatatatcagaatttattatatgcatgaccttttcatggctttttcttttgtcattgtaattttccaatttctgcttaaattctctattgatcgaaataatattttcatgcaattatatttccatttttacaataaattttccttctttttttttctctctacaaatgaaaaaaatgaaatgccaaaaaaagattttcacaatgccaaaattaaagcaaaatcgtaaaaatattgcccaccggtttacctcagttgggccccgcacgtttgggccccagcggggttttggctataaattttttttgccaatcaaatccaacaatcttggtatcattcgataccctaatgttctctattagtctgaaaaaatctgaaaaattttcgttaaggttcaaatagttatgaccaaaaaacttcaaaaacccagattttccaacctttttggtcataacttttttgaatcttaacggaatttttcagattttttcagactaatagaggagagttagggctatcgaatgataacaagattgttggatttgggtggcaaagaaaaaagtcatagccaaaa

SEQ ID NO: 42513 - DNA, 885 bp, Heterodera glycines
cgaggccgcgaagaggccgagggagtactttcggtgcaggaaaattattaaaattttaaaattttttaattgcttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaaattaattcataaatatttttcagaaaagggttctgaaccgcaccaaatttttattacaaggtaaataaggctctctgatgctttttctatcattattgggggtaaataaattttaaaaattttttaattgctttttaattatgccaaaaaattaaggcttactttttagtgaaagtttgatcactcatatttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctgttttatcacattagcttgtcatcagtttttat

SEQ ID NO: 42514 - DNA, 1204 bp, Heterodera glycines
  misc_feature (70)..(70): n is a, c, g, or t
  misc_feature (109)..(109): n is a, c, g, or t
ttgttttaaattttattttctctttgagatgtgatgcttcccggcgtgtttgtttataggaacgaaaagnatttgaacattttattttttttcatcatatttttgtgtnatgaatttcttttctcaagtaatcatcgctaatgataattctcgtaaaagattaacacaaaattacgtgctattcaatcacctaatgtgattttaaaaattattggatttacttctcgctaatatttaaagatattttttgattatttttattatttttaatttataaatgcatgtttccaattagattttacaaaaaagttttttcttgttttcagaaagacctttgatccaatagttaaatatttatactggtttatttattcatatgaaacctaaataattttattaatattaactaaattttgcctacatttagttttatactaagaaatgatattcttttttgggtcatacattatttattttaatgaaattttattgaaatacatgtacatatcttattaaagaaaaatataaaaaatcttttaaatttatttattttctaagacagagtatattttaatgaatttatttatttagttcttaaacaatatttgcaaatattttagtaaatttagttttatatttgttatattttttccctgaaattgattttggtcaccatttgaatatttcccatatgtttagagaccttcatttgatcctacttgaggtctcgatgacttaatttttgaatttattacttaataaggtttttatttaggcatttaattacttcttgttattttttattgattttaaaatttaccattcttattaaattgtttttaagaaaaatttagaaatattttgtttttaaaaattttttaattcgcagtaaaatttttaccgaataatcgcattaaataaagattttaaaataattaaatgtaatataaaataataaaaagaacattagatatagcataaacattgaattataacaattcaaaaacaattttttcaaatatgtcaaattttaatgggaaataaatccaacattaaaggtttaaaatacacaaaatatattcatggttatatattaaataacgtacttttataaatttaattgtaaaattatacaataaaatgaattttttcttattatctatgaaattatttcattattacaaagtgtaaaaaactgttattg

SEQ ID NO: 42515 - DNA, 992 bp, Heterodera glycines
gaatgccgtgattgccaaagcggaatttgcagctttcgctgcttttttgtgtttttcgtcttcagatggtgaggaatggctgcttttccaatggacaacaaagaaatgtcaaaattgcatgggacgcaatgcgcaaattcatctcctgttttgctttttgtgatcccctgaaattcattggaatattcacttttaaaaaagcttttgcgcttaggcggtgccatttgttagtaatatgtagtgcaggtgctaaattaaaaacaaaagagaaagacaataaagcaataaaaactaaaataattacccaaaaataacagcatgaaagaaattataatgccaaaattgaaaatatttttcttaaacagtatgccaatcagaaatttttaaagaaatttgacagatttttctgagaagcgacaaataaggacaaagtaagaacaatagcccgaaatcagaacatttcttacaaataagaacatttttattttgtaagatttgaaccctccaaatcagaacatttcttataaataagaacagatcacatccctggttttaattgaaatgaattattaattttttatttggttttccatgaaatatttataatattttgttattaaatttagtaatcagtttttttaaagttaatttttttgctggagagagttaaaaatgttcatagtattagtctctgggtttttatgccgttttgaaaattcttagatattttgacttacattgaaaaatttaagattttgttagctttttttaaaaaaatttactgtctcactgacacattttctactaacatatttttacaaatgcatataaaatatgagtaattatataaattttttcatagtaattataacatctcctatatagaatttgttttacagaaaataaaaataaatattaatgaatgtaataaatcaatcaaaatcatagcaatttgccagcacaagtcattaattaattcttatatttatgaa

SEQ ID NO: 42516 - DNA, 874 bp, Heterodera glycines
agcaattttcaacccgacattttgtagggctcacccgcagatagtaatgcgtttttggggaaaacccaccatgtacaccggtgtagaaaaaaagagatagccattttctgagaatatctattcttctgagacagcaattttcaaaccgaccttttgtagggctcaaccgcagatagtaatgcgtttttggggaaaacccccatgtacaacggtgtagaaaaaaagagatagccatttttctgagaatatctattcttctgagacagcaattttcaaaccgaccttttgtagggctcaaccgcagatagtaatgcgtttttggggaaaacccccatgtacaacggtgtagaaaaaaagagatagccattttctgagaatatctattcttctgagaaagcaattttcaacccgacattttgtagggctcaaccgcagatagtaatgcgtttttggggaaaccccacatgtacaacggtgtataaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaagagatagccatttttctgagaatatctattcttctgagacagcaattttcaaaccgaccttttgtagggctcaaccgcagatagtaatgcgtttttggggaaacccccacatgtacaaccggtg

SEQ ID NO: 42517 - DNA, 809 bp, Heterodera glycines
tttgaaatgctaacgaaaaaatattctttccgaaaaaaaggcttatctcttttttctcttggggatttggaccgccaacttggtaccaacatttccttttttagtctggctctatcaaacactcacacgatatttaaaatacaaacgaaaaaaattcttgcctaaaaaatggctatctcttttttctcttggggatttgaccgcaaacttggtaccaacattttgccttctctagtctggctctaccaaacactcacacgatatttgaaatgctaacgaaaaaaattcttgccgaaaaaatggctgtctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctgtctcttttttctcttggggatttgaccgcaaacttggtaccaacattttccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattct

SEQ ID NO: 42518 - DNA, 1068 bp, Heterodera glycines
  misc_feature (1050)..(1050): n is a, c, g, or t
aattttgaatttagaaaacatgcaatattaaccatgcatccctcccagaaatgaagccattcaaaattaagaacaaagacggcctttccaatgattacacaggcaattttgaaaaaaataattgaacaatcaatgccttctgccaatatttcagatttttgggtggattacgagccgatccgtcactgcacttccgatcgaccaatttgcgagtcgaggttacccaacagaatgccaaaaaagattgaactgacgccaaacttcacgcaccttccctctcacagattccttttctgtgatcggtccgtttggcgctgtcgaagtcgaattgtgttaggcggcaattgtacaggctttgcgggcactgaaatatgctatggatcagtgtgcattcaggcaagacaccaaaagtgaatttagcgtttgatcgaattaaattctcagccgaatcattggcacaccagtgatcagtcagaacttaaacgaaaaaaaggggggggggtgacctgtaaattgattgtaatgatggtatgggttacgtaccgtatccattcatcccaattcgctggctgatactgtagttaatttcctgcttatctccttgggatcagacatcctcctacaatttctgtgctgaatttggtatttttcagaatgtttgccgactgccggcgacggaaggcaatggatttttgaggcgcgaagtttgtttcggcatatcgaaagtgaatgatttgatcgcttctccgttctttcgttgacagcgtcgcccgccgatcagcgaagttgtgtgggcaaagagttggctgttggaggagggcgcacggccgacgagcagcggaattgcgcacgtcgtggtcagagaggagggggcggcaatggaaggggaaagaagcgcttttgtgccccggcacactcagtacccggagttgccggtgggtgggactgatcaggcagagcagagaaaacattgctgattcactgaactggtcgatcagttcatttgtcactttgcgcttccttgaatttcgatcgcttttcttcccttanggcgtcctttatttgccg

SEQ ID NO: 42519 - DNA, 1377 bp, Heterodera glycines
aaaaggcataataaaagtcaattgtagaagggaaaatgggtttttttatgctcaataatcggaactaatgcgcagaaaaaaggcatacacctcaaaagtgggtctctactaatttcataatccttaattattaaataatttaaaaaactaaacacattaaatgtaaaattttaatacgcatatttatttagcttgagtatttgttgaatttcgcaacaaatgttgtcaagcagttttgccaaactgaagctgcaagcgctgaccgcacacttttacccattgccaaacgtgactatttaatgcaaaaattaatacatattgctaacttttggcgttgggcacactgacaggaaaaacctgaaaatattttcccaaatcttctcggcggtgcctattagccttgcttaacccggcccaacctttttcgtttgcttcggcacctatcggcaccgccgaaccaccattttaccatatttttgaaaaatggagaacaaaatggcaaaaaatagtaattttttggcgaaaaacgactaaaatttttgtaaaatacactccataattcgggatttcaaaaaacgaaaaatacacccctaaaaacgactgaaaaaagaaaaatatacccctaaaaatcgagtttctgatttcagccccctccgaagccaagggtctggctacgcccttgccctcccccttgtccacctataccgtatcatttcctttattaatattcaaaatctcagaactgtccctactcgactaccgtatcgacaacagtattcgcttatatgatgaaattaaatctttcaaaaataggcaaacatccaagcaacggagaactgatcgaagtgcaattaaattcaattaatttccaaaagaattattcaatgaatcttaaattaaaaaataatactttttaaattaataatttttcttcaattattcatttcgccctaaaaacattttttaccattttataaaataataaaaatgtttttccattaaaaatgcaatagaatagggaaaatacaccccctaagaaatgacctaaaaaaatttcagaaaatacaccccctaagaatgaaaattttctcttctcaaaaattgatcgttaaaatttaattttttttttgataaaaattttaggtttaaaattttccttattcgaaaaacatttataaaatatttaataatcatttagatgaccaaaatttagttatttggttaagttttacgtgttttgctccctaaaaaatccgtaataaaaaattttaaatgtcctttttcatgcctttttcggaattttcgtgcttttttttcaattttttggtgcctattaatagtgcctttttcgcgatttttggtgatttttttttgcga

SEQ ID NO: 42520 - DNA, 977 bp, Heterodera glycines
aaaagagatagccattttttctgagaattaattcacaatttcccgcagctctgcgggtaatggaaaaaatttgaaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaattttgaagagtctctgtggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttacggtaatggaaaaaatttgaagaggctctccggaac

SEQ ID NO: 42521 - DNA, 869 bp, Heterodera glycines
  misc_feature (20)..(20): n is a, c, g, or t
cttgcatggcctggcaggtnctcgattttttcaaggtggtccgttgggggtactcaaacaattatcccactggaaaaatccaacgcagaattaaagtacaggctatagtaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagctaagcctaaactttttggcctgtttaaaaaggaattaaaaatttttaacaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcattagcaaaaaatatgagtgatcgaattttcactaaaaaaggtaagcctacctttttttggcatatttaaaaaagcaataaaaaaatttttttaaa

SEQ ID NO: 42522 - DNA, 953 bp, Heterodera glycines
accttcttgtagagctcgagctgctctttccaatgctccccacagaggtctcgatccgtgtcgaactcacaaagttatgcgagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaattttaagagaattttgattattaatttgagtcttgaattatttgacaaatccaagacttaa

SEQ ID NO: 42523 - DNA, 1017 bp, Heterodera glycines
cccccaaccggaccacttgaaaaaattgattttttttgtttttggggccatcccccccgaaccgaatcgcccagatttatggggaaggccgaatccttccgggaataggttccctatagcctgtctttaatttttgcgttggatttttgctccccataattgtttgagtaccccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggaggcgaaggcccaccacgaggccgcgaagaggccgagtga

SEQ ID NO: 42524 - DNA, 821 bp, Heterodera glycines
  misc_feature (55)..(55): n is a, c, g, or t
  misc_feature (60)..(60): n is a, c, g, or t
  misc_feature (63)..(63): n is a, c, g, or t
  misc_feature (65)..(65): n is a, c, g, or t
  misc_feature (68)..(68): n is a, c, g, or t
  misc_feature (70)..(70): n is a, c, g, or t
  misc_feature (98)..(98): n is a, c, g, or t
  misc_feature (101)..(103): n is a, c, g, or t
  misc_feature (107)..(112): n is a, c, g, or t
  misc_feature (114)..(116): n is a, c, g, or t
  misc_feature (119)..(119): n is a, c, g, or t
  misc_feature (123)..(123): n is a, c, g, or t
  misc_feature (129)..(129): n is a, c, g, or t
  misc_feature (131)..(131): n is a, c, g, or t
  misc_feature (139)..(141): n is a, c, g, or t
  misc_feature (143)..(143): n is a, c, g, or t
  misc_feature (148)..(149): n is a, c, g, or t
  misc_feature (154)..(154): n is a, c, g, or t
atgaatgcgaatgattggcacatgtttgaagtgccggacatacatgaggcacagntgatntgngnggngnggaaaggggccccttttcagacggacgnacnnngacnnnnnnannnggnaaanaaaagngngccaccannngncccannagctnaacccgtcgctagcgcgcagacagcggatgggcgggggggggggaggggagaagcgggcaagcggaggagggacccctaccctcccatgtagcctcctcatccaaaaaagttcgtgtcaattttgtttaagaaatttgcataaaatttttccgatgaatttttatacttgtttttgtttgaatctttaaaaatgcttaattgaaaaaatcgggacgatgttttatgcaattttgaccttttgtaatacaatacttaatgctacaatacctagcattttccaggggcctttttcggcaccgtcggaaaccctttggcagctattgaaatgaaaacttccgggtttccattcctacatttggcactcgcatttaaatgcataaacaaaaataaataaattataatttttattataggtaagtgtaaaaatttaacagcaccgatgaaatggaaatataattaacattaattattgataaagtgcaaattattgggcaaatgcgaatttgggggaggggcgaaagaaagtggcaaaaggcaaaatgaggcattttgggggagagggcttattatttattacgaatgcgtaaagggaaaaagttagcaaaaaatatattatataaaaatttttaaaggaaacataacaacggaagagatttttgagtggga

SEQ ID NO: 42525 - DNA, 977 bp, Heterodera glycines
ggggacctctagagtccttcaccacacccctttgcatgtatctcctagcagccatccccacggttcaatttgcttatatctaatttttggagattttctattttaaatttttcaaaattaaaaaagcgagattttgcgggatttatccctgcgggtcccgtcccgcaaaaattttgacttctattgaaatttccggtctctatcacagacgtcgcaaatacaatttttggttgcccttttagcgccgctcgtcgtcccaaagtttcacttcgatgactctgtgctcaatgaacacattttggttaatgtgatcaacagtttgagcatgatctcctcgtcttattttgaagaatgcaatggcaccgaatgtctttacgcgcttttttccaaaccgaaattgcaaaatgttagtgcatttgcttatagcaatcaatcgcttatgcattaattatgtgataatttttaaatacctaataaatggctcataatttggggggagcgtaaaattaggctcattaaactgacatatcaattaaactttttattatctacttattttctttaattaataagattttccagtgaaaacccatttattttaaattgataaattatttttaattttagttcatttttttgcataattactgaactttcaggaggatgatctgccctataaaataatggaggacaaaaccttttgccaaaaggcatcagaaaaactcaaaaaagtcatcaagataaaatctgagaacgaaaatgcgagagaaatgtttgacaaagtcatgaaagagatgtctgaaaaggcgaaaaagatgtacaaagagcagaagtatatcggtaccacttattttaccaaattcatttggaactcgccttttttgcaaggatagacaaagtacggtacccagaacaaatagtattacgatattcatgattcattggcgtaatcaagggcgagaagggggggggggggg

SEQ ID NO: 42526 - DNA, 704 bp, Heterodera glycines
ccctttggcccgcagtcccttcagctgctcgttgaccacgcgttggctctccttccagccggactgaacaaaaggcaaaaattgggaaagggaaacccatggaaaaaccaaaacaaatggggaaaagccatcattgaactccctgaaagccatggggatcaaaaatgacaacaaataaccttgatgttgcacgggtactcctcgaatgtcatcagcatataacggtcgccggaggaggcggggtcgcgttggcgctgctgaaaaaaggcaaattaaaatgtccacaagtccattcagcggcagataaaatacggccaaagggtccaaattaatgcatttaatgccctcattttccctcctaattggcagctaattttttttcccaattaggtttggttttttcaactgtttcattcatttatttttgtttaaccttcaaaaattgttcaactgtcagccgtgcaaagtcgagcagagttgtgcccaaatattgcttttgcatcatcgatgcgctggtgtcaatcagaaatacaatcacagtcatttcggacaaaaagatctgagctttatgtattcggatgagtttcgagatcgctaacaataagcacaattaggaaagcaaatgttcggctgcttttaaacccacgaaagctttgaaaaagcccgagttacaccacttgaactttttaaagcaaaatttgata

SEQ ID NO: 42527 - DNA, 1174 bp, Heterodera glycines
tgtcgagctgtgcttccgtcccccgctgccgttttgcttcccaagggcggcggtcttcgccaaatgatgcgggtactgtctcaaatcgacgaaagcattccctgcaaaaaatggaggaattaaagcgaatttcatattctaaagagacggatgccaaccatttggcactcctccgccaaatttgaattcattttccatcgccgacgcggcgggcacagcggcggaagcattggacgaagtcggagaaagcggcgaatttgcctgaaaaggaaagggaattcaaatgaccacaaggaaaaggaaccaaatcattaaaaggaattcgtaaataaacaaaaattgcgacctccgccccacggccaaaggcaccgccgcaaccgttgttggcaccgttcaacagcattaagccgttgatggatgccaacgaaaaggattccccgtcacagtcgcgcaacggcgtactcgtcctgtcgggggggggggaattataatggaaaacatttgaaaatggaaatttaacgggggttttgatgaaaatccaaagagtttgtttcgtttttttccctccaaattcgtccctcttttgtccacctccgtttgctctgtcgatggtcagctgacgaatcggcggtgactgacaaagcggcggtggaagcgggccgaggagagacagagccgtggcggcgactgtcggcagcggcaccgcccgcggcaaaagaggaggcgccggtgttggcactttctttggcttccgacgcagaaatgttgccagaaggactggtgcttgtgttattggcgttatcgcgattggttgcgtcattattgccctgaatttcccatttcgaaattattttcaattgattttttgccaatttattcgttctttttgcccttccattttttattgtcagccttttctagccccgttttcacctgcccaaaatgcttttgttcatgtgcagcagcagcagcagcagcagtgttcggctgctgttgggaggcgaaaagtccgccgaaagtgtcgttaattagggaggcaaaatgtgccgcggcggcagcggcggacgacggaggggcggacggaacggagagaggcggcggaggagggaaaaggaagggcgacggatggggggcgaggggagcggggggaggcgcgtgggaaagggcggcggcg

SEQ ID NO: 42528 - DNA, 945 bp, Heterodera glycines
  misc_feature (71)..(71): n is a, c, g, or t
  misc_feature (93)..(95): n is a, c, g, or t
  misc_feature (98)..(98): n is a, c, g, or t
  misc_feature (104)..(104): n is a, c, g, or t
  misc_feature (108)..(108): n is a, c, g, or t
  misc_feature (113)..(114): n is a, c, g, or t
  misc_feature (138)..(138): n is a, c, g, or t
  misc_feature (141)..(141): n is a, c, g, or t
  misc_feature (143)..(144): n is a, c, g, or t
  misc_feature (161)..(161): n is a, c, g, or t
  misc_feature (184)..(187): n is a, c, g, or t
  misc_feature (200)..(200): n is a, c, g, or t
  misc_feature (211)..(211): n is a, c, g, or t
  misc_feature (226)..(226): n is a, c, g, or t
  misc_feature (261)..(261): n is a, c, g, or t
  misc_feature (290)..(290): n is a, c, g, or t
  misc_feature (296)..(296): n is a, c, g, or t
  misc_feature (331)..(331): n is a, c, g, or t
atgtgacactcttatttttaatgaaacaaagcgtaattcccacacgggaaattttttatgtattttctgtnagtgttttctttgtggggaggnnnaanttttgnatgnattgnnttgatttatgatgattgattgaangtnannaaaaattatctatatanaattaattttatgtgaatgaggnnnnaaaaattgagtgnaattatttttnattggggggggaggnaaattgtggtaaaaaatggaaaaaatggaatgganaaaaattgaattaaatttaaaaaaaatanattttnggaggaggaggaaagaattggtttttagtaaattnaaatttaacatttagcaagactaattggctttgtatagaatactccggaaccgggaattttgggtaaaaccgggaccgggacctaatcgggttgaaaaaccgggactttttggctgtgaaaaccgggaatttcccggtcccggtcaaaactggtcaaaaccgggaccttgatactcagatgaccgtgttttggtcccggtcccggcgcactctagctttgaaaaacaacaactcacacaaatgtgtactgagttttaacaatggaagaaagaaaacgttttgtttacaaaaggattcttaacaaattgaaaattttcataaaaaatgacagtaaaattgtaaaaaaaaaaaaattcgcattaaaaagaaaagattacaaattaattttgttttttttccgcgtctgtctttttgattgtttgttttgttttacgttttttttttatttgctttgtgctttacgcgttttcatgtttcttccgatttgttgaaaaacaaataatcaattcgtatagttttgtacttttatattgcaccagaacataagtgaatcgaagaaaataacattaattaattttggagaaaaatattattcattttatgctaataatcaa

SEQ ID NO: 42529 - DNA, 1018 bp, Heterodera glycines
  misc_feature (63)..(63): n is a, c, g, or t
  misc_feature (67)..(67): n is a, c, g, or t
  misc_feature (81)..(81): n is a, c, g, or t
  misc_feature (89)..(89): n is a, c, g, or t
  misc_feature (102)..(107): n is a, c, g, or t
  misc_feature (109)..(109): n is a, c, g, or t
  misc_feature (111)..(113): n is a, c, g, or t
  misc_feature (116)..(116): n is a, c, g, or t
  misc_feature (118)..(120): n is a, c, g, or t
  misc_feature (126)..(126): n is a, c, g, or t
  misc_feature (142)..(142): n is a, c, g, or t
  misc_feature (150)..(153): n is a, c, g, or t
  misc_feature (160)..(160): n is a, c, g, or t
  misc_feature (170)..(172): n is a, c, g, or t
  misc_feature (179)..(179): n is a, c, g, or t
  misc_feature (181)..(181): n is a, c, g, or t
  misc_feature (183)..(184): n is a, c, g, or t
  misc_feature (252)..(252): n is a, c, g, or t
  misc_feature (260)..(260): n is a, c, g, or t
  misc_feature (281)..(281): n is a, c, g, or t
  misc_feature (288)..(289): n is a, c, g, or t
  misc_feature (302)..(302): n is a, c, g, or t
  misc_feature (318)..(318): n is a, c, g, or t
  misc_feature (320)..(321): n is a, c, g, or t
  misc_feature (323)..(324): n is a, c, g, or t
  misc_feature (353)..(353): n is a, c, g, or t
  misc_feature (358)..(358): n is a, c, g, or t
  misc_feature (362)..(362): n is a, c, g, or t
  misc_feature (387)..(387): n is a, c, g, or t
  misc_feature (392)..(392): n is a, c, g, or t
  misc_feature (398)..(398): n is a, c, g, or t
  misc_feature (426)..(426): n is a, c, g, or t
  misc_feature (449)..(449): n is a, c, g, or t
  misc_feature (457)..(457): n is a, c, g, or t
  misc_feature (474)..(475): n is a, c, g, or t
  misc_feature (478)..(478): n is a, c, g, or t
  misc_feature (482)..(482): n is a, c, g, or t
  misc_feature (484)..(484): n is a, c, g, or t
  misc_feature (487)..(487): n is a, c, g, or t
  misc_feature (489)..(489): n is a, c, g, or t
  misc_feature (491)..(491): n is a, c, g, or t
  misc_feature (496)..(496): n is a, c, g, or t
  misc_feature (510)..(511): n is a, c, g, or t
  misc_feature (516)..(517): n is a, c, g, or t
  misc_feature (527)..(529): n is a, c, g, or t
  misc_feature (532)..(532): n is a, c, g, or t
  misc_feature (546)..(546): n is a, c, g, or t
  misc_feature (549)..(549): n is a, c, g, or t
  misc_feature (554)..(554): n is a, c, g, or t
  misc_feature (561)..(561): n is a, c, g, or t
  misc_feature (578)..(578): n is a, c, g, or t
  misc_feature (586)..(586): n is a, c, g, or t
  misc_feature (588)..(588): n is a, c, g, or t
  misc_feature (602)..(603): n is a, c, g, or t
  misc_feature (616)..(616): n is a, c, g, or t
  misc_feature (629)..(629): n is a, c, g, or t
  misc_feature (660)..(661): n is a, c, g, or t
  misc_feature (666)..(667): n is a, c, g, or t
  misc_feature (675)..(675): n is a, c, g, or t
  misc_feature (677)..(677): n is a, c, g, or t
  misc_feature (679)..(679): n is a, c, g, or t
  misc_feature (684)..(685): n is a, c, g, or t
  misc_feature (687)..(687): n is a, c, g, or t
  misc_feature (690)..(690): n is a, c, g, or t
  misc_feature (692)..(692): n is a, c, g, or t
  misc_feature (695)..(696): n is a, c, g, or t
  misc_feature (698)..(698): n is a, c, g, or t
  misc_feature (707)..(708): n is a, c, g, or t
  misc_feature (711)..(711): n is a, c, g, or t
  misc_feature (713)..(724): n is a, c, g, or t
  misc_feature (727)..(729): n is a, c, g, or t
  misc_feature (731)..(731): n is a, c, g, or t
  misc_feature (733)..(735): n is a, c, g, or t
  misc_feature (738)..(738): n is a, c, g, or t
  misc_feature (745)..(745): n is a, c, g, or t
  misc_feature (748)..(748): n is a, c, g, or t
  misc_feature (790)..(790): n is a, c, g, or t
  misc_feature (794)..(794): n is a, c, g, or t
  misc_feature (804)..(804): n is a, c, g, or t
  misc_feature (807)..(808): n is a, c, g, or t
  misc_feature (824)..(824): n is a, c, g, or t
  misc_feature (849)..(849): n is a, c, g, or t
  misc_feature (854)..(855): n is a, c, g, or t
  misc_feature (858)..(858): n is a, c, g, or t
  misc_feature (866)..(866): n is a, c, g, or t
  misc_feature (880)..(880): n is a, c, g, or t
  misc_feature (889)..(889): n is a, c, g, or t
  misc_feature (905)..(905): n is a, c, g, or t
  misc_feature (916)..(916): n is a, c, g, or t
  misc_feature (921)..(921): n is a, c, g, or t
  misc_feature (928)..(928): n is a, c, g, or t
  misc_feature (933)..(933): n is a, c, g, or t
  misc_feature (936)..(936): n is a, c, g, or t
  misc_feature (940)..(940): n is a, c, g, or t
  misc_feature (950)..(950): n is a, c, g, or t
  misc_feature (954)..(955): n is a, c, g, or t
  misc_feature (960)..(960): n is a, c, g, or t
  misc_feature (964)..(964): n is a, c, g, or t
  misc_feature (972)..(972): n is a, c, g, or t
  misc_feature (977)..(977): n is a, c, g, or t
  misc_feature (1002)..(1002): n is a, c, g, or t
tctagagtcccatttttcgcaccgtgaatgttatttttattgtattcatttcaataggggagnagantagactagaaaaanaggaaaantttctaaagaagnnnnnnantnnnttntnnnaggggnattattttgtaaagtntttttttnnnnaataaanttgttaaatnnnatttttngnanngtgaatgttatttttattgaattctgaaccggttttgagtagattagaataaaaaaatatgagtgatnaaaatttnagtaaaaagttaaaaataaantttttcnnaaagttaaaaagnaattaaaattttattnanntnnattattgatagaaaaagtattagagtggntaaantaanatgtaaataaaatttggtgggtttnagaantttttntgaaaaaatatttatgaattaattttgnaaataaataaaaaagaaagaatnagattttngaaaaatttttttgagnnagntagntnggngntnatttnagtgtaagttagtnntttannggggagtatnnntgnaaagtttggtaagnttntggtnaattagnaaaaaatatgagtgatngaattttnantaaaaaagttaagnntaaattttttggnatatttaaaaagnaattaaaaaattttaaaatttaataattttnntgganngaaggtantnantcggnntnttngnggnntngtggtgggnnttngnnnnnnnnnnnnttnnnangnnnttnagagtanganaaatattttaataaaaattttgaaaaattgattagagtaatngaangttaatgganganntaatggaaaaaaattnttgaaggagagaatttaattaaatntattnnttngggggaangtggtgggtggtgnggggtaagnagtgatggtttgtttnattatggtatngaatnttttggntagtnagnaatngttggttaanttgnnagatnggangggtgtgnatgantttatgaaaaaaatatttatgaaanaaaaaaattgattttt

SEQ ID NO: 42530 - DNA, 620 bp, Heterodera glycines
catcattttacttattaatcgcccaattaattggtcgcccccccgtaaatgattgggtaaagttggcatatgccattgtgtgctaaaattgacaggaaaccggccattgcaactccggaagtgtcggccaacgaaataacggtcattttgaattctctggccatgggtgaagcctaaaaatgaagaaaatttgttaaattatttttatttttaatttaaacattctaattaaatagtttacaaagaaagctttacttgttggtgaattttgccgaaaaagttgcaacatgcgccgttgaccattcccacaataaaaattgatacaaaaacgaacaaaatgtgcggtataaaacggaacagagcttggccaaagaaaatggccaaattcgctaactgaaaatggtaaaataaaaatttaattcaaaaattttaaatgtaaaaataccataagaaaagggagtgaataaaaaataagtgatggcatttcgacaaaaatggcactgagccgagaaaggaaaaggccgatcagatggaaagtttgtagccagcggaattggctggccaacgacaagccaaaactgtgagcacaatcgaatttgacatgttgcagctgataaaat

SEQ ID NO: 42531 - DNA, 886 bp, Heterodera glycines
aacctcggccacacactgttggatcctcccccactgacacagggaatggacagggagagggcggacacatatttgtgtgttcggtaataggtgtccgcaatcagataggccgtttcgtcggaggccaaaggatgctggaaatgaatgacatgacaccaattagtaaatcagaatgccaatttggaaaaaatgattttggaattgtgtttatttgtataacgcggtgaattatcctaaaaaggctttttttaccgtaaagtcttcaatgatactgcccccgcgctcctcaatcacttcttagtgttgccgggcagtttgaccttctgttcggctaaagatacatcagacaacaggctcgtcggaaccgctgaaaatgaaaaaaaatattttcgcgttaactcatttcgcctcaattttgggggaggggaaagctgccaaaattggcacacatactcttttcctcgtaattgtgtcattctcattgtccgcaggaggagaaggttcgtctgcgattttcttgatgtacaaaggcactgcgcggaccaaatacgagccgatgtcgtccaaaactgttgcatagaatttgggcgactaaaaattgtaaaattatttaaattttgctccccctttactttacgtcttttctgctggtcaccaaagtgcgtgccatgttgaatgcttgatgctgaaaagcaaatgtacaaaaatgaatgttatggcacaatgccataagaatgcacccgcccagattcgttttacctttttatcgtcagacattttggcgtcggcggtgaaggcgagaatagtgggcaagaatttctgaccaagatattgctggggaagaaaataaagtaaaattagataggccaacaattatgtaacgaaa

SEQ ID NO: 42532 - DNA, 620 bp, Heterodera glycines
ttctcgtttgtggggagaaattcgaagaattttcccatccacgccatttttagtgtaatatgttaacagaaaataataaactgaagcattcgttttaataatataactttttttgttgttaaccaaatccagcaatcttggtatcaatcgaaagcttaacatgtttagaagatatttctaagctattgcttcgcgattagacaattaccaaaaaagttataacatgaaattccaaaaaagtcgaaatttttgagtttttttcttaataacttttttagaagctaaaatttttgtttgttttttgtaaggctaatagagcttgtgaagggctttcgaatgataccaagattgttagatttggtcaacaagaaaaaaagttataataaaaaaactgaggctggcgccaaaacgtcggcgccaaaacgacccagtcccgcaatttttagtgtaatatgttaacagaaaataataaactgaagcattcgttttaataattaaattttcaaatatattcatttcttaggggtggaaatttcgcatttcgcgccaaaaagcgaaatgcgaaacgccaaaaaatgcgaaatgcgaaaagcgaaaagcgaaacctcggcccatccctg

SEQ ID NO: 42533 - DNA, 838 bp, Heterodera glycines
ttggtttatttttgggtaaattgtgttcacttgccattaccttgaggcgaaagcctttgtttgtacggatgtcactgttcggctcgacttcgtaaacttttgctgtctccacaacttcgactacctgagccgcctaaattccaaacagttcgctaagattatttccgtttaatataactgacgcactctgtacacttgcttcccatccgatttgttgggaccgattgaaatgcgaacgaagcaaccgaccactgttttagcgaagaacggagcatgaacaaatttcgcgagctttcgccggaaaagttggcaacggataatttcatcccttgttttaatctgaatgccaaaatataaattcgaaatgcgttggaccacctcttgtttgacttcgggagaaggagaacgtgacttggtcaagtcggggctggaggaacgcgaagaactcgtcgacgaactgctgctgccggccgattttccaccttcgttttcgttgccaaatatttcgtccaagtcgagagtcgccttcaatgtctccttcttccgcttttcttcggcttaaaaagtttcaattacatttcaattcatccaccgactcttctttctctccaattgccttgtattttattgcgtcgtttgctcaataagtcggccatggctttctttttactctgtttgttcgcgacttcggatggtttgtggtattccgtgtcgatttcgtcgtccgactcatcgggttcagctttaaccgcactcttcgaatgtgatgtctcttccgcgtcgtcggaactgctttcggctaaaagtttggcaaatgacataattagggccaatatct

SEQ ID NO: 42534 - DNA, 970 bp, Heterodera glycines
aaaaatttatatatttttctgaaaaattttataccgcacaaatgctctcaagcatgatagggagagcggtgcgcaatggatattatattgcccagagaatttttagcttctaagaggaattccagaaaaatggctatctttttctgaaaaattttataccgcacaaatgctctcaagcatgatagggagagcggtgcgcaatggatattatattgcccagagaatttttagcttctaagaggaattccagaaaaatggctatctttttctgaaaaattttataccgcacaaatgctctcaagcatgatagggagagcggtgcgcaatggatattatattgcccagagaatttttggtttctaagaggaattccagaaaaatggctatctatttttctgaaaaattttatacagcacaaatgctctcaagcatgatagggagagcggtgcgcaatggatattatattgcccagagaatttttggcttctaagaggaattccagaaaaatggctatctatttttctgaaaaattttatacttttctgaaaaattttataccgcacaaatgctctcaagcatgatagggagagcggtgcgcaatggatattatattgcccagagaatttttagcttctaagaggaattccagaaaaatggctatctttttctgaaaaattttatactgcacaaatgctctcaagcatgatagggagagcggtgcgcaatggatattatattgcccagagaatttttggtttctaagaggaattccagaaaaatggctatctatttttctgaaaaattttatacttttctgaaaaattttataccgcacaaatgctctcaagcatgatagggagagcggtgcgcaatggatattatatttgcccagagaaatttttggtttctaagaggaattccagaaaaatggctatctattttttctgaaaaattttataccgcacaaatg

SEQ ID NO: 42535 - DNA, 1251 bp, Heterodera glycines
  misc_feature (1084)..(1084): n is a, c, g, or t
ttcaaaaatgaaattaaccgttaccggtttgtctagtaccggtacagccggtaaaaatttgcactggtaagaatgggggtctggtcgagaaaagagaaggaaattggtgaagaaggagaaatttttgagaaaaaattaaattttatttcatttagtcatgggattacacacatgcacatgtggtgtagtggttaaactttctacctttcataatttttcgcctgggttcaattccccacttggatagaatattcctcatattttctttaccattattttaattaaaattttaattttaaaaaatattccaacttttttctttcatgttaagcatcctaaaaacccaaaacttaatcaattggctgttaacaaatcgcattaaaaattacaaaatttttcccggcggcgcctatcggcaccgccggccctccttgttccccaaaagtcttggaaaaaacgtgccgcgtaaaaagcggtgttgaaagcaaagaaaggtaattgatttacattaatttacatgaccggagaccccttcgcaaaattggaaaattggccgctgaccccttgttttgcaataatctgaattttgaggtctacatctgaattttagtgttctttatcctgaatttgaaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggttgaaaaagttggtaccggtaccggtttttgcagtaccggtcagtaccggtaccggtttttttgcaattaccgattaccgctcaactctacttcagtctattaacggattgatcatttaaaaaaaaattttatttttggcgcagagaggggaagcgataagggggtaagaagcgataaggcgttaactgaccccgggggaggggagaacgcagtacgcccagaaacacttcaccaaaaccggactgtcataaatccattccatggggtgggcgggtagggatagtgcccncgtttccgtacggaatcggcatctgtttgattttaggaattggtgaacccggccattgggtggtacaacgaaaaggatgactcagtgattttgtcggctgaagtgtctccgtattcgcctgcgtatccgcacagttggtctcagaagaggcgatggactgactgatt

SEQ ID NO: 42536 - DNA, 1027 bp, Heterodera glycines
  misc_feature (777)..(777): n is a, c, g, or t
  misc_feature (967)..(967): n is a, c, g, or t
ctttagtgagaattgcggctactattgcatttattttcccccccttatgtgctcattaggaggaagaaattatgagagtaactttgaaaaaataacaaaaaagttgataggagaagataatccagatttgtttgtcgtgaattttgttaagaaactgataaaaagtatttaaaagaatttatcattaactcatttataaaaatggatcgattagacacagtaattgcttctcttctgaactgtcccgcacgtaacttgtgcgactgcttaaatcacccggatgagattcaaaaagttgaaaaatacctcaaatgaaaaactctacagacaacatacaaaaatcaactagatgaatacaaagattttgagtacggtggaattacaagagaaagtgcccgtaagcaaatggcttacaatggtttcaagaatgtgaccgtcgaccagcatttttatgtacggcaccgcatttgtcttcgctattcaagcaatccttgcgtgatcgaaaaacacaagaatggcaatgaacgtttctacccacttgaacttgtgaaagtgaaggacaatgatataatttatttagggcaaaattttcctaaacctttaattcgtgatgataatatgtttattgatgatcaacaatatttgaattggtaacttaatgcttaaaattacataataatgaataaaattgattaaatacaaaatcaatttcttcttttgatctagagcctgttagattaagctttccactagagaacactatgatcgatattttangggttttggtttctgtacacgagaccggggaatagttcaggagtgaaggaacaatatttggcgcctagaaagtcggacagaggtcctaagcgtatatgaaaaccaacgtctgttgtcgcaaatcaattcttcaccgcaaattcgtggattcgtgcctcgtagtacccacattgtcgtattctttcggtgnactgctccgcagcttgcttacattctttctcattagctgctcctgtacatacgaattttc

SEQ ID NO: 42537 - DNA, 786 bp, Heterodera glycines
taaactcgtgataaaaacatgagataaagcacattagattgggcttaaaattctctacaaaaaagctcttagacgattttttgataaaatcaactcctgacgagttattgcgtcagaactgaaattgaggcctagcaaccaaaattttctatttccaaaaaaatttttaaaaatttttctgaaaatgccaccaatcgatagagcgtgaaaaacggttgcttgaaagtggtcttggtttttccgagaaaaatctgtaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcacgaaaaccgaaaatacggtttttggcttttcaatttttagccacgcgtaccggcaatacgataggtcgtagagaaaaatgtttgcaggcgaacttgtagtgcacacttcaacttaaaatcctcccagcaagcattttttcatctgaccaactgccctcgtttcacaggctcttgaaaaaacgaaaaagccatttcagcgccgctggcgctcagttggccaccggaccggaatgcccctatttttcccggatgcgccgtcaaaagttacccctgcctgcaaaatttcagatccccccgattagccgttcccgaagatttttgttttagcaatgagttggcactgttgttctaaagtatataaactagcg

SEQ ID NO: 42538 - DNA, 1078 bp, Heterodera glycines
  misc_feature (73)..(73): n is a, c, g, or t
tgaaaataatttttttttaaaattaaacggtcccacccacccatgggatagccttatataattatcatttggncaaaactttaaatggatttttgtaaaggtattaaaatgaatgctgaatgaatatgcaacattagtatcaaaagctcagacactaaagaaaaaaagcccggggaaacaattatggtaattaataattgcgggaattctttgaagttcattccgtcgatagggttttctcacatttggagaatttacataaatgagaaaatggtaaaaagagtgtgcaaaatgaattcataagctaatggaaagtttgctttgctgatattcgaaaaactgtgggaataaaaaaaagcgaaaataattaaattaatttaatttaaataaaatttaatcgaattccaatttaagcttaatgatgaaaaaaagaaaattaaaagctccaaaacctttttcaaagaaggaaaaaaaaggcctaacttgtaaaaataaataaaaattttccgggggcaaaaaccccattttttttgttaagggggccctaaaccctaatttttaaaaaaccaccccattaaaaatttttgggtttttttttttaaaaggttttttaaaaaaatttaaaaatttgaaaaaagggaaaaaaagggggaaattaaaaaaaattttttccctcttagagaaaattttcttttttttttttcttcccaaaaccccccccccaaaattttttttttttttttttgggcccccccaatttgggggaaaaaaaaaaaaacaacccgggggggggtgtgggcgcgggggtaaaaaaaaaaaatttttcccccccccccccaatcttttttttttttttataaagaaaaaaaaaaatttttttttttctctctcccccccccccccgccaaaaaaaaaaaatttttttttttttttttaaaaaaaaaaaaaaaaccgccccccccccccccccccaaaaaaaaaaaaaaaaaaaaaaatttttttttttttttttttttttttttgtttttgcgccccccccccccccccccccccacacaaataaataattttttgtttt

SEQ ID NO: 42539 - DNA, 1321 bp, Heterodera glycines
  misc_feature (59)..(59): n is a, c, g, or t
  misc_feature (66)..(66): n is a, c, g, or t
  misc_feature (1248)..(1248): n is a, c, g, or t
  misc_feature (1250)..(1250): n is a, c, g, or t
  misc_feature (1277)..(1277): n is a, c, g, or t
  misc_feature (1300)..(1300): n is a, c, g, or t
cgccggacttgccgagatgaacaatcactacaagggcatttttaaagggaacagaaagngaattgncggccgccggagtgtctctaatttcatccttagcgacgaaaatttaaaattttatgattcatctgtttaaaataattttacgccaaattcataacctttgtgattttaagccttttgttatattagtcagcatttttacatttaattttctgttcgcctatgtaaaatttgccgtatttaaaccattgcaaaatcaccattttttatcgttcaatcgttcattaataaatatatttgttcgatcaaaattcactaataaagtgtgaaatataattgaagtattgggaaatccaataaaataaatttaatttaaataaattaaatatttaaattaattcttattgactatctgaaaaaaggagtcaataaagtggtgccacgaccaaacatgtcgggtcctattagaatgcggataaatccgtctttaagaaaattaactgaaagactggtagaaattagaccagtaattgatgcgcaacaaagagaccctgaggggattgatttattaagaaattcgttggtaaaaataaaaagatcagtgacgttcattgatgaaagaattgaacaatggcgcacatatatgacagaaattgaagttgatgaacgagcagcagaagaagcactttttgtaaatatgaacgcaaatcagcgccatgtaactgaatggttagaagatgcaagagaagcaattgatgaaatagaaataattttagtaaatgaagcagatgatggttcggacacattatcagttgaattaggtgcgcaaggcaaccaacaaagaataaatcaaaatgaaaatgaaaggaatgaacaaagaattgtaaatagagaaagagttgaggctcctccagtatattatccgaaactcccatggccaaatttttatggagacacaatgtcttggccagttttttggcaagcatttcaagccaatatgggcgataaaccgattcccgaagcacaaaaatgtacttatttattgttaagcctaaaaggcaaagcagcccgagcaatgagagggtatcaaccaacagcagaaaattataatttagtaataaatgcgctaaagcgactttacggtaatgaaaaagtcataaaagaagcactacagaatgaattattgaatttaccgcaggccaatgaagctgctatttcactaagaatttgtttagaagatgttgnanaagagtgtgcgtcaattaaataatttngggatttcgctgagataaagatnatgtgatgatgacaataaaaa

SEQ ID NO: 42540 - DNA, 1503 bp, Heterodera glycines
  misc_feature (65)..(65): n is a, c, g, or t
gctaactgggatagaaaaactactggtaatattgccttcttagaggttgccaactctatggaacncagaagggaccacctttttaattttcactgagaatcgccaaaatatgggcaaatttgggtcgtacaaatccgaacgaatcattggccatttaagtcatttaaataagtaaattatctttaaattggccaattttgtgactaacaatctgctcgttgtttttcccatcctgcccttagaaatacttggacagtttgcattcattttggactcgctcagttgggccgtcacgtttgaacccccacgttttgtgccctatacatttgtgccccatgtttttttataacttttttctgtcatcccaatcaaacaatgttggtatcactcgtaaagctcttcaatgctttattagccttgcaaaaaaaggattttctagcatattaaattgttatttaaaaatttcaaaaatcttgactcttgcaatttatcatggtgtaactttttaaacaattgccgaattgcgaagcaatagctagaaattcttctaaatatgttaagctttcgaagggtaccaaaattgtttgctttggttggtcgacaaagaaaaaagttatagtgcaaatacatgctaccgtgccggctcaaccgtaacggaccaactgagggaaaccgcattcatttcgtatataaattgaattcaggaagtcacttggccaacaatttcgcgcgcatatgcaaaaaataaaattggtacaacggctattgttgagggtgaagccgagtataaaaaagtagcgcagagggtaaaggaaaagcttgatataataggccaacaaaagtaagtaaaattttagagcggatgtgatgctcgtacgaaaatcattaagaggaatatttttagagtcagaccgggcttctggtactgaacctgtcataattcaaataagtcaacaaataggcaatgaaaaattgaaaaaattgtcaaaattcaattttattacttcagtctgcaaaatttcagaaaaattcatttgatttaagtcaatttcatgatttggccaaagttttcttgaatattttcacttatatgtattttatgctgcccttttgcgttttaatttcaaatttaaacatttacggtttattggatttgaaatattcccaagttattaaaagtgatattattatttttttaataaattgggctttaaatggttcatttttcagtgcctaatttcgtttttttatctttataatttcctaaatttagatattttcacacggtcatcgttttcccaaattggagtaacgcttttcagttggcaatccttgctaaacaaagtcactatttctttttggacggcgaaaatgaaatcaaagaaaataaaatcaatgtgatcgttgttcggtgtgaaaccgaccgttttggaagggctatccaagcggggcagtggtttacccaaacagttgaaaaccaaatgaagacatgataaagtaatt

SEQ ID NO: 42541 - DNA, 839 bp, Heterodera glycines
  misc_feature (63)..(63): n is a, c, g, or t
acatatttcaggatttttagcacataaaaatcccagccctactaggttctaatttatcaagtnccacctctaaatgacgccttccataatttttcaatattttaatgggttactctattaaattttgttgattcaactaaaaaaaattgtgcccaaaattcgcaatttcccatatgtaaatagaaattttggccgccaatttccggttccacgggatggagatgggggtggggcgtatgctttatgctctaagcccaacccctaacccatcgacgcccactgaaccatccccgaggcgcacaaattggcacaccaaaaaggtggcacacattcggcgatggcacctctatctaatacatgtgccaaatgctaatgaatgaagcgcgcgcacgcgcgcacacacacaacacacacacacacacacacatagggaggtgaagatgtcctttccaattaaatgcacacgaccacgacgacggggtggcactcatttatgaaatgccaaaaatacatacaaaaaagtgccttaggcgggcgatgccaatcctgcccagccattaaaaaacaattttgttcattcatcaatgagcaacggtggcactaaaaaatcggcacccgcctacctcagttctctacgatgccattcattgtgcattttgtacacattcgaattcaattagtggcaaaaatttattcactaatttttcctcgcgaagcagcatttcacgcttcaaatattcatttaaatttatatttggctttacaatggcaaaaagtgtggcgttgtggatcataggaataatttaaaattctgttttaatgaagaaaatttgtgccaa

SEQ ID NO: 42542 - DNA, 1273 bp, Heterodera glycines
  misc_feature (866)..(866): n is a, c, g, or t
  misc_feature (898)..(898): n is a, c, g, or t
  misc_feature (944)..(944): n is a, c, g, or t
  misc_feature (952)..(952): n is a, c, g, or t
aaaaaaaaaaaaaaaaaaaaaaaaaaaaaaaaaaaaaaaaatttttttttttttttcttttttttttttttatttttcatataatcgcgcctcatttccttccttttttcctttttgtccgcccccccccccccccactcctttttctttctttttccctcaaaaaaaaaaaaaaaaaaaaataaaaaaaaaaaaaaaaaaatttttttttttttttattttttttttttttttttttttcccacaaaaaaaaaaaaaaaaaaatataaaaaagaggaggggagtgttgtagggggggggcgcggcgcccccctttttttttttctccataataatttttttcaaaaaaaaaaaaaagagaggagattttcttttttttttttttttataaaaaaaaaaaattttctcggggggggaaaagagtttcccccccccttttttttgaaaaaaacagaggttaaaagaggggggggggggggggtttcctttttcgcctttccccctttccaaaaatttcccactttttggggggtttccactttcctttttccccttttccttttggggggaaaaaggggttttttcccccctaaaaattggggtaaatttcccaaaaaatttttcaaaattttttccttaaaattggttaatttttcagggaaaaaatctgttataaaaaggtcaaaatttccaattttttttccccggggggggcctattggccacgccggggcccccaaaactccttatttttttttagaaaaaggccccaaaatcgcaaaatttggtaatttgatgaaaaactgttctcagcggcgcgccaaaactcttattttctccttagaaaaattatataaaaatcacanaatttgatcattttttagtgaaaatctgtcancaaattttaatcaaattttcaaaaattttcccggcgccgcctgccncctcttcncaaaaagtttttttggaaaaagcgcgcctcaaaaaagcgttttattgatttttaaatttggaataaaattttaaaaaatgatttttgctttatgattttaactattaaaaagttgtagaaaaaatttcgcttttcgcattttcgcatattttggcttttcgcatttcgcttttcgcattttcgcatattttggcttttcgcatttcgctttttttttcatttcgcatttttcagtttcgcaaatttcgcttttcgcatttcgctttttatttatcaatttggcccatccctggtttagatatgtttttgagttggattaga

SEQ ID NO: 42543 - DNA, 690 bp, Heterodera glycines
  misc_feature (59)..(60): n is a, c, g, or t
gtgaacaaaatagtcaaacccaaattcaaacttaactctcacaggtaaccttatatatnntttgccttggtcaaataaattcgattagtgttggcgtgtgtttgagtgcttcgtcgatgtatttgtgagcacgttggtagtttttcaaccagtcgaagtgttgcgccaaatagtaataaacccacaacaccgtggtaggacattccggaaggttcgacccatccaacgaaaatctgttatagccattttcttcaaattttcgaacaaattccaataaaattcgctctataactgagaccttaacttctttttttaagaatattggaatgaatgaaacacacttttagtgggtcggaataaagaaggacgagatttttgaacaacgatggaattcctcgccgaaggcattcaatgagaaaagcaaacattttggattcaaacgcggaccctacaaataaaaaaatattaaatatgattttaacacagtgcccaccgctcaaataattaaggtgaagcatttttggaatcggtgcttttggccttttctcaatgatcgattcgtaaagagcagccaatttcgggcggtcgttgacctcatctgtttattataaagaaatcaatcaattatcaggataatttggctctagtgcctttatgagtccaatccaattgacaatacctggtttatat

SEQ ID NO: 42544 - DNA, 1046 bp, Heterodera glycines
tgcaggtctattacaatttcagaacatggttggatggtgaacccagaaccgcgcgcccaccgctaaagggatcatcgattatttggacggcaaatcgccggccaacgccaccgaaattggcaccgttcggaagcatgacggctgatcagttacaaaatttgttgaacaccgaaactgatcgtttgaaaaggctcggaacgaaaaaaagtgatcgatattataaattgttgaagaaaattggggaaaatttagccaaagcaaagaaagctgaggaggaatatcgtcaaaaattggccacaaaacaatttacctgtgaacagtaaaatttccattttccgttatcattttttgtttgtgtatttttttgcctgtaaatcacaaggctttttctttttttaagataaattttcttgcaagcttattatagtttattgaatatatatactgctggtttccggacaattggttagtggacaatcggtcaaaaaacgtacatttaaaatgccggatttaataaaaaaaaggaaataaataatttaataaaagctaaacaattaattgtaaaagtggcttaaaaatcattttcacagctttatatttttcctgaaattcagttaaattaaataacttattaaaaggtagaaatgttctataaaaatacaaaaatgactttttataaaattaatcacaaatttatgaacaaaagcaacacaaaactgcttaatggcacaaaaaatgatttgataaagaattgaagttttcagtttttctaaatttagataattaataaattaatttggtatctcaatttgaaaagtgtgaagaaagctagctaatccaaaatttatttccaagctttttttaatacatattttttatgtctcttttaaaaaaatatatttgcaattttttagcgtcatttttcattaaattatttaatatttttaggacattattcaattttctttacagtgggaaaatttgtaattttgattagaaaagatcaaagaagtaatcaaaacgatcaattatttgaaaagcttttt

SEQ ID NO: 42545 - DNA, 260 bp, Heterodera glycines
tttttttgaaaattttctccaacgcgagcgtagttcatcagaaaatttcaaaaaaatcgcttcctaaatttttcaaaaaatttttttcttgaaattttcttactaagaaagttcctaagaatttttttataaaaaatttctaggtttgaaaattttttaaaaaaaaatttttcgggggggaaacgacgtgggggggaaacgacgggggggaaacgacacgggggggaaccggcgggggggaaacgacgggggggaaacga

SEQ ID NO: 42546 - DNA, 1254 bp, Heterodera glycines
  misc_feature (1249)..(1249): n is a, c, g, or t
ttatttttaattttaattaattctcttccacaaagtcaattaattttaattaatttatttatttatttcttaatcaataaaaacccttcaataggtttaagttcacccccgcacccatccaataggctttggtttaaaccaataggctttggtttggaacggtggttttccaagggcgaaaaagggggctagtaactactttcctctcatctcatctccacctgccggacgacgacgaggaggggaacggggggggggggggcggggatacaccgcctgactggacaatttaaatatccgaaaatccatccccctctcaaatatccgaaaatcgctctcatcatctctccaccgcattcatgcaccccgagccgcgcatttttggtggtggtggtggtggtgtcgcgcaaatccgtctcgtttccgtccgctgcgccgcccgccggacctttcgtgcggaaatatgtaaacccccgcgtggtgcctgccgccggcgcccccatttcaatgcattaatttatccagaaaatatttttttacaaatggcattttaactttccatttttcttgataggaaacatgccgcatgatgttatgtgattggtaaaaactcagttcattctgtcccgaacattcttactcgattagtctgtaaaattaaaaaaaaaaattttatcgaggctacaaaaaaaagtcgtgacccgaaaacatttttagttttccattcgtattgactctttgcgatttgtctgatgtaatagttaaatgatgatgtagtttagtgaaatttccaatttttagggcttaattacctaattattaatgaattaattaattcatgtgacccgtcgccttccttttttttactttaaaattgggctgaagcaattagccataaatcagtgaatggaatgaagaccattgacatgaactgccctaggcgccacattcataaaatgagtgtttcaaactaaaatattgtgctgcttttcggtactaaacatttcccctagattcgagaccagactgaaaatcaagtccgaggtctcccagaaaaaaaagaagtttcttcataatttggaaatgtacaaaaattgctaattttatggattttttgaaaattttgaagtgtggaggggtcttggaggagggtggagtgggtacaactctctggaaaattttttgaaaatgttttttcttcgaattttttaaaagataaaaaaaatttaccaaaaaattttttgcctcnggcgg

SEQ ID NO: 42547 - DNA, 977 bp, Heterodera glycines
agccaaatacagtaggattttgcatttgctatgccttccccccacggaattaaatatatattttttgaatatattccttacatttcgccaaatataattccaatcattctgtcaattccaataaaaaacattataggaggaatgcctcctaaagtcaattatgataaaatttaattattagtttgagtaaattacctaacccaaacaaaggaatcattaaaatctttgccgccaaacgatactcaataaaattttgtccagaaaattctgtataaacaaacaaaaaatggccaatctgatggaggatttcaaaaaaggaacaaagtgccaagaggtaattaacagtgccacggaatgacctaattaaggtaattaaggttcacttataactcattaatactgcttactccaagaatttatctacactaattacgcactttgttaaaaaggttacaccaatgacagaagaattgaaaatgatgccaattaccgcaatgattccaaaaatcagtgcgcatccaattaatgaccagctgggatggacatctttgaaggccaaataaaactgcaaaaattaaaaaaaaacaatttataaatatttcaattaatgactaccgtattgtacgttgtgttgtcattcattttgattaattttatttaattaattttttgagataaaaaccacgaatggcaaaatgctgaattatttgcataaataaaaccgaaagctcacctgacgatttatttgattaaatgtttctgaatttacataatacttgtgattttttgtgtctgcctttctgttcatggcacctggcaaataattaatgaaattacactgtttacatcttttccaacaattgaataataaatggaataacgctttttgtccggaccgaactgaacaaaaagaattcctataaaatgttttttttttataattggaaagaaaatttaatttttttttttttgaaaaa

SEQ ID NO: 42548 - DNA, 772 bp, Heterodera glycines
aggtccgaaagaatgcccattttaagctatgctttatgcccagcacattggcaccttcagcgcccccggcaccgttgatggcagcattgttgaaaccgttcatgcgcaactgctgttggctgtggtactgcttgaacgactcggtgtagtggtcctggggcctcggttggccggcaccgcccatccgcgacgaggtggacgcggcattggcatcctccaccattggcattggcacgcgtccagctggcagttcagcaccggcaccatgcttatggtggtgctggtgatgaagccgtttaggatggcgcggaaattgatactgatgggccactgcaagcgccaaatgaagctgaacggagtggcaaaagccggcaaaatgacaacggacaaatggcacaaaaatggacaaatggcatggcattcaccgaccagcgagtgacaaagtcaaatttggcactctccggtcggtgtgcatgcttcggcgtaacgaaaacggcattttaagccacacaaaaaatggaatttcaaccaggactaagatcgcaaaaattagcacgaaaagctaaagcaaagaaaaaaacgattagcgcagaaaaaaagtattggccatttcacatttaggtcgagattcttgaccagggggttttggcaattaacagaaattgtacaacagctgatcagacggttttcatatgatcaaagcccgatcgagaatctcgaattttgaagaaataattgatgccaaattgtcccacctgttgggccaccggct

SEQ ID NO: 42549 - DNA, 765 bp, Heterodera glycines
ggtcccggtcccggtagggcaccggggaaaaacaagcactgataagaatgggggtctgagtgaaaaattagtaatgaaaaattgtagttaaaaggaaaaaaatttaaaaaatatattaatatattctttaaaagtaacgccgacaattttgcggatggcctagtggctagtctccttgactttcccttcttctttcccctggttcaatccctctacagaaattaacatattttgaattttctttttgtatattcattggtttcctatcgagaaatatgattccttatatttttcttttaacggacacatgtttatcattttttttaaagaaaatccgtacaaattgagcctaataatcccaaaaaagaagccatttttgttgaaaatctgttaacaaatctcactcaaattttcaaaatttcccccggcggcgcctatcggcaccgccggacccctttcttccccaaaagttttctggaaaaagcgcgccgaaaaaagtggtgtgataagtaaatctaaatttcaaataatattcgaccatttagtccaaaaaatgattaattgtttgaaataattaaagaaatttgttttttcattaatttaatttatctttaacttttggattttattaaataaaaaacaaaataaaaatctaattttgtattattttcagttgaaaaaaaaattaaaatttgaatttttttgaatttttgaaatttcccggttggtcccggtcccgaaaaaaaccgaggtcccggtcccggc

SEQ ID NO: 42550 - DNA, 1033 bp, Heterodera glycines
ttgtcagtgattaatcagctctcaaaaaagttgtcagttttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggcccgttccgatttcgcctctgttttttttttttgtaaaatgggacaaaatgccaagccaaacaaattttattatggcattgttttacatagaattatttaaactaaattgatgctaaattaaaaaaaaatcattttatgtcaaactaagacaaagaatatttgaaatgtatttgacaaaaaatcagttttttattaatttaaaatcccaattttttaattccaaactcaaattaattaaaattgttttatttgtataataaagaatttaatttattaatcacgcgaaaagcaaattatttattctttcagaaagctcaaatattccttaaaaatttgtttgcgcaaagattacggtaggtcccttctgcacatttggttttcaaattaattatctaaaacatttattttttctaaaaataatattttaaatcaatttttttttacattttgtcttttccactaaaattttttcaatattttttgtatttcaaatttttatttttgattttgtaaatgaaagcgcattttctcttgtcatcaggaaataataaattgtccttttgggattgattgtgatcgaactttttctaattttcatctttggtcataaagctaatgaatggcccaaaggaggtcatttggcggtgactgaatttccccccccccaaatgattttcttatttttaattgtatttttgtctaaatttcccaatttttttccaaaaaagcatcctttacctatttttcttatttttgttggcttatccaactccctcccccctcccctcgccgtctcattttctt

SEQ ID NO: 42551 - DNA, 1060 bp, Heterodera glycines
cctgctgggacgttagtcaaaaaaccatcaaatggaaaatttttgagagaaaattattcataatttcgtctaaagtagatcaaatttaataatcttgatatttttcgatagccctaagtgttttctattatcctgcaaattttttaaaaaattctttaagcttaaaaaaagttatgacctgagaagctcaaaaaaccaagtttttttgaacatttttagtcataaccttcttgaagcttaacgaaactttttgaaattttgtaggctaatagaaaacacttagggctatcgaatgatatcaagattttaaaatttggttgcctctgagcaaagttatatcaataaatattttcatttgatggttttaattaaaatgctaattttaaaacagaaattttataccactttatttacatttttcggtacaaacttggcgaatttttgtacatattttggcatttttatacatttttaggtgcatatttcttgagagaatcgctctcacatttttggcaatgttgacagaatgccgtgcttcatttaaaaatttcttatgaaagaaaaataatttcttaagctccaaatgtatgatgaaaattaaattttaatcaacgcaataattggcttgttatttggtctacaaatatgaatatataataacataatgataatgatcaagcatatttcatcaacctcctaaaacattgataacacaaaaatatatatatatataaatatggtgttaatatattaataaatctataagtaaaattatgtgtgccatagcgccaattcaaaattttgttttcgctccatgcacggcatcggcagcaggcaaattatggtcgttattgccggccgactcgcagcccatcgtcgtcgccgccggctgccggtggcactcgcagtgcgacggcaccggctgcgtcgccgctgggctgctgctcccgggcacgcggcggtcgctgccgtgggactgagacgaggccggcactgtcaccagcagatccggcatcggcatcatcacggttggcacaatggcgttgcgtcgtcgtctgag

SEQ ID NO: 42552 - DNA, 1179 bp, Heterodera glycines
  misc_feature (1126)..(1127): n is a, c, g, or t
tgttttggctttttaaaaaaatttttggcttgtattttttaatttattgatgtgtgcttctttagttttgtgtgtctgcggtagggccgaaacacactttttttactttttttgttttcttttggaagagccgcactgacgaggcccactcttccattagagattttataacaaaaaaaattttttcatttaatttttttctcaggaattgtccgcaaatgtccgtccgcaaatgtccgtaaggcagctatacactaaaatttagaaataacacccctgcaaaattcgggttaattatattcaaaaaaaaaacatttaagcaattttagatacttaccactgtctgccattacatacgccggccttttattcaaaaatccataaatatagcttttacttcccatgagagtattgttaggcattgcgacggttctgaattagaatagttaaataaagataggtatcaatattcaagtttcaatatttttctattgatttttttaaaaacaaagaataaataatttctacccaacaaatttttttttgatatttaaatttctggtaagtgctgcaggcttctccacggagaacgaaattttggtgaaaatttaaaaattattgcctaaccttaacacatttccttgagccgatgttggccgccgttgttcatacggcttcattgcaaagcatccggaaaggtccaagtccgtttcttttaaaatgaatttataattgaaaattatcaaataataactccataatttggaccggaccttctttttttggaaggcataaagctgcgatggtgagcaaacaaagtttgacaatgttgataataccaagcaaaagtttcattatcttttgaataaaattaaactaattacaaatgattgcgtgatttcccattcacaattttcatattttgctgcgctcaactgccaaaatgcagaagcgaaatgcgcttgtacaaaatatccctggaagaatgggggtctgatgagaaaatagatgaaaattggtggagaaattttgagaaaaactaaaatatttatttcattacatacatttattgcatcaaatctggtttagtgggtaattgaaattttaacacaaattaacaaatatnntgtcattttttgacaaatttcagtaacaaatctcactcaaaattcaattttt

SEQ ID NO: 42553 - DNA, 772 bp, Heterodera glycines
aggtaataatgagaatgtcattttttaaacaattctacgagacaaatactggacctcctatcagttagacaaaatatgaacgcttgttgtccaattgagagcgctttcggaaataattgcttgaaccggtaataatgagaatgtcattttttaaacaattctacgagacaaatactggacctcctatcaattaggcaaaatatgaacgtttgttgtccaattgagagcgctttcggaaataattgcttgaacaggtaataatgagaatgtcattttttaaacaattctacaagacaaatactggacctcctatcaattagacaaaatatgaacgtttgttgtccaattgagagcgctttcggaaataattgcttgaacaggtaataatgagaatgtcattttttaaacaattctacaagacaaatactggacctcctatcagttaggcaaaatatgaacgcttgttgtccaattgagagcgctttcggaaataattgcttgaacaggtaataatgagaatgtcattttttaaacaattctacaagacaaatactggacctcctatcagttagacaaaatatgaacgtttgttgtccaattgagagcgctttcggaaataattgcttgaacaggtaataatgagaatgtcattttttaaacaattctacaagacaaatactggacctcctatcagttagaacaaatatgaacgattgttgtccaattgagagcgctttctggaataattgcttgtacaggtagtaatgagaat

SEQ ID NO: 42554 - DNA, 1211 bp, Heterodera glycines
  misc_feature (1075)..(1075): n is a, c, g, or t
  misc_feature (1098)..(1098): n is a, c, g, or t
aaaaatttgtcatttttcgggactaaaaatttctttttttccgctccgggtaagccaaaaaaaaaagggtctgttgggaaattttttgctacaaaaatgttgatttttgctgccaatttttcgtgcctttttgacgcttttgttcattttttatgcctttttcaccatttttcgtgcctatttgagaaatttgcgtgcctaaaagtccggtctctgatcatcatatttgagtgttttcttcgttaatttaacactaatgaattatctcgctttatcttcttcttttgctggtggtggcggagacaatggccttaagcgcaatttgaattatttaaaaaatgaaatcccttatttaattgcttacccgatgcaattggttccactataaagccaaaagtacacatagttccaattttcatctttcttctgctgctgaaccgccgcggcctccccaattttgcatcgtttcattatccaaatgttgtccaattcatttgatttggccaatgtcagcttttcttgcgttcgttcgttcaccaattcaaacggcaccattggctttgtcggcacatgaacagaaaaatgaatttcgtagctgacggaagaaatggtggtggcacgcataaattcctaaacaattccaaaaatcagttatttgccgaaaatgttgggccgcacctcctttaaattgttgatcaaatgtaggctcacatgttcattaatatcaatgaaacggaatcgcttgggttggccatattttctcggagagtgcaaccatttagacaaggcttggccagcagttgcatttggcccatcaaaattatcaccaattgcatcgggcagcaatagaacggaatcgattgaactcaactgattgagatcagtgagaattgtgggcgaagtgcgacgacgcaaattgtccaaatgatcagcatcgataaagtccaagtggcgaatgtttgatgcaaaaattggccatatttcacgaacaaaaacgtcccaaatcggctgccggtcatccgccatatctgagtaaagcatccccatacgcaacttggtgccacttttgtcgaanattttgtgatttgaacgaagaanagcgatgacggagtgatcgatgtaactgtgaaaatgggaatgaatgaatgcttttattgcgatagcactgatttttaatttactcactcgaaggcgcttaaaacgaattttgc

SEQ ID NO: 42555 - DNA, 1076 bp, Heterodera glycines
ggcagccctagtgatttctagggatgggatttaagtcaaatgataggcatcacccaagaccaaacggaaaatgcgatttcgtgcttatatgtgcgtatcaagtgcgcagaaaattaggcattgcctaaacgagtccctactgatttgtctacatatatgaatttgaaaagttcgcccctgatttgtccaaccctttttgagcaattttgagtttgcgtcctccaaattaatatttacagttaagcattaaaaaaaaatctttcaagattcttcctacctctaaggctgaaattcgatctaactcagattttccataacttttcgtccccttttgtttctgaacaagaaggctctgtgaaggctttggcgcgattgagaacccaaatgatgatgaaaatcttaactcatctcacaccggcttatgcgaaatgctttgaaaatttagtaactgttgcccgtaatggctaatgattcctttggaccttgggaagggcatccttcttttttttttgaaattttgcgtgtcctcccccattggcgatacgattttaagctctaaaaaccgcaaaaataggtaggttttaggtcctaaaaaccccaaaaatatgtcgagtcctcaaattttgtcattaatcccaattcgtttaatgtaagctaagagttgccataacatcgcaacttcattgttttcatgtttctagatcttttccgattattgtagcttttttgtttcatgaaaatttttttcccaaaatttttttttgcatgctgattatagcttttgaatgaccaaaacatatttaaaaactctaaattagtgagaagcatacaaaaatttatcagcattaaacatctttttctgctcacacacaaaatttactttaattggtttggaagaacaaatgaatcgaaaaagtgaattggtccgcagaatcgggcatgctgttcctaagcttgagctattaattaatgaaaatcattaatgagcgagccatttttaagtggcgtggctttttgatgacgcccaatggactatgccaaaaaacgtgcgacagtaaaagactattggatgcaca

SEQ ID NO: 42556 - DNA, 798 bp, Heterodera glycines
ttgccgtaaatttgacagaaaattgtaagtagaaaataactaattggtgaattattttaattaataattacattgaaattataaaataaattaattcaatatttcatttattcatttagaaaaaaagcataacaaaagaacaaacagaagccgtccatttttttctcttatgtttatgttgcaaattcacaatttaaaaaaatcacatttaaattccttttccgctgataaaggcctaattaaagttaattattgcaaattgtggattctttcttatgtttttttttgctttgcctccgttttctcctttcactgcgattgaaaaataaagcgaattatttgatttacctaaggttttaattatgtaattaattaattaatcatccaaatattttaatgctcatgtcacttgacacggtgaacatataattaaatccatctttgacgtgctgtcattcattaaacgaattcatagcctttttcaaaaattggacctaacaattccaaatttaaatcgaaagttatattattattactattatttaaatataattatttaaataaataattattttatttatttttttattaataaattttttaatattttaattagttagcactctgacaatgaattgttcgatctgccccccccctatcattttttgaggcctttcctcgacccgttccccgattcctctgacaatatgccctgcagctcgacccacacgccccctcccccccccccccgggaaattcctcgcatgaaatggcgaaatgccacccccaaatattttt

SEQ ID NO: 42557 - DNA, 1290 bp, Heterodera glycines
  misc_feature (1204)..(1204): n is a, c, g, or t
  misc_feature (1212)..(1212): n is a, c, g, or t
tcgattgcatcagataccaatgcgtgaatactttccggatcatagcctactaaaaaattaaaaataattattttgtaaaaatttaaataaaataaataaataaaataagaaaatgccattgatttgaagtttttatttcaggaagagctccgtcaagaaaatatgttgaagaaaaaagaaaacatatgcagacaaattgccagaacatttttttaaatttaattttaattgaaataataaacaattttaatttttatcactcttaaatattattttaaaattccaggaagtttaaaattgcaggaagtgtttgctaattaggtgcatcatcatttggtaactgctgtccacgttttttcattcataaattgtggtttttttaaacggaaattacttagtctatatattttttaaatattctatcgattttttattattcaaaataataaaaaattcataaaaaaataaacatttttttaaaaaattgtttaacaaaattgtcattccatcagactctcattttcttgcgattattacatatcatcaacagtttttgtctaattcatatacgtcgatttcttaaaattatgttttgtaaactttgaaaactcaatttttacaacagctaaatcgggtgccactgcacttgactcgaattcccgacattcttagccaattctatactccaacaagccacatttacatcagtttgccagagatatatgtctcagaatcacagaagagtccgttcccgaatctccatttttgggcctaacccaatctcgataggggtcattaaatgatatgcaccgaaaatcggctattagattaattaattggtcaccaaattaaacactcccgaaacagaatttatttattactcagagtcattcatttaccggtgcaaaataaaattgactcatttatatttattaccaatcaactttctaacattgcatatacggcattttaataattttctttggcattattatttaaaataatatcatttcttggtccaattttcagagaaaaaaaatattgtaaaataaattcacatgcctttttgatgacttccgttcacttacaaaattcacatgcaaaaagtagtaataaaattaatttgtttttcatattattcatccgtcaattgattttcgagagtgcattttctatgtggaaaaaataaaataataaatattgngaaatganaatcattggcacaagaatatttaattatataaattttattatatcaaaaaacattaaaaaagtggagcttttttgaaa

SEQ ID NO: 42558 - DNA, 996 bp, Heterodera glycines
ttattaaattttaaaaattttttaattgctttttaaactccgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcaggaatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttccggatagcttccctatagcctgtactttaattctgcgttggattttgctcccataattgttgagtaccccaaacggacacttgaaaaatcgatttttttgttttcggggcagtccccccgaccgatgcgcccagatttatggggagaccgaatccttcggaatagcttcctatagcctgtactttaatctgcgttggatttttgctccccataaatgttgagtaccccaacggacact

SEQ ID NO: 42559 - DNA, 1439 bp, Heterodera glycines
aatttaaagaaaacccccccccccgcccccgggattttggcttccccccaaccccccgcccccgggaaaaacccaccccccgcccaggggggctcggacccttaataagaatacagaaataaaaagaataattcgcattttattaaaaaaatgtttaattatatgatttttattatttttcgtcatttaaattgaaggaatttacgtcataatttatgggatttattaaaaatttggaggaaaggcaaaagtgtaaaaaaattttgcaatttatcattataagaaatttttgggtactggtcctcccgagcctctaaaaatttacataattttcaaaaaaataaaaggactcaaaaaataatatttttaaaattttaattttttttttctaaatttcaaaaaatttccccgcggcgcctatcgacaccgccgaactctcttccctcacctatacccaaaaaattttaaaaatttaaattgattttcggaaatgtataaatttctcatttctaagccggaattgcgcagaaaaatagttggcggtgagtaatgcttggttttgttgaataaaaatgcatttaaagttttggaagcgtgttttaaaaatgtccttatttttgaccctaaaatcttatttttgaccagcgatgttcttatttcgggaaattttcaagggtaactctgaaaaatagtcatttgcgccgctcactcaaaaaaatatttgaaaatatttttagcaattttcaacaaattttactcaaactactgtgccaccaaaacaaaaaacaattaaaataaaataagtttctctgatcaggatctggtatccatttcggccaatccgaactccggaccggaataaatattctttatataacaatgatcagacattttctttatcaatatatcattttattttcttctaaaaatgggaattattttctatgatatttttttttattcaaaaatttttgttaaaaataataccaaaaaaaaccaaattatttattatgataattaataatttgtcgacaaacacactatttttgataaagtataaactttaatgaatataaataatatttaattaaattttgattcatttaattttctcatggcaatcatttcaattaataaaattattaataattgtaaatttttttacattttccttcacgctgttttcttcataaaaaagacccaaatattttggcagttagtttagcataaataactaaaattataataaaattaatcataaaattttataaataatgaaattttatgttatatttcttcttttattattcataatgaatttactaataagtgaaaagaatgaaggaaaaataaggccaacctttgaagaaatatttggccaacgaatgggaaaatgacaaaacaatggaaagcgaaattaatcaaaacttaaataatca

SEQ ID NO: 42560 - DNA, 878 bp, Heterodera glycines
caggccaaaaagtttaggcttatattttaaaaagtttctccaccgccgggctcactaaaatcgatataatctctccaaatttctttggccttctccattgtaaaggactaacttaacctgaaaaaatgccaacgcttgttgtttttaaaatttttcgaaattctgactttttcattaattatttattattttgcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatatgcgaaaaattttaggcttaactttttttttataaactggtcagaagcgaaccagattttgcgagggcatcaaaaagacaaggaaaagcactgctatgatgctaactccagtaattctgaatttaaaagtttttattaatttttaaagcttctctattttatcttaaagggaaaatcaattcataaatatttttcagaaactgct

SEQ ID NO: 42561 - DNA, 1718 bp, Heterodera glycines
attagcaatttttgtacaatttatgttaataaattgcatctaaattttcaattttttttccgacggcacctatcggcaccgccggactcaaaaaaaaaacttaattttcttgaaaatttgctcaaaatcgctaaattttccattttttggacaaaatttgttaacaatttacattaaaaattacaaaattttcccggcggcgcatatcggcaccgccggacccttccttccccacagtttctcaaattctctttggataaagcgcgccgcaaaaaaagggtgtaactttcccaaaaaaaaatccaaaataatgtaaaattacttaaaatattttgatctttttaaaaaatatagaaataaactaaaaacagtttgaaattaccttttacatggttaaaaatttaaaaatttagcctattaaatattttttaaaaaatttattatatttttttttgaaaaattccgacttccgagttccgacttccgacatttttggggtcggaattccgacttccgaaaatttttggggcctcggaattccgacttccgacatttttggggcatcggaattccgacttccgaaaatttttagtgcctcggaactccatccctgatatggacccattcgatgatattttggcccaaatggttgcatttatgcatctcaaatagctaaagggctgtctttgtatattcagtccgctctttatttatgttattttttaaaatttgaatgtgtggccccaaaacggaaaagtaccgaatattattattttttagtttcgacatcaaaaaaatttcagaaaattttttgaaattttcagcaattttcttaacaaaattgcattaaaaatacgggatcaaaaaaacgaaaaatacacccctaaaaatcgaatgtttcataaattttgaaatttaaatatttatttaaagtaattagtccgtacaaaaataggcaaccaatatttcgtatctccaaaaaatcatttttcctatattctacaaattaactgttaatggatttacaacttacggcaaatatccgttgattcgtcacccaaatatttgcgttgcgcacatttgatggtgttgtaactttgttcctaaaataatttgtttttttttcaatccaataaatttagatgcaaaaatttatttaaattattattttatgcaaaatttataaaaaattattattttatatataatttaggtatttaattattatttcatgcaaaatttatttaaaattcttatttttatgtataatttatttaaattattaattatgtataatttatttaattattattttatcgataatttatcaaatgattatttttttgcaaaatttatttatgtaaatgattatttatgtataatttattaaattattattttatgtataatttatttgaattttatttaaattcttatttttttaatgtttttcacctttcccattgtgccgtcatcgatgcacctgtccattcggctcccggacaatcggacagtggacaattggacagtggacaatcggacagttgggcaatcggacagtgaggacaatcggacagaggtggacaatcggacagaggacaatccgacagtaaaatgcataaaaagataagaaaatgccgtcgccggaggggaccaattgtgccatatcaagaaaaagggagaataggcaaataaaaaagtgctaatgcagtctaaaa

SEQ ID NO: 42562 - DNA, 377 bp, Heterodera glycines
  misc_feature (371)..(371): n is a, c, g, or t
ttcatcttcagacaaactcaaggacaattgggacatgtacattcgacgacatggagacaaagaaaaggttcggggcacccctcccccccggggcgctgttcaaacgtaaattattgcaccaattttggcgaactgttcacgggtcgtaaatctttggcggattgtcgcgacgacgacgaggacaatttatttttttttccaatgttgcgacttgttaatgttatttaattgggtcatttagtaattaaattaatcttgtaaaatttagtaaaactttttacaacttttattttaaattaataatgagtaaaaaaaacaaaaacggaaaaattgttaaaaaaactaaaaaaatatttcgtttaatacaaaanttatat

SEQ ID NO: 42563 - DNA, 603 bp, Heterodera glycines
aggtacaacagtgattaaaagaggtaaacagtgattaaaagaggtaaacagtgattagccgccgggcaccagtgattagaagatgtacaactgtgattaaaagaggtaaacagtgattaaaagaggaagaacagtgattagaagaggtgcaacagtgatcagaagaggtacaaatttgatgaagaggtacaaaagtgattaaaaaacgtacaaaagtgattaaaagaggtacaaaaatgcattaataatttttaaaaattgtaaaataaatgcctctttttattattaaaaaaaactttgaagcttataataatttaaatttatttagattgaaatcaaattagtttctgaaaaactcaaataaaaaaaaatatatgaaattatttaattaaaaaaataattaattttaataaaatttttcataaaaaaataatttaatttaaattaaaaaaatttattttttattatataacaaacactctttaaaatgaattaaaaacattaaaaataaccataaatataacgaaaataatgtacaccgcccggattcgaacttccccacccctcccccctcaaaatgatgctcagaaccccaacacacag

SEQ ID NO: 42564 - DNA, 886 bp, Heterodera glycines
aaaaaaaaaaaaaaggggagcctttaaaaattataaaaaaatttttaattccaaatttctgggagtgacctccatcccggttctttccttgtctttttgatgccctcgcaaaatctggtttcctttggatccagtttataaaaaaaaagttaagcctaaaatttttcgcatatttaaaaagcaattaaaaatttttagattttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagatttttattcatctccctttttgatagtgtaagcatctgagagccttatttaacttgcaaataaaatttggtgcgtttcagagcacgttctaaaaaatatttatgaattaattttgctaaaaaaataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatc

SEQ ID NO: 42565 - DNA, 398 bp, Heterodera glycines
atcaattttcatttttgatgttcagccctcatttctctctctctctctctctccctctctcccccctctctcccttcaccctctctcccttcccactttctcttccccctctctctatctctctctcttctcccccctcccactctctttctccctttgtgctacaccaccccagtcatgcgttatgatgactctctcacactgctcccactctttttgtaatcaatgccgctccctttttccattattgttctgctcatacaaagtacacaaaaatctgtcatctgactccactccccccctccctaacagaaatgcttggtgagaggaaaaaaagatcgtttttttgcggccactaacaacaataaaaggattatgttccggggggaggaaaaaaa

SEQ ID NO: 42566 - DNA, 1055 bp, Heterodera glycines
cttagaccatttttttctaggcttagatcacatgcgacttccggcactctgataattttagcgctcataatgggatgtatataggcgattgtagaaggaattggaagcgctaaaattgtttgagaagctttttgagcgtaattacgatttttacttagaccttttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttaaatcacatgcgattttcggcactctgataattttagcgctcataatgggatgtataaaggcgattggagaaggaattggaagcgctaaaattgtttgagaagctttttgagcgtaattacgatttttacttacaccattttttgctaggcttagatcacatgcgattttcggcactctgataattttagcgctcataatgggatgtataaaggcaattgtagaaggaattggaagcgctaaaattgtttgagaagcttttttagcgtaattacgatttttacttacatacagattttggtacaacgggggggggggaaggcccaccacgaggccgcgaagcggccgagtgagtaccttcggtgcaggaaaattattaaggaagagagttcattatttatttgtcttttgcataattaattcataagtatttttacagaaactgctctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaattttaaag

SEQ ID NO: 42567 - DNA, 828 bp, Heterodera glycines
cccagagaaacggagaccactttcaagcaaccattttccgccctctatcgactggtatttttttcggaaaaatttctgttttttcccggaaatagaaaatttttttggcctgagcgggacatttgagtcccgggtccataactcgttaggggttggttttatcgaaaaaacgccttagtgcaaaattgtagagcttttaaaatgctatcgaatagtgtattatatggccggaaattttcaaaaattttcgagctaggccccctagaaattttcggaaaattttttttggttgaaaaatatggtgaaaaatttttttctgggtatttttaaggtgctgagcacgaatctgatgttcattttcagtttaggaaattttagaattttttaaaaattcaaaaatatttggcaattttttggccctcgggattttgggtaaaattttgaaacttcgtaactcatttcaatttaggatgaatttcatgcaataaagctttaaaaatagagaaaaataaggagaattttatgggatttatctggtatttctatcttcaaaagaaaaaaagttattccagaatttctggaaaaattcgaatttccagaaaaaaattcataactcggttctgaaaggtcatactgtaaaagtaaaatactacaaaaatccgcaatttttttctctataatataaattttattttaaatttttatcacatttttaaaaaaagatataaaaataaaagtgatttttggtttcgggaccataggggggtgaccaggatttttgggtggaaaaattttttcaccgaaaatattccaaaaacatgtctttag

SEQ ID NO: 42568 - DNA, 739 bp, Heterodera glycines
taattaattttggttattattacctgatataaatcagcttcaaagccactacttttcaaataaggcaatgcttcagccgtgatgaataagcttatgacagaaaatgcactgaatgcaaaacagaaaatgaacaaaaccgacaaatagtaaatcttttccattgttttgtaactaaaacattaattatataattaacaaggattacatatttaatttatcaaatgaaataaaaccatttttgttaaaatgaaaaagcggtgacaaaagtactattataaaaactgatttaaaagcttcaaggcacgttaaatattataaaaaatttctaatttattaggcaaaattgcgaaactcaaaataaattttaatggttattcatagatttataaaaaaaatatattttttaaaagtttatttatattaattaattaaaaaattggttataaataagggaatatgacgcaaaagagtcggtcaattgcagtacaaagcattgcaggaaacacaccattataaccaatgattgaaagtgtgccaattttaacggccaatttatagtcaatgaatgtttggccggtcaaactgaggaacaaaaatgtgaaatacgatgattgatgcgcaatttcgagggccgcattaaatgccaataaacgatttgtcgggctatttaatgttctaaaattaaaaaataatatttttattttgaaaaatattttataataaatgcaagaacataaaa

SEQ ID NO: 42569 - DNA, 878 bp, Heterodera glycines
  misc_feature (841)..(841): n is a, c, g, or t
  misc_feature (856)..(857): n is a, c, g, or t
gttatcatttttcgccgattttttatgataagttcctccccgacgaagatgttgctccccgagatttttttaaattttccccagctcccgctccccgacttttatctccccgaaagtttgtttgatacttttatattcgagaataatcattggacaaaatcttttctaacatgtcataccattcattcacttgtgcgaaatttctctctttttttgatgggtttgctgtgtcatctttttttaatgcctaaaattttctgttacaagaaagtgccatttacgctatgccatcatgcccccggggccatccatcattttcatccgctttaaatctttaccccccccccccccaaccaccaatccttttttttgtctgcatttcacttatgttatgctcttttcctcttctgcctgagcctcagttttattacatacatacaataaccattgaattttttaattaatttttaaattttattttaaatttttctttgtgattttttgctccccataatttttttttatttcatcccatttttgtaacattcaacacaaaattagcaaataatttagaaactaaaaaagcgaaacaaattaaacaaattttaatgaaaaatgacattctcattatcagcggagagcaaattaattaatatatattttaaattaatttttctttaattttttattccctggatttttgctaatttttttttttttgaatgcttcgttgactccttttgaattccttttataagattatttaaaaaaaaaacatttcttcattccaaaacttttcattaggcattttccacttctttttatttaatatttattcaanaaaatttattattcnncatcaatatcacacttttaat

SEQ ID NO: 42570 - DNA, 1031 bp, Heterodera glycines
gtcccttgccctgatcgtcggtcccttcgtggccttcagatatctctgacaaattacggcgcataaattagcgcccgctgaatcgcccattaatgcaatcttggtcgggtcgatgccataagtcgaaaatggcactttgttcaattccgcaatgactctttcacattggagaagtgccgttgggaattttgcctcgggcgaaagggaataatcgatggaaatgattgggatgccgactttccaactcaaacacagcaaagcgccgtcgtaataccctgaaaatgggcaacattacgatcaattgtttgcttaggacaaatggcgccacttccattggctaaattagtcaattagatttgcttgcttggctttccgatgcaccatccgccgccgtgaataaacacaacagcaccgttgtgccgtcgtttgtccccctttggcacgtacaatcggcacggcacccccgcaatggattcgtcgcgcacatcgcaccaatgggcggcgaagagccaacggaaaagccaacgagggaagacggggaaggtgaggagagaaagggcacgactcaatttgttacgtgcggaatgaccggcggcgatttcgacgagggaaccctttgggggaaaaagggagagaaatgagagggaaaagcaaaaggaaaaggaaaagccgaatgaatcggagaatgtgtgcactgagttaacacttatcccccaccaactaaatattcgttgaacaatcgcatcaaaaactcaaaaagcgcaattttccttcggtcggcgattcgcgcggggagcggtcgatggagggcgacgagcaacagcaaaaggatgaaaatgaaaaggaaaagccaacagagagccatgccgatgagagaggacagcacagagaggaagagaccgaaagagtcgggctgaaaaagacggggaaattgacacaaaaatgggagaaagggacaaatgctaaattgcaaaaatatacgctctattaaacacttcccccccccccccctcaatctgttgaataaattg

SEQ ID NO: 42571 - DNA, 1396 bp, Heterodera glycines
gcagcaattgcatcttagagtgtaaataaacaattgacaatggcgaaatgaccaaatccttagaggaatgctccaccataatgagcaagtgttcgcggagtcttggcaaatcgccttgcaacttcgccattctctcgcggtccctcaaaattgaaaaatacgaaattagaaatagtaatgattccttttattcaaagttcatttattgttttacaatgcaatttcctcctcgcgccttctcagcgcatcctcgtctttgtcaatcatcgaattttgagaacaaatctaaggggagtctgaaaaagaggtggtccaatacaattaagtccgcttctgcttccaattgctctttaattttgaaggcatccccaattctcaaatttgcatttgccaattccgtcgccattccttcgcatttgctatttgctttgtccaactcttcctcaagtaaattcaaacgttcttcggatttgtcttcgccaaattgcgtcttaaacatgcccaaaaatatctttttgactattctcgtttttcttattgaaaatgatacttcgtccgtttgagtggaaaaatcgctcagttccgaagattttttgcgtctatttgccatggccgtttccttctcttcactgccggcactgctgctcaccccttcgacttcgatttcctctttgcccatccgttcccaatcgttgtttgaagtcgctgagtccgtgtcactgggaggcctctgagtttgagttaaaattagagtgaattttgcaggaagtagggactgaatgatctctgatggcattgtcccctccatatgtcgcgtttgtccccgcccccttccctttcccccgtttttctccgtagttttccccgactgactgactttgctatgtccctccgacgtcgtaatttcggccaacactttgtcgttgcgcagcctgtacagctcctcctctcgctcgttcagttccgtcttcagctgcacattctgctcgaccatttccgcaatttgctgctccgtcattctttgcttcggttcatcgtccgtttggctttgcctttcgtccgattttttccgctgcgtttgcaaattgctcaaagtttccttctcatttctcagttcgtctctttctgcagtcactcgttcaatctttgcaaatttagttttctttcttcctttttagtattcctttccaattacctctctggtgaattcgtcttccgtttcggcaaattttttccgcaaaatgcttaatttgtcttcgctgtcattcagtgcatttcgcaattcgttaagttgttccaatgagtcgtgcagttggctgttctcctgtattttaaaaatattgaatgaaaaataagttgtaatataaaagaagaaaagtgaattataagtaaataa

SEQ ID NO: 42572 - DNA, 1385 bp, Heterodera glycines
  misc_feature (1318)..(1318): n is a, c, g, or t
aaaaaaatggattttttcaagggttcggtttggggtcttccaaacaatatggggaagcaaaaattccaacgcagaaattaaagtacagggttataggggaagttattccggaaggatttggttctcccccataaatctgggcgcatcggttcaagggtactgccccgaaaatccaaaaaaaaatttttttttggataaaaaataattaaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaataccacacaagtattatttttttttaattatttttttcatttatcacccaacgttctagactgatcagaagctcaccaaattttgcagggaaactgctgagaaccctacaaatgcttataaattttcttagaattttttgcctggaggaacacagttcttcacacttaccacaccagcattattttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattattttttgcatttgatcacccaacgttctagactgatcagaagctcaccaaattttgcagggaaactgctgagaacccttcaaatgcttataaattttcttagaattttttgcctggaggaacacagttcttcacacttaccacaacagcntaaaaatttttggcctgtttaaaaaaggaattaaaaatttttttaaatttattcatctccctttttg

SEQ ID NO: 42573 - DNA, 537 bp, Heterodera glycines
gggaaagtgaatgcgatcacctaattgagcatggtaatgagtagaaaatgaaattaattagcacattctttccccacctgtcggcaaatttcgtcgggccccgccctcttttgccccgggggacagccgcacaattcctcgcctatgcaaatttcgcccaattcgggccgacatggcaatcccccgcacagtgccgtcgtcttactgagcagctcaatgtccgtcgccacttggattttgccacatccgatgacaaataaaaatataatttttaaaacgttggaggcaatcattttttagtgattttataaataaatgaaaagtggttggaataaaaataatcggttggttaaacgatgaatgactcatttgaatttaatttatgtaaaggcaagccctgtttaataaaacagctaataacaattattcatatttctcataaataattaatattattaaagagtttgtaatttacaattataaagtatatttcaatagatatgtacgaacaaataaaatgacctcaggcatcaagct

SEQ ID NO: 42574 - DNA, 753 bp, Heterodera glycines
tttgaccgaacgcaaagatttgcgcccgcgctgattttaaaccgaatgaatgcttttcggattgaagcatttgattgatgatgatgattgtggaaggggaggctcaaaacgatgtgtaggaaatttgttattcttcagtttgttatcgtttcataggtattttggtataaacttttgaaaaaagtgaccaagacaagaaaccagggttgtcaactgaaattttcaaaatcagcagttggtctacaaaaaattagcattttgaaaactttgttccaaaaaaaaaattaataaaaaatgtttttgcggaattatgcgtaaaaatttcagaaaattatgcatatacattttttagcatttttccaaaattcactaaattatattcaaaaaagttaaaaaaaattaagccaaatcagtattgagataaataatttttaaatcaaaaattcatgttaagaaaacaaataaataaattttggaggtgattttgggtcgattcttaggatgtattttttgaaaaaaattttaggtcaattcttagggttgtatttttcgtttttattgcatttttgttaataattttgggcaaaatgccaaaataggcaaaaataggttctttcaaaattttttaggcttttaggcgctaaaaataaaagcctagaaaataggcactaataactagaaaagtagcttaacaaccagcaaaaaaacaacatgttttcgtgcgttttatgccactgggagctcaggaaaaaa

SEQ ID NO: 42575 - DNA, 1585 bp, Heterodera glycines
atttttagtccatttcatcttgagtgttatgacattacttatatattgaatgtttatttcaatgtttagaaattttatactgtttttttgtttatattcctttgattggcatagttatttttaaagttatttatattttacacgttttttaagttgcctaattgatcttttttgatgacttggtcaaactaaattttttaaaatttatttttggttgatttatcgcacaaatcacaaggcgctaatgcactctaacagtggcatcattttcagaatatagataccgcactttttataaagtcggggaccgcgaatcgggattggcatgtccgggataaaattatcgctggggaaaagccgtacatgttttatttttatataattttttggattttagaaaatttataaatttcttgtgaaaatgtcttttttttggaaaatttttccctaatgaaaaataaatttctaaaaaacgaaaaaacattttactattcctaattacatttggcatgccctcttttacgttttgtcctaaaaactaaaaattttatttgcatattttggtgaaaagttggaatttttttatatattcagaaaaatttcgtcattgtttgtatacattttatataaacccatattaattagttattattatagaataaatattttttgtataaaactaattaatgcataataaaaattatttatgcaaatgatattgcatataattgtcttagcaataactttatttaatttaaaaaatatatagttatttgatacagaatttttcgctacgatattgcttaatttaataaattcataattattagattttaaataattaataaaatttaaaataaaggtaaaatttaaaaattcttatttgaattttaaggtttttttctaatttcattttgccatagcgaaaatgaaataaatggaattttttgactcttatatattaaaattttgaagaatattcaaaatttaattcattccaatttctgaatatttttttgtcttttaaaattctaatgatccatttatcaaattcttaggcttaaatataagggttttgttttaaaatgatttttaaactcaagaaaaatttagaaatattccactcttattaattatctaaaccaaaacttaaataatgatttttctttctttctattgttgcttccttaatatttgttttttttcgctttgggcaatttatagttaaactgttaatatttctatttatcatctatgagttttttttcaataaataaatttttctattcattcgattacaaatttttcttttatacatttgaattttcattttttgaaagtaattatttctttagttgagctatgactgaaagagacaaatctcatataaattttatgactttaataattcggtgtaaaaattataaatgaaaaagcaaaacaaaataaatagtaacaattttggtttttctatgttaactttcagttggaaagtttatttattgtatttacaatggtgtaatttaaaatataaaaaaatctttaaaaagtcataaactggcctgatctatatcataataattcc

SEQ ID NO: 42576 - DNA, 1070 bp, Heterodera glycines
taatagggcctagttaagctgtaaaaaaaatttgggggcgatttaaaagagaatagaaagaaccaggttcgatgaagttttggtaagccaaaaaaaatccaaacatttaaaaatctataaaaaatttaaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctattaaaaaaataaaatagtgaagttttaaaaattaataaaaatttttaaattaagagttactggcgttagcatcatagcggtgcttttccttgtctttttgatgcccttgcaaaatctggtgcgcttctgatcagtttaattaaaaaaagttaagcctaaactttttggcatgtttaaaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaagtgagaattcatgcgagattttctggaaataagcttaata

SEQ ID NO: 42577 - DNA, 1439 bp, Heterodera glycines
  misc_feature (1376)..(1376): n is a, c, g, or t
tccacagaatctcgaatgggtcaacaacttcaaagaggtgtgtctcgccatattttctataaattgttgttttttccaattttttatttagacatttcgccgtgccaccacttctgtcagttacaatattcaattttatcttcgtgtggaaccaatgccaattgagccatttgaattggtgaacgaagtgacaaatgagaagctgacactgacgaaggatggcactggtgaattcaattggctgttggagagatgcccaattattggggagacggcggcggttcagaaacagcagcagaagaaggacgaaaattcggatgccaatttgaacaaagtgttcttccgcctttacgatgacattgggtgagcagaaaggaggccttttttgtatgaaacacggatagggaaacggtatcccatgtacagtactttcccagaatcttggcagggccatgggttctgttaagacagaacttcagtccttagttttgtcttttttgctctggtccatcccgaaaaccctgctggtccgggtttttccaataattacgggctgtactttcgaaaaagttatccgattcaaattgcgcttaatttaggccgctgtctccgccaggtcaaagcaatgaaaaagtgttctctttttccgggtccagtgatcagcggaataagaaaaagtgatcattttgggaaatggccgatcattatcgagttatgatgtattggattgattgatgatgttttgtttgctctttgaattgttcaatttgacgctgacatttttgctattaaaaaaatggaaaatttggcactttttttttactttagataatccgatgttttttctttaggcaactgatttttggtcgtgttttttgtttgtgttcaagtttcaaaaataatttttttagagtaactaaacttgttttgggtctcggttttaaagtctcgggattttatagaggcaagaaaagaacaaataccaagcattcataaaaaaattacaatgagaaaacacgaaattcaactttgttttccgagtgtatttgcgaattattttttccaatagccttaggtaaaaattaaaaaaaaacaattcttagactttaaacttatcaatagggaacggatttttaagcgcgaaaaagtcaaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaagggtcgattctcaggggcgtatttttccgnaaattttttgggtcgattcttaagggtgtattttttgaaaatttttaggtcaattctcagggg

SEQ ID NO: 42578 - DNA, 439 bp, Heterodera glycines
ttttaccgatttccccccccccatcccccaaaaaaggcattaagtgactattttgaattttgcctcttctcattagcaatataggcttttcccctttcccccccccccccaaagcgtcggccggggtttctcttgttaaaacctgcgcacattcacaaacaaaaccatcacatcccccggcgggttgccgcatatgcatagataatagaatagatataggtgtgggcttaggcttgggctgtgagtataatgattgaaaatgaaccaattaattatttattggcgtgcggcggtgcgcggagagtccccccccccccccgggggaacttccggccctcgccccctcctcccccctttttgccctcttttgccccccgtcgcacagaaaattaatgtgcagaaaattgatcgaaattgctatacattttttttacttttt

SEQ ID NO: 42579 - DNA, 911 bp, Heterodera glycines
  misc_feature (837)..(837): n is a, c, g, or t
taccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttaaatttattctctatgccagaaaaatggttatctcttttttgcgagaaattttgtaccatacaaatgttcccagcatgggcagaggggcgcggagagcaatggccattctattctacagggaatttttnaatttattctctatgccagaaaaatggttatctcttttttgcgagaaatttgtaccatacaaatgttcccagca

SEQ ID NO: 42580 - DNA, 1011 bp, Heterodera glycines
  misc_feature (964)..(964): n is a, c, g, or t
  misc_feature (994)..(994): n is a, c, g, or t
ttgagataatttttttttccgattcctttatctccaagcatgagccttataagtgattgttcatatccccttctcttgaaaaaaaattgtcactaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgctattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataattttttttccgnattcactttatctccaagcccatgagcctntataagtgattgttcat

SEQ ID NO: 42581 - DNA, 1665 bp, Heterodera glycines
agccccgccatttcttggaagccgatcagtgcgttgcgaagttccgccggcgtcggaatgggcgaagagaggtagccaaattggagcagatacttctaaagagaggagggattgcaaagtgagcagcagaagggtaaaaagtcggaattggcatgagaagttggaacttttgccatttcggtggctcttcccggcttttggcaaatatcccctgactgaccaatgccattccgtggtgccgttcgtcgtccaattcgccgttcgtcggtacgtccccctccattttgccgctgctcgtctcttccggccactgcttctcctcctcttcccttctctcctccatcgaatgccttcgcggcattcccttgccgagaattgccattgtcgccataatcagccaaatggaattgagaagcatcgtcgtctttctcgggtgattggggcggacgaatgaagaagaggagaattatacgagaattccccgcaggggacattgaccctttcgcctcgtcgtcagcgaattgcgcacatttatatcccaaatcggagatcgaaggaggggggaggggagggggtttttaatatttaggtggaaatcgcttttcgaatgaagaaaaaatgagtaaaatgacaatttattatcaaatgaaaaaagcgaatccttctttgcttgataaagaaattgctgaattattggaaatctctgaacgcactctcagaaattggaaaaacaaaaatcaaaatttgtgatttgtgtcaacgaagcagatcatttcacatctggcttccctagaaacgttttgatgattttctttattttttttattattttgggtttttattttgctaaataaaatatgtttcaagtctattttgttcatttttatgacattttgtgcatatttcaccctttatgaagttatttttccaaaaaataaccattttaaaattttattttacatattttgcaattatcttaaataaaattctcagccctactaattatgtcatttgtatggcgtttttgtttttattaactttaatctaagattttttgccaagatagtaatagggatttttgtacatgggtcccattttaattattggcatttttaccggttagtgtctgtactagaaaaatcggtgcggtaacggtaccattaccacaaaccgctaattaccgaccggcaccggtactggtatgaaactcgtttcataacaaagtaacttttcatttaattaaaatgcttaaatcaatatttaaaatagaaattcaatttgtctgatttgttcgaacattcgggatttttcttctcaaaaattgtgtgcgtcatcctcacattaattaatagttacatttattcaaattttacttaacgttaagaaattataattgttcaaacttttaacccaccaattttcttttcacgttaagttgagacaattggaatattcagctgcgtcttaattaacatttttcatttcatctgtttacattgaattataaattaatgtgtgtcattagtgggcatagaaatgaaatattctgtcagagcgtgtgcctcggtttttgggttttgattatgaaaaaacaatgtaagtttgcaatattgttttaattacggtacagacaattattcgtttgtgaaaaaaattattttgttt

SEQ ID NO: 42582 - DNA, 1097 bp, Heterodera glycines
ataaaaaatgacgcaatttattaatatataaatcatacatgacaattttaaattactaaataattacaacattaaagccttgtgaagaattcaggcttgggaaaataaactaaatgtcggtaattttgaaagaaagtaattttgaaaactaaagtccgttagacaattttccataagtatttattaaaatgaaattgttcaaaaaaataaatttcatctcatcttttaagcaacaatttttaaataaaatttattcaaacatttttacttaatttaatgattgaaattaaaaaaattaattgttataaaaaatcaaatattcaaaatatacataaaattgattttaaatcaatatagtaaaaatgcaaggatatatataagaaaaattcaaataggaaaaactatatacagccaatgttaattataagaaattatttataccaaatttcaaaaatataaaataaataattatttttttaaatcttttaataatgaaaaattttacaaaatgcattaatttaaaaacagtaagtaataccgagaatgaaattaatttaaacaaaaataatataaaattttagtcaaaagttatatttttgatctcatcccaaaaagaaatgaacttaattaataaacataaatttttaaataataattctacgatttatcaacttagcgtattcatatggaaaaatttgaaaaataagttatgaaatgataatttaataaaaaatgtaactaattgatatattttataaacttatatacagaaaatatgcattcactatatttagggcaacaatattttaaaaggttcaagcatatgaatttttgtatgtctttcaaattcaagtgatccaaaaaagaaccataaaaactaatattatagataaatatcaaaaacccgaaaattcttcaaaaataaaataactttttgacatttatataaaattcctgaaacaaaagaagaaaataaaattgaacaacatagaaattatataaaaatactattggaatgaataaaattacattaaaattcctatgaaaaacacattaagggatagaaatgaaaataaaagaaattatttatgatggaa

SEQ ID NO: 42583 - DNA, 143 bp, Heterodera glycines
taataataataaaacatatttcacaggttttattttttaaacaaaatgttaaccaaattaataaatatctaacatttatttttcggttattttcatcaaaacatataattatgaaaaattattttaatttaattagtttcatt

SEQ ID NO: 42584 - DNA, 724 bp, Heterodera glycines
ttttatttttcgcttcaaatttaaaaaaaattcaattttccaatggttgtgaatattttccccttttttctttttggtattgtttttaaacttatgacatttaattttaaggctgcatgttcaataggttgaatcagctacaataggttaggaatttttccagggaatatccctgacgaatacttaaaaaaatgtgtaattactatacaaaaattatgatttttcttttaattttttttgttcttgatataaattttatttaaatctataatttatgacaaagcgaaataaataagtaatatcgtatatattttatgcacgagacttacgcaagatgagatgaatttttgaaaaaaactgcatatttttttaggtttaaaatattataaattttattgcataatgagtttcattataattatagatttcataatttagcaattttataataagaaacgtcctaactattaagtatttttatttactatgaataatatgcaaatgagtaaacaaatatataaaatttacatataaatattacatgatcttagaaaaatatattcatcagtgattataagggattagaatatatttaaattattaaacattaaaatctatctactaaatagtttattatgtagggtcaaccaaaatctctgagtttattggaattaaagtttttgctctcgccagttgaatatgaagcccttcaaggtctacttga

SEQ ID NO: 42585 - DNA, 989 bp, Heterodera glycines
ccgacttcggacaaatttcttaccttttgtatttattgcggctagtatcttcaataatttgtcagtttggtcggatgtgcgtcaaacggaaaaaataattaaaattttataaaaacacataaatagtataacaaaaaatatcaaatttccgaacaaactaaggtcgcacatttcatagtttagggaaacaccagtgagaaaattgttagcgttttcgggattcacattgacatttgcataattgtgatcattttgggggaagtgattgttattgatgtcgttataacggtagaagagtcggagaatccgtgcatcggcttcgcgatacttcttttatcgtttgatcacctaaaaaaccaaaaaataacaaaattgtttttggatataaacccactttttgtggcgattttgctcggaaaagctgctagtacaggtgtgcatgtgttttgcaccacttgagcacgaatagtcacaggtgcttcgcacgtctcagcagcacgtcgcttgaatccagttataagtcgctgacattccacatgcgcagcgttcatgaaataaatgtgagttatgaattctcttttatatgcaaccacgcgaaaacggccctcacgcgaaaacgtcctggcccgtaaatatttatgaaaacattgaaaaattcaaaaatacctattgaataaaaatgggaaaatttgcagtgcaaaaattcatcttgtcttattccccatttcttcctcatgttccatccctccccaatccgtccttccgtctccaaataactccgtccatcgaccattgactaagtgaccgccaaacccaacccgaccgcatttctctctcccgtttcctgactaggcaaacattcactaaaaaatgactttttaaacaaaaaaaaaaaaaattaccaaaaaaaagtgagaaaattttcatcattctgaaagcatcttttttgtcgtgaatttttttaaggatttcagagtttttcgttttac

SEQ ID NO: 42586 - DNA, 591 bp, Heterodera glycines
  misc_feature (57)..(57): n is a, c, g, or t
gcggggattgtggctgatcaagtcgggacttttagtccacggtcctaacacacgatntacatatttgcaagtaatgcactaaagaaagaataaatgccttccttttcttattctttaataattgacatttttgatttttgcatattaaaattaataaaaacaaaataagttaaattaatttaatttaatttaaataagaatttatttttttatagaagaaaaccgcaaacgaaatttatatcgtggcaaaagcaaataggtatggtaaaataaaaaagtgacttttgaaataacacaaaatttttaaatgccgaaacgcgacgcgcaactgcctttgaaaaataaataaattaattaaaaaaatcataataaaaaatacaattcattctatcatttttcatttatttttgtaacattagaaaaagtattattatattccacataataatgaaagcttttgaacaaaaatatctttcgcaattccattcttttgtgttgtaaatcaaaagcattcaaaaagcgtttagtatataaagcgctaaaattacaccaaaatcaacaaaaagaataaataaaaataaatgctttttt

SEQ ID NO: 42587 - DNA, 990 bp, Heterodera glycines
ttgcggggtccgtcgggggtgtggcattcttacagtatgctctttttaggctctctccgtggaatgagtgatttggtccgttttctgccaaatgccttttctctgcttaaccacagggaatgcctttagacttgtgagtctgcaaatgtttttggctctgtggtcaattcgacttgcgattcggtcgacgcgtccattcgatcgatgtatacggtaggaagggatggggagggtacggtaaggttgagacgcaaaggaatcccatccaatcataaatggaagatgttagcgaagactgaggagcttgacgagtctttgcggagcattgagaagctgctgcagcagatcaaagacaccaaaagacttctggacaaattcgaagagcacattgtcgtaggaaatcagtgatcagaaatgatttggcattttgttttgaatttttatccatttttatcgaacaaatcaataaatggatgaaagggaaaataaaaggaaaagagagaaagaagcatccgatgaaaggagaaagtgcacaggggggaagagagagtttggtctgtgccacgcaaggctcaaatgacggcaaaacactctcagttcgaaattttccaataaaactactcgtttgataagaaaccatcgctttggaaattgaatttgaatgccaactttgggccgtacagtaacaaatttagcggaattagagaaattcactgggaaatgggacacaattggataatgaaaatggcatttgttatcgagcaaaaatatttgacaaaatttcgtttttttttaattgaattctttcatttttcgttttcttttttgttgctcgacaaatgtcacttttctattgaaaagcgaccgggatttacaaaagaaagagaaaggaaaagatgaaagggaaaagcaaagggacgacgaattggccgattgaatcggccgctctaagtacagtcagtgcaatcaaagcacaaaagcgcagactgt

SEQ ID NO: 42588 - DNA, 1263 bp, Heterodera glycines
ttttcatgactttttttaaaaattttaaaaaggggcactttccatatagcgcggaaaattctataatctctggacccctaaaatcaaattttcggcgaatacaataccgtgtcataatatatttatattatgcattttaacaaactaacatataaataattgacaaaaattaaattttaatttgaatatttcttgaaaaatatcaatacatacaaaagtatccaattaaaactttaataatcgcacgattctgttgtttgggtggttgcgaatgaaatatttacggctaaatgaatgaatgaattaatccttaacaatttatctttcatttgatggatttaacctttcgttaaaaatgagaaggtaaaggccgacgacgggggcgaaaagccaaacgaacatcggcggagattggatattcatcagatattggaaggcaggctaaacagtgattgtgactatgcatcgtcaagagggggggggggggggggggagttggtactcttctaatttacgagacaaacacacacataatttttcagacataaaattctgaaaattcatacggacgactttttaaatcccgagcccgggtttgggttctccggcatcgaaaaatctcgggtgaccgccgttgggaccgataaggcatttcaggtttttcaggaatgctatgtaaatttaagtaagggaaaattcccggctaaaaatatttagtcaagagcttcatattctgtcaaaatttttactctaaaaatgcttcttaaaatgtatatgaaatttggtctgtaaattagaagaattactttaaatcaattattctcgtccctttcccaaatcactgaccgtatagacaaacaaattcaacaacagaatctcgatgatgatggcaaatatgctgactaagttggtgatgccgtgttggaagatggaaatgcgacgggtggtgcacatgaacagatggaacacttgggacatgacctttggagggggggaggaagtggggaaatggcggatagggggagggggacaaagggatgccgacacaccaaagtgacttgccaagcagctgaaagttaaaagcaaattgatcggattaattgccttttcaattgcactgaccagctgcttgtcttcgtactcgcacttggtcagacgcgctcagctcctaaaaccagtggtcatttatttgcagtttcggcaatgccatcaccaatcctcggctggtggttagggtagccgattcccagtgccaatgatact

SEQ ID NO: 42589 - DNA, 1449 bp, Heterodera glycines
  misc_feature (132)..(132): n is a, c, g, or t
  misc_feature (175)..(175): n is a, c, g, or t
  misc_feature (1442)..(1442): n is a, c, g, or t
agaaaaaagtcaagctgacgcgaaagagctgcacgccaatgttgggatgacagcagtgaattggggcccgcatcagtaccaagtactgagcggacaggcgggccactttatctttcgctcaaacaaatttgnagtgacaaacacccactgcaaaactgatggtggtgagcctttntagtgaacaaatcggacaagtatcgctcatcaacggacagcatcaagtcgtcaaggacgagcaaaagaggcttagggaggcgcttaatcaattcctcggatgggactcccgcgtacacatcaactcctgccttttgaagcacaggcaccgccgcattcatttcaccaaaacaatagagcatggacacaggctttggtgtgattaagtggtctgattcggcaatgaattttagcaaaaattgagtttttcccgacgacgaaggccccgaaatgattagaccaaatggtaatttaaagcaaatgtctttatcgctgaatgcttggctgtttaacatttttacacaaaatgagggtctacatgtttgctgtggatgctttaatactgttgaagaaatcgtcaagcgttttgtcaatgtctccgaggtcctctttttgttggtcatcatcatcttctttgtgttcttccgccacagttgcttcttcttcttttttgatgtccgcgacatcatttttcagcggagtagcggaggtggtgtccagcgattccgccaaaaggaggttgccgagcacattgattgctgttttcgccttcttccagcgtgcgccgtcctgcatggcatcggccattagtccggcctccactaagtcaagagctacctttgctttgcgcttcagctcatgttgatgatagtcattggtgcggggccgtttagtggtgtgcgtgtcagaagagggtatgtcgccgtagggtatgttgaacactcgagacttatttttcaaacggaaaaagcaatgaaccggcaaatcgtacaccacatcgaacggaatgaattgggccttctatatgcgcgtgcaccaaagcgtgatgccttctttcgtgatcacagtgtcaatttcggactcagtgcccttacagcatctacaacggccggcttcatcaaatgggatgaagcgaggtgtcgagaggcggggaccgctgatggttatgccacttgaggtcacggtgaggtcagtttggccgaggatttggttgcacaacaattttttgtcggagatgttgattgccatgggaatgagtgaaaatgggataccaaatgaaaaatgtgccacccgatgcgcccgaaatatacgcaaaaagttgggccacaaaagttgtgtggtgccacgccacgcccacttttataatgttaacagaaaagcgggcgggatgggcgctcataaatgagccccccgtcaaaccgatcagcggatgaccaaccaaaattatntttccaa

SEQ ID NO: 42590 - DNA, 1529 bp, Heterodera glycines
  misc_feature (74)..(74): n is a, c, g, or t
ttaggtcattttttttggcattttgtgcctttttaccctttacggagaattttttccaaaaaaaataacttatntaaaattttttttaacatattttggtatttttcttacaaatttcaggattttttgcatattatgtacacattttgaccactttttgtacatatttttgccagccctaataattacatatatttttttcataatttttccctaaatcgtcaaatcattattacacattcccattaattaaaattgtaaattttttggagttaggtattttgaaaatttcctgtacctatccggggtagttccgcagtaccaaaaataattgccgaaattacggccccaccaaattagttaaataaaaatttaatttcaagaaaaaaaaaccgttgtaccaaattttataggcatactccacggtccataattaacttaacctgaaaatattcaacgcttattggttttaaaaaaattttcgttactttgagttttccatgattttatttttattttttgcaaaattaattatattttaagctaataaagattcttttctcgagactaaaattagacttctaaatactgtaaattttattgattggataatgattatttaaataaaacttttaaaatattccaaaaaaacaaaaagaaaaaaagaaactgaccaaaacagctgaaatgagtgcaataatgataattgccacaattaattgatgcactgcttctgtgatttgttgatcgccaagaattgaatccaatcgcaaatcccataaactgtccacaattcgcttgccttggcccgtctgattgcttggctgatattctgccttagcaaaattttgggtttaaaatttaaatagaaaacagttaaaaattgattattaataaaatataagaaaaattgaatttttgtaagccaaggacgtccttttaaaaaatactctgttatggcatttaaaaagatcattgaagcaagaacgcataaaaatcgaatttttcattaattttttggtttttggctaaaaaaataaatcattttcaactaaactcaaaaaaatttcgtaattaaaagttaacattagcagttctctgcttttatgaaatttctttatgaatttaaaataatattgatttactattatgttgctaaattaaaatgaattacaaattaataaaatgtctttataaatgaattaattttgtcaaaaaaatattctataaatttataaattttttatttaaataacaaatcacaaacattgggttttctgctgctgattgaacttgatggtggtgggactgttttcatttgtcgataatcgtttgaaacggaggccattgttgaggttgattgattataattgaaagttttatttttaatcatcgagaattaaaaataaatttaaataaataaattatttgtgttttaaaaaaaattaaaaaaggaaacaatttaaaaataagaacggactgatgacttttttgtgatcattcacacaatccagtgcttactgactgac

SEQ ID NO: 42591 - DNA, 1142 bp, Heterodera glycines
  misc_feature (94)..(94): n is a, c, g, or t
  misc_feature (169)..(169): n is a, c, g, or t
  misc_feature (179)..(179): n is a, c, g, or t
gagaattgcaccaagttcgtctccaacaaaattttatttgtttcgggaaaatttcaatttttgcagaagcaaatgaccgacttggacttttcgnatgacaaaggcgcatcagcagaagcaggaaaagtggccgaactgacgggaggaactcacggcaaatgtttgggcnacagcaaacnggtttgataaagtgagcacaaaaaaaataattgcctaattgactgacaatgaacccattcaaattttgcttttattttctggtttgtattaaaaaacaccattggaacggatttttgtaaaaaaaattgtaccaattataaggctaatcgaagaggacgacacggacaaattggcatcatcatcctcatccttcagcaaattgcggcacaatgttgtcgccagtctgctgttggtgctgaactcgttgatgcatgattttcggacaaggtatatttgtttctaaagagtttcggacattaatgaaatcctgaattttcttttccattcttattcattgtcagccaatccgccttccttcgccaattggactcgcggacagcaaatttggacacttttgtgctcaaatcatccacaaatgttgtgccaactgctgcttctgtttgtgccggtgacagtgggaccacggacggtgccatgacaagttgcacgagagacgctgacaagcaacagcaggaagaattgacaatcgaccaaattcagtacatcatgcaaaatgagcacgtgtccaaggagcgcgaacaggaggtgcgaagaacaacaagatccccatcccctgttgtttcccccgatttttttatttctaacttttgttagaattttttcaaaaaaacctatgagcttttggtcactaataaagggtttttggaaatatattaaaaaccaaaagggggggggcccttctggtttgcaaaattttgtgttttatttgagtttgggttgtggattatttgtcttgacatacaatttttaagtctgacaaagagcggacccactctttcgaagcaatttgaaaagcgcattggttattcaggtgctcaaaatcagcaaatcaattctggaattgcatagcatgttcaagaacgattgcgtcgatgattattgaccagggcacaatttggaca

SEQ ID NO: 42592 - DNA, 954 bp, Heterodera glycines
  misc_feature (5)..(5): n is a, c, g, or t
  misc_feature (28)..(28): n is a, c, g, or t
  misc_feature (39)..(39): n is a, c, g, or t
  misc_feature (864)..(864): n is a, c, g, or t
  misc_feature (931)..(931): n is a, c, g, or t
aaaancaatgaactatatgaaggcctanagcttctcccntgctcacccaaggggacaaatttttagcatttaccattaaaataaaaataatcggaaatgaaacttttttctttatttatatgaaaaagccattggccacattctgtaaggaccaattggggttgatgccactgaaactatgtcggcacttttaaaggcttattgaaacattcaacaatttctataggaaagagtttttctattctattagaaaaatgccctcctaaagtcgaaaaaagttgaatatttggcttttggaccaattatatgtaaaatggacgaatatttttaaaaacattttgatcaaaattgaggccaaattttctgtttttgttaacccataacactgctagattcaaagtctcaatcgcaaaaacaatgaacaatgaaggcctaagcttctccctgttaaaaaatggggacaaatttttagcatttaccattaaaataataatcggaaatgaaacttttttctttatttatatgaaaaagccattggccacattctgtaaggaccaattggggttgatgccactgaaactatgtcggcaattttaaaggcttattgaagcattcaacaatttctataggaaagagtttttctattctattagaaaaatgccctcctaaagtcgaaaaaagttgaatatttggcttttggaccgaccaattatatgtaaaatggacgaatatttttaaaaacatttagatcaaaattgaggccaaattttctgtttttgttaacccataacactgctagattcaaagtctcaatcgcaaaaacaatgaacaatgaaggcctaagcttctcccctgtaaaaatgnggacaatttttagcatttacattaaaataaaaataaatcgaaatgaaacttttttctttattatatngaaaagccattggccacattctg

SEQ ID NO: 42593 - DNA, 1607 bp, Heterodera glycines
  misc_feature (1539)..(1539): n is a, c, g, or t
  misc_feature (1545)..(1545): n is a, c, g, or t
  misc_feature (1553)..(1553): n is a, c, g, or t
  misc_feature (1577)..(1577): n is a, c, g, or t
  misc_feature (1592)..(1592): n is a, c, g, or t
ttgcctcctcaaggtcgagccgtgcacgcagcgcatttccttctgattcgagtgccttccgctgccgctcccattggtcagcgtcgcatccggcgcgctcgcgcagcgcgtccatctccgcgcgacagtcacgctgctgtcttttctgaaccgaaaatgtgtcacatgacgtgaagcattcacaaataattggacctgagtttggagttgcgcttccgcttcaaacttttcgcgctgtaacgtgtccaactgagcggtgaaacgttgctccaattgttggctctaaaataaaaattaattttaatgactccattttataattttttccttttttagactataaatttcaagaaaaacaatttaaaaattgtggaaaaaaattccgaaattaaaaactggcactttttgctgaaatttcctttaattttcaattggcacttttagctaaaatttcgtttaattttcaattggcacttttaactcaaatttagtttaattttatggaaaaattatagcgctaacaagctaagggttgggctgacgccaagaaattataaaaaatcaaaaattcactgaatttccaaaaataaaactcagaaaattaaaaaaaacaaaatggcaccaatgccattatgccaactttcttctctctctcccccttatctttctctctcttcttttcctcccgctctctctctcccttctctttctctttctctctctctctctaccttccgttctgtgctctccaatttgtccaccgttaattggtgcgtttgcattggcactgtcgtgcgtctctggtccgccaactctctctccaatttgtcgatgtctgcgcgcagcactgtctcgtgctcctccgcttctctgacctccttccgtgccagttccaaattggcgcgcaaatgttggcattctgtgattttttcttccgccaatttttcgtgtgcgttcaattccgcgcgcagttcgaacatctcagcaggattagaagcactggaaaaaggggaaattgtaaaagcatttaaattcagtaagtatttgaaacttatttaaaaaaaactaatttaaaaattaaaaagaattttttaaattaagtatttagatcctaaaataaaactaaaatatttatttaaaacatcattttttggtttttaattcaatttttaactaattttgacaaaaaaaatgagaatttttcataataaaccacgaaacatatataaaacaacattaaaattctcaaatatttatttatttcgaatttacaacaacaaaaaaaaaatcctattaaacataaatcacttcgctaaaataaattgaatttacaaaaagatgatttgttaatttaaaaataattatttatggattttggaaaatatttttgttttttattgaatttccaaatgtaataaaattgtttattaatatgaatgtgaaagcacaaatgagaagaagagaacccgcccaacccattcattcacataacataaaatttttcccccacatttagcatcattaacaccaaaaaatggnggaatntatttgtncattatattcattcatgtccattntggaggagagagagncaaactgctcaatta

SEQ ID NO: 42594 - DNA, 1272 bp, Heterodera glycines
tgatgagaaaatggccatttataataattgggaaaatccttattagaatttgcacagggagtgagttggctgttggagcgggtaaaacgccggttgggtgccttagccgtggggcctttgtgccgtcagcatggcattgtgtgtcttgcggtactctttcacgtaataatccaaagtgtcggctaaaccctgcgcgaatggcaccgtacactcccagcccaattcctcgcgtattttggtgaagttctgaacagcggggtggcaaatgccgttccttcgattgggcttacgatgtaatatcgccggtcgtggtaggggcggtcggcgatcggttcgaaggatatttgggaggggtcccttaaaatgggggggggggggtgagttggcggtgatcagttgggcggtgcttgcctgtccatcagtttttgcactttttcctgcagcatttccgtcttaagggggttcgttcgtcgttctgtctgcctttgctgtctcttaccaagtgcaaattgcacttctcgaactccgtcccgatgttgtacgtctgtccgattcttcccctctccgttatgcgtcttatcgcttccgcacagtcgtccacgtacatccaactgcgcgagtgcatcccgtcgcccatcagcgggtacggcttgccctccagcgccagtcgggtgaacttcgggatcagcttggagtacgcttgccgtggcccgtacacattgttctaaagggccaatcgcagtgcatttggacgatgccgagacaatccatgctcaccattcggaccatcacatagggcaatttgtaggagtgcttaagggtgtgaaattgacctttgtctccgcctttccaagtgcgtccgtgccctccctccctcacatggtaactccggacgatcacctcacacgcggctttgcttgctgcgtaaggatttgttgggttcagcggcgaatcctcgcacttcggcgttgtgtcgtccatcgaatcgccgtacacttcgtcttaagggaatgcctctgcttaaactttgcggcacaatgccacacaccggtactgatatggaccaaacgacgcactcgcccatagaaattaatcgcctcgagcagtctaaaaaagtgggagaaggaatgtttttaaaggcaagtcaccctttggctacttgtgtgggtcttacgttgttgtggcaatcacattctcctgaattgtgccaatgcgatcggtgtacgattcgtccacgtgtgtaatggcagcgaaatggatgaccgtgtctat

SEQ ID NO: 42595 - DNA, 1063 bp, Heterodera glycines
  misc_feature (58)..(58): n is a, c, g, or t
  misc_feature (94)..(94): n is a, c, g, or t
aaattttttttacagcttaactaaggccctattaagctttatttccagaaaatctcgncatgaattctcatttttaaatttttttatagatttntaaatgtttgattttttttggcttaccaaactttcatcgaacctggttctttctattctctttcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggctctttttaaacatgccaaaaagtttaggcttaactttttttaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcg

SEQ ID NO: 42596 - DNA, 979 bp, Heterodera glycines
cgatttgaaagagaatagaaagaaccaggttcgatgaagctttgttaagccaaaaaaaatccaaatatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaagacacccaccacttttgcacttaaaaaaatttcaaaaaatttgatcgtccataaataatttgtaattgatcagcggctcaccaaattttgcagagatacgtatcggaacactacaaaagcttactaattttcctagatttattaaacccggtgaaaattttttgcagacacccaccacttttgcacttaaaaaatttcaaaaaatttgatcgtccataaataatttgtaattgatcaggggctcaccaaattttgcagagatacgtatcggaacactacaaaagcttactaattttcctagatttattaaacccggtgaaaattttttgcagacacccaccactttttcacttaaaaaaatttcaaaaaatttgatcgtccataaataatttgtaattgatcagcggctcaccaaattttgcagagatacgtatcggagcactacaaaagcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaaagcttactaattttcctagatttattaaaccccgtgaaaattttttgc

SEQ ID NO: 42597 - DNA, 837 bp, Heterodera glycines
gagcaaaaatccagcgcagaattaaagtacaggctatagtgaagctattccggaaggattcggtctcctcataaatctgggcgcatcggttcggggggactgccctgaaaacaaaaaaatcgattttttcaagtgtccgtttggggtactcaaacaattatggggagcaaaaatccaaggtaacaatatagtagaggtatatcgaagctattcccgaaggattcggactctttataaatctgggcgcatcggttcagtgggactgccccgacaacccacaaaaaaattttttggataaaaattatttaaatgaaccgactagataatatttaaaataggttatttatcttcctttcagtatccctgcaaagtatggtgcgcttctgatcagtttctgcaaaaaaagttaagcctaaattttctggcctgttaaaagaggaattaaaaatttttaaataattttattcatctcccttgtcgatagaaaaagcatcagagcgcctaaactggcatgtaaataaactttggtgagtttcagaaccctttcagaaaaaacatttaagaatccatttcgcaaaaattaactaacaacgaaagtctcactttgtgtagaagttttttgcaacagcgagctccacgctcacaaccgggggaaggatcgcccccccccccccttcggccgcaaagtgccccaaaattggggaccccttcgcatcgaggggggccgtgtaaaagaggggggggggaggtcgccgacgaacgagaaaagttctgagaaattggctattttcttaacaaaattcatttaaaattcttaaaattttttcccggcggcgc

SEQ ID NO: 42598 - DNA, 1261 bp, Heterodera glycines
  misc_feature (45)..(45): n is a, c, g, or t
  misc_feature (69)..(69): n is a, c, g, or t
  misc_feature (73)..(73): n is a, c, g, or t
  misc_feature (95)..(95): n is a, c, g, or t
taattgaaatgaaaacaaagcacaaattgctgtgggtgcataaanttatgattcagacaatttcattcncacngagatgagctttaagtgattantcaataatttttataaacggtatacattctgtaattaattccatttttaaatgaattgatgaatttttttgaaaattgaccacaacatcagtgaacaatttatagcaaaaatttgtccctgaacgtctgaaagccacatttcatttaaaacataaatatgcgcatttttaaataatggacacaaaataattgagttgaaaactgatcacaaattgccattgggttcataaatacgattcatacaaacgcatttccaaaacacgattgagctccagagatttattattatttttataaaaaacagatattcagtaattaattccatgttgaaatgaatgggtgaattattttaatattcaccgcaacatcagtgaactgtttatagaaaaaatttgtccttaaaagtctgaaaaccataattcatttaagccaaaactatggacatcttttaattaagagcacacaataattgaaatgaaaacaaagcacaaattgctgtgggttgcataaattatgattcagacaaattcattcccaacgagattgagcttaagtgatttatcaataatttttataaacggtatacattctgtaattaattccattttaaatgaattgatgaatttttttgaaaattgaccacaacatcagtgaacaatttatagcaaaaatttgtccctgaacgtctgaaagccacatttcatttaaaacataaatatgcgcatttttaaattatggacacaaaataattgagttgaaaactgatcacaaattgccattgggttcataaatacgattcatacaaacgcatttccaaaacacgattgagctccagagatttattattatttttataaaaaacagatattcagtaattaattccatgttgaaatgaatgggtgaactattttaatattcaccgcaacatcagtgaactgtttatagaaaaaatttgtccttgaaagtctgaaagccattattcatttaagccaaaactatggacatcttttaattaagagcacacaataattgaaatgaaaacaaagcacaaattgctttggattgcataaattatgattcagacaaattcattcccaacgagattgagcttaagtgatttatcaataatttttataaacggtatacattctgtaattaattccatt

SEQ ID NO: 42599 - DNA, 1738 bp, Heterodera glycines
  misc_feature (1563)..(1563): n is a, c, g, or t
  misc_feature (1633)..(1633): n is a, c, g, or t
tgcttatgcacatgccattattggctcttttatttcctttatgtttcattaatgctttttattcctttaattaagtccttaaaattatttgattctgaaattaaagattaattgataaattagtattttgtaattttttttgtctgtgcttttgatttgtttttcattgtaaacgcggaataaatgaaattatgtttctgttgccaataatcatcaaaaataatagtttctatttatttaattctttaaagtaccacttttcaagactttgagtatctttaataaaaaatttattctaatgggtttttcatccacgtgagagtttttaaagtttagctaattttcataataggacctgttaacgatttcgacttggcatatgatattatttcagtcttatgacttgctttataaatatttaattatcaattacaaaatatggaataagactttctttataatatatttttgcttattaaatttcatattacattcatcatttcagtttcgaaaaaataaaatttatatttcttaaataataatcatttaaataaaaatctttcttaatttcatttttttatgtttataaaattatagtttcaagtaacataataactgataaatgcataaatattattttaatttatttttctactggcgatttcttttttgttttataattttttgagattttaaaatccagggacattttttttactacagccaactttttttttgttaaatttttccgtcagagcctataggcatggatgggtccctcctttcttgttccaatttatttttgaaaaagtacgcctaaaatttagttttactgttgtattataagtattatggatgctccaattttttatattaatatttatttttcatcctcatttaatgcttgttgacttattcattttgggaggaataactatttataaattatcgttcggattagtcattttaaatttaaatttattttttatttttactatttttattttgtcaaataaaaaattcgtctattggatgactgcgtaattattaaaaggaattaaactttcgataagatttaaatctgttctttcaacgatataccttttttgttgtaaaatgtttaatccaaagtagaccattttattcattttataaaaagttattatgttttaatatttttattaatttcaattcatatccaaaaaggcagagaaattttttaataattttctaaaataataaaaaaaattattttttcattttaataaataaggaaattgccaattttaacattagtcacatttattttaacaaaaaaatattaaagactatcatttttaataaaatttttaataaagtttaattttgtttattttttatttgattttaaatgaacaaataaaaatacgttcaccatggaccatcattttattttatcttatttttgatttttcagttttttctactgaggaactgcttaaaacgatataaatatctcctagtagtattgttctaagtttgcaaaattattgaacttctacacattctaattattttcattgngtccaaaaattacagataattaggtgacgtataaattagaaaaatgccaaaatactgctttgcatacaanaaaggcacatatgcaaaagtgttttaagcgtatgtttttttcgtcataatttttttttcagatggttaaattttttaattttttgcaggaaataaaatgcataag

SEQ ID NO: 42600 - DNA, 1344 bp, Heterodera glycines
tctctctctctcccgctctctctctctctccctctctttctccctgtctctatttctctctctctctcccgctctctctctctccctctctttctccctgtctctatttctctctctctctccctcttcccctattctctttctcccttttttcctccttttcctttcatttcctttttctcaaaatagacgacgccctttaaacctttttgcgcctctctttcccatatttctctatttttttttgcctttttctcttttttatctctgttttcctccctttcctcttttgcctcctttctttttttccccatttaaatgcttttttgctcttacatttttctttttttctctttcctttttgcccttttctctcctcattttccccatatgtccgtccgtccgatcgttccaacgaatggaaatgatgaccaaatgcgcaaaaaagcaaaaaccaaaatgaatgaatgaatggccgatgaccaaaatgaacattttgtgtgaatgcatccaatggttttttacacttgaacaaacgaaaatcattttgaaaataatatatataataattttaaaaaataataattatttatttttgtgagttgttggttgggtggggctggttccccccccccccccccccatctacagatatcaatcgtccgattattgccaatgtcttttttttaaatatatttttatatattaatgcaaaatttagtggtgaaaccccaaagattatcgaaaggtttgcaaaaaaatgaatgaaatggaaggaaataaaatgggaaaaatgcataaaaatgattctatagttgttaaaaacaatcaaacaaaaaaaagtagtaaaatatgaattattttacattgaatcagaggacaccttcggaagtcattgaatttgaatgaatttgaaaggaaattaaaaaacgaaggcaaagaagagagaatgttttcgtgtcgaaagaaaattcaaaaggaaggcgattggactgacgtgtcccctccccccccgggcccatttgctcgtccgcccctttctttttgctgcgtgcgcaatcgcaattacgacggatttcgaagaccctcggcggaaggcaacaaacgcagctttaaatgggccaatttaacatcaaaatttgctataaaattgaggaaaacgcgtgggaatggaaaacccaaagtacgaatgggttacggtagaagagacagacaaattaagacgacagagaagggaaaggcaggggaatacggtagatcgaatgctaatttgtaaaagaggagaatgataaaagaagaggaaagctatggtgatctattttagtaggataggaagggtagaag

SEQ ID NO: 42601 - DNA, 835 bp, Heterodera glycines
aaatttcaaaaaacttaaaaattcatagaaaattaaattcataggtactactgctaaatcaacgcagagacgcttttccttgacctttttaggcccctgctggtgcgcttctgatcactactcgaaaaatgagtgattgaattttcactaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcattaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaa

SEQ ID NO: 42602 - DNA, 1047 bp, Heterodera glycines
cgcgcatgcactagcacgaaagtcctttgcgcgaagcgctcatgtcagcgcccgcccatatataccaaaagtatactgtctacaccgtgcaattactgtgcaaagcatactgcccacaacatcccccactgtgcaacacgctagtttatatataactaaagaaacaaggcaactcatttccaaaaacaaaatctccttacggtttgcaggaaggggttcgaaatttcgaccttgggggtaacttttgacggcgcattcaggaaaactatagattttccgatccgagggccagctgagcgccaggcgccgaaaagtcacttttttcgaagcagtttttgcagtttttgggattcaaaaattttttaaaggcctaaattaaaaatcggcctcgataggattttaagttggacttttttggattttttttgtttcttgaccgaaccccaaggtcttgtcagtttttccgaaaaactggctaaaaattgcatacttttttgggccatttcagcgccggctgaataactcgccggggtttgaccggaggaggtcggtgtaagcggcttttttgtacagcttgacgagctctatccaaccatgcttttagatttcagaaattttcagaaattttcgagctaggccccctcgaaaattttccgtttttgaattttatgattttttacagatttttccggggaaaacggagaccactttcaagcaaccgtttttcatgctctatcgattggtgtcattttcagaaaaatttttaaaattttttttggaaatagaaaatttttggttgctaggcctcaatttcagttctggcgcaataactcgtcaggagttgattttatcaaaaaatcgtctaagagcttttaggtagagaattttaagcccaatctaatgtgctttatcccagaattttatcttgaatttaaaaaaagttataaaattaattgtgattttgaaactcaaaaccaaagggggaccccaagggttttgatttcatgaaaaatttttttgccccaaaattaaccaaaagggattttt

SEQ ID NO: 42603 - DNA, 1113 bp, Heterodera glycines
  misc_feature (51)..(51): n is a, c, g, or t
actcagggttaagctaatttcattaatttcttccctcaattgggtgtgttntcctgtttactaatgatggtgatgattaataattaccgtatccaatcactaattatgccttaattgactgcgggatactgtatctttctggaggatgcggattcagattaagaattgattgaagtatttgtatggtcattaattaagttccattaaaataaagacaataattaattgattattataacacggacattaacgaacacaaaacacggcacaaaaatgaacaaattattaattaattaattaactaattatttatttaagatttttcttccgcccaccaatgctgaatggctcctcatagtcgtcgtcgtcctcgccgtacgaaacaccgccgccgtatttggtcgggtacaagccgtccaggcacgactcggggtcggactggaaggacaccacggacggactggtgccggaccgtaacggcacctgtgccagaattgggaatgcgaatttaaaattttcaatacatgccaaaaaaaacaattttactaaaaaaaaatgaaaggactaattaatatgatgccaataaattttaattgctttatgtacatgcatgaaataatttatggacttttttaattttcaacaaatatgggaaaattttaacattgctcttactaaataaatgtaaatcaggatgccacggagtatccttatttttaaagatttgtccttattttagagtgttggaccaaataattgaaaatttttacaattgaaacaaatttgtatcgaattcgacatgtaaaaatagccaaaaaatcattaattgctgaaattatataattatttacattcatggaattaataaaaagtattaattgtttttttttaaaaaaaaaaaggatttttgccttcagtaaatcctcgtcaatttgatgcggataaacaggacttattggtcgatcaaacagtaacgaagtgttgggcgatgttggtggcattatttccaattttggtcgacctaaattgtgaaagatttttaggaaaaataaaaattattataaaataaaattacttttagtagataacaatttaaaagagaaaaaatataaa

SEQ ID NO: 42604 - DNA, 762 bp, Heterodera glycines
cttactatcctatggaaaaaattattttgagttttggccgtgtggcgctttactcgtaaaagtaaaggcctcctgggcctttctgagaaaaagcatcgaggctggtgaatcctttaattattttaaaaggtgttgttaaatcattgatttttcttctttcttccaatttgtgtaaatcagtgattttaagtctttccatatattttttgtacacaaatccacatttcgaaaagcttttcttgtgaaaaatttttgtacccgctcaattttgtctatatctttttttaaattagggttccaaacttcggtagcgtattctaattgaggtcgtacaaaagttttataggctgctgttagagtttttatttccctgcttttcaacactctcaaaatctgaaagcttctaagatatgcgtttcgtataattttgcttatgtgttctgaaaaattcagtttcgagtcaattataattcccaagtcacgaacattatccgactcagaaatcttttttgagttaataaaatattcttttttcatattatttttccctaaatataaaacaaaacatttttcagttgaaatttctaacccatttatttttgaccatttttccaaagcctcaattgctttatccaactgattcgaatggtcatcattttcgtgggcataatataatttaacatcatcggcatacatttttatgccaactgatgccgcttcatttgtaataacggacggcagatcatttataaaaattaaaaa

SEQ ID NO: 42605 - DNA, 960 bp, Heterodera glycines
atatgtgatggaaacgcaacaaagtaaaattataatctttttttttcagttattagcgcctgttttctagatttttattttgaagcctaaaaactttaaaaaaaattttgaaaactagtttttgtctattttggcgtttttaaagtttatttaaaaatgcaataaaaataattcacccttgaaaatcgaccccaaaaaattcttctgcaaaattaagtgaaaaatcctcaaaaattattttttagatttaattcttaaatatgagtagtcagcaacaacagttggatgtgcttattgtcatagatggtaccaacattgataagccttgtgtattttttgatcttttcaaatttcaacatttaacttatttaatttaaaggttgatattttttcgagttctggctttgttgcttcttgtctcaattgggtttcaaagcttcattctcctaatgtaattgttgcgttacccaatcaaccgaatgatgtagcagccgaacttttaaagtcggtttatataaatgaaataaaaaatgtttcaataacttacagaaaatgggcttctaaattcaagcagcttcaggtactacttttattttaaatttattaaatgttctaaatgaacttaattttgcaggcatttggtgtttcaaattgccaatctttaaacgatgttcttcgtgaagttgattttcgacaaattcttagaaatgatttcatgctcatacaaaatttagccactttttgtttttcctatctgacgcgacaaatcgaaaaatttcggttatttctgaattaaatattcaaattttcatggtctaaatttaagaaacgataggcggcaaaacaacaaaaatgtgctcacattgctttattactcaaaacgaaattatggaaggaaattcgaggaagatcggtctctgattggatacattgaacaaactcaaaaattaacacattatg

SEQ ID NO: 42606 - DNA, 87 bp, Heterodera glycines
acgcgggtattgtgggtcggccacggcaacagccgcgaggcggtccgcccgttctttgaattgctcggcaagcactgccattagata

SEQ ID NO: 42607 - DNA, 1579 bp, Heterodera glycines
agtgctggttcgtttcatcacggcaccgaaccttttgccttctgaggaatcgttgcttaacttgccagatcggacgggtgcttatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaataaatcgattttttcaagtgtccgtttggggtactcaaacaattatggggagcaaaaatccaacgcagaatttaagtacaggctatagtgaagctattccggaaggattcggtctccccataatctgggcgcatcggttcagggggactgcccccgaaaaccccaaaaaaaaattttttggataaaaataatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaactctcttccttaataattttcatgcaccgaggtactcactcggccgcttcgcggcctcgtggtgggccttcgcccccccctccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaagaaagtaaaaatttttaaaaatttattcatctccctttttgata

SEQ ID NO: 42608 - DNA, 1432 bp, Heterodera glycines
  misc_feature (44)..(44): n is a, c, g, or t
attaagcaagccattgctaattattgtttgccagtttttctacncctctttgttttgtgccgcctcctccgccctccaattcgcaaaaccgttgctccatcggcacttccgtctcgccaatccgtcactgatcgccctgcatttggttggtttggtcggcaacagaacggcattattttgccgttcctttaacatttcctccaatttcagttttggttgctcaaccacgcgtgcaacccgagtaatttttaacaatcgcttcaattagcctttaattagccccgcctctcccttgtgtaagaagcagcaagaactttcgcatagcattcgtgttttgccaattctggattcagaatttggccctgaatgctttttcctttcctcgccccgttctacagtatacttcatacagttcgtccccttttccacagtaatctacgcctatttcaatgaacgcatgcgttcctcgtacattgaaatgttttcatgcgcctttctccgttcctcactccgacgacgcaaacgccgctactttgacaatccgttgggcatgtcatgggccacgcgactgtgcgccttcgccggactgccaatggcacggtattaccgtaccgaaaaggggcggcaataccgtagcaagagtctgcagacaattaaggatttaatggacccattttgcagcccgccccttaattcgcgtgccattccttcccactccacagaattggtcgttcggctaagcgtcggccgcactcccgcgccggcggttcctccgcagaaaaatccaacggaaattttgtgcgctcatcactgcagttgcagtcacgcgacttcgaacagtacacaaaaaaaagagaatagggggggaaggacaatggaaaaaaagtatgagggaagaatcaattctcgagccttagaaatgagctcgagattctcgaatttgccgacaaaaggcaaagggacggaaggacatctcttgaaaagggccaagaagaaaaattggcaattaagttagcatttaactcaatgctttcactcaatgctttcatgctttcccacacacagactctgtgagttcatgatgcgcgtcagtccgctgaatgattcgtcggagggatggcgcgagtccgtctcgcgctccgcctccgcgtcttcgtcctccggcgaagaggagggcttttggcccggaaggaaggttcgatcggaggtcagtgatcagtgcagggagacaatcgaaacatttcgccaatattttttttgaaacgcccgctaaattcagggcggtcttttgagtgcggtggaggccgtccgccgtttgtccaacaattccatttccatcgcgcaacagtcaatccgagagccgtcccgttccatcgttttgctgaacatggaccgaacattcgagaaacggtacagcaacaaaggcagcatt

SEQ ID NO: 42609 - DNA, 1507 bp, Heterodera glycines
cggggatgacgtggcggtggtaaaaggtgtccggggcttccttgcccgaatttgtgacccttctcgaaaataaagagaccttctcaaaaccgaaacgatcggaaagtgatgtcgtcgaagtgaacgtccaatcggtgaaagttgcgccgggttcgtctcacaattcgtcaatctttggtccttactttgtcaaatggcagggaaatggcgtgtggttgtcaaacatgtccccgacaataaattggtattggtgcgcatcgccacgggtctccaaattcgcaccgcggttattgcctcgaggaattgcgcacagcaaacgccggagggacaattcgacggttggaaaggctaacaaaagcgaagcgggaaaaacattaccggacgaattttggattataaccttatttttttctcaaccaaatcaaaattgaaaaactaattatttttgaaacataacgaatattatggtccaaaaaagtcttccggcaatgttttgtgtgctcccatcaaaaatcggaaatggtctttgcttatttaagacggatcaaacttcaagaacacgaagatccgacctgggctgaatgtgtttgacgagaagggcaatgaggtgggggagaagttgacgacccacggcatttccctttctttccgccttcctttgccatttttgcttttctcccttttctgtttccatccgatcataatttggcttgtgccgagtccggttgctcctctctctatctctcctcttttttctcgtctctctctctctctctctctctctctctctctctcttctctcctcttttttcttttttcttcccctctctctgtttattttgtctctccccactgatcagcttgactgggactacgaacacgacacgcgttttttcgaagagggcgactgggcaaccgacaaaatgcccgtggtggacgcaaaggaaagcggcaccgctcaaacgaaggacgcagcggagcaggcgaaagccatcgaagcgcacgtcaaagggatgaaaattcgatcacgcggacgcggtgccaaaaagtttctgcaggctttggcaagtgacgacgacgaatgatcagccgaagagtcgacggatcgaacggaatttgttgaatttaactgaaccatttatcagaggacaaacattttcggattttaatgttcgcccattcacacgcattggacaatattaattcattttgcaaattattttatttttcattttggtctcatcgtatttaaaagtttcttcaattaaaaatattttttaaaacggaaaaaataaatgtgcaaattgaaaaatgaattttcatttttatttatctgttggtcttttgcttggttagttagcgatgcttttttcatcgttttcatttctccatatttttcaatggttttgcgaccattccctccattcattcattcgtcatgtgatcgtcggttgggccaaacgttcacaacaccggtgaaaaatgagcaacgctcggcggtgggggg

SEQ ID NO: 42610 - DNA, 1291 bp, Heterodera glycines
tccaacacccacatgtttgtagttttcactgaacactgttccttccgtcctcaatgccatggttttgctggcacgtcattcgttcaatatccccggtcatcggagtgatccgatcgaccattccgttcgggaatgccacatctttcgttaatccaatcggccaattcctttgaaatttcaaattttctttaaaatattttaaaattatttacctgttgtcccagtgcccgtgccatgccaacacacgcatttcgtgccatttcaccatttttggttatgttgtcacatgacagcacagtgaatggatcggggccgtttgcacgccgacggctcagcgcggggacaatcagtccgaacacagggcgaggattggctatgaaaattaattaaaattattcttgtttttaaaaaaatagatattaaaatgataacatatttaatagtattttcgatattatttttaaaagaaacattataaaatttttaagtttcttatatatcttttatattttctatttaattttcatcaatgttcatgcattaagttttgaaaattatgataaataatggaatatttagttcattttttcttttttcctgaaaatgacgtcaaatgaaatataaagaaatgcaatggctaatttgaagaattttgtgtttcattatgctgacaaaatcacgtaaattcaaaaaacatttaagcgctaaaaaaaaattgcaaaatttctaaaaaatacgtgaaattcaggttaatggatccaattaaaaacataataatggcaaaataaattaaagccaatttacccggatcttttgagtcagcaacaattgccggatgggttgggtcaaattcgccagtggccgagttgatgaaatagccgccctccgtcacggtcatcgacacaattcgtattgccggatcagaaagttgggccacaatcgcttcggcattgtcaatcggcaggaagtcaatcattgcgtcagtgatcttataatttttaatattcaagaacattgttatcaattaaatcatgttacagtacgtggcccgtatttctgtagttgtcttgtccgagcgctagtagtcagaaagtcttgtccgctcaccccctccatatttttttggtttgtgtattttaaggtgataatcgtttatgtgacagttgaaatcggtttttgatctaaatcacaattatgggcattttgctaaatgaagcttccttctgaaataaatgaaataaatccctcctatgaggagggataaaaaaatagttctcccgatttttgtcaa

SEQ ID NO: 42611 - DNA, 955 bp, Heterodera glycines
ttcattttatatattaaaaattgatttaataatttttcccttatttctatattaatttataccgtcatcgtattatgatccggcgccgctggtggtggcagtgagtgaaatgatggcaaattgttgttgctgttgttgttggtgttggtgccgttggccgcagacaccggaaccatgggttgttgctgttgcggttggtgatgttgctgagtaagtgccgcaattgccaatagttgttgcaattcgcaaggtaaaaaagcgttgttattggcggcggcaccaccgatggcatcgttcggctaaacattaaataaaattaccttcccttcccttttcatccctccctcaccatgatcagtgtcggtgttgaagcagcagccggtgcgctgttcacttcgtcagcaacgcctgcggcaacagaatccgatttgggaattggggaaaattgctggagagaagcgaacggatgaaggtgttgttgttgctgttgctggagttgttgttgctggttgtgttggtgctgcatttggaggactaattcgagcggactcagctgactctgcgcgtggccatggcccgcgggggttggggcgggcgaatgaactgcttggacccggtggtggtgctgcgcaagtgtcggcatttgagcggtgggtcgagggaattggaaaagctgcaaagattaaaaggattgattatttggcataatttgttggtgattaacatttgccgaaaactgtgcagcacgtgccggtgccaccgcctcggcgttcgcgtgcagcaatggcacactgcgcgtgcccatttcggttggcgagttggagtgactgcacgcgccgccctcgtcgctcatgatgccactgtcggaactgaatttatattcgtattttaagcattttgtggctgacaatgaataagaggcctcctcacctaacactttggcggcccttcagcc

SEQ ID NO: 42612 - DNA, 1040 bp, Heterodera glycines
  misc_feature (57)..(57): n is a, c, g, or t
  misc_feature (72)..(72): n is a, c, g, or t
  misc_feature (1015)..(1015): n is a, c, g, or t
  misc_feature (1029)..(1029): n is a, c, g, or t
tttcccctttgatcggtacaaaatggcccgaaaaagagatagccatcctctgaggcncgaaggaaaaattgnagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattgaccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacatttgggcttgaattaagccattttccctttgatcggtacaaaattggccgaaaaagagatagccattttctgagccccgaaggaaaatttgagagggctaatttatatgtaatattcgaaagtgccaagctaattagcgattcaggcgcacattggggctttaattaagccattttccctttgatcggtactaaattggccgaaaaagagatagccattttctgaggcccgaaggaaaatttgagagggctaatttatatgtaatattcgaaangtgcctaagctaanttagcgattca

SEQ ID NO: 42613 - DNA, 989 bp, Heterodera glycines
aaacatgtcaaaaatgaattctcacccagaacaaggtatttatacaattctgatagtatgatcttttgtacctttctatgacatattttcgactggtgcttttaagtaattttttattcggtaaattataatgtttttgttaaataggtatttatttttaatttctgaggactttgaatttaattgctatttgaatttatgatttcaaataacaatctaaccgtttttgaagctaattttatttttgcatatttaatttaaggaattactattttttgtttcttctaaataacactaattatggcattggtttttaaatggactgaaataaattaaaaggcaaaaataaagtaattgcttttttacctttaaatttttacaaataaatgaaaacaattttaaggaataaaggaaaaacatgaagcaaatagcttaagaaaatttaaatgcgaaattttattttaaaacatttcaaaaaagcaaatgaaaggcgtaataaaaattattttaaaattaaacaaaaaattgaagtgtgtaaaatttaaatataaaaaggttttcagaaagtgttgttaacacatgtaatcttgtttaaagaattaatcaataaatgtttgttttgcttaatatatttatttattgaatttttactcaaaatataatcatctttgcatacttttgtttaagtaaatttccaatatgctttttcgtatttttttaaaatcatgttctgtcgtccaaacttttccttgagagatatttcctttattctaatctctttttaaatgttcaatgaatttattaataaatgcttcacaattttttgttaaatatttttaaatttgtgaatttcgcctctgctcaatatttttgtttattagaataatgaatattaattagacagtaaaagttccgtcaaataaataaacaaattcaattacatgattttttactttttgagttattttgagattttttaatcttttata

SEQ ID NO: 42614 - DNA, 941 bp, Heterodera glycines
taatcattttattgtttcagcttcatctctgctgactgttggcttaaggtgttcgatttgcttccgccctctcaacttggccttggcattgcgttgatcagtcgccgctttgactattacgtcgacgaacactttaaaactcgcaaatggacattggacaaaatggaaattcgaggcaaaattggagagaatggcacagaggaaatggaaattgtcaattccgatggaaaagaattgccaacccctcattatccgttgccgaacaaagtcatcggattcaaactcattttgatcaagtgaaggatttgaaaatgatttgtgcccatcaatctactttttttgattttcagcttcatcgaccaaaatgtgctcacttttcctggccattttcaccgttttttcgcgacatccacaacaaaattgttcattcgcactgaaaatattcaaattttggagtttcttatgcgcaacatttggccaatgttcaaggccacaattcgtctgatatattttcactccatcgcttttggtcaaatccggcaatttgccccgttaatgcttaacgattgtccgtcccttcatgttgtcgatttcgatggtggcattttgcccgaatttccgcctgatgacagtgccaatgcgtcggatggccaagcggtggccaaatggctgttcacgcctcgtcccgacaatttgacgaaggtgctctctgtcaaaattacatttgttgaacaattgttggcaacagtggaacacatcaaagcggtgattaattaatattttcaatttaattcattttttctatttttgtcttattttaggcatttttcaatgcttcttcgcctgtttctttcgtcatattcattgactttccgtcgtcctcttcgttttcttcgcttatgccatttcaattgaccaatgaattcaccggggagaaattg

SEQ ID NO: 42615 - DNA, 1200 bp, Heterodera glycines
  misc_feature (54)..(54): n is a, c, g, or t
  misc_feature (113)..(113): n is a, c, g, or t
atggttagatatattaaataaaacaagatttatttaaatatttttcttcaattnttgtgtaaaaaattcctacatcccataaaaattgaaaaaaaattaatgataaataaatntaaaaataaattaaacaatttattatacaacatttaatttgaagattaaccagatcaaaaattaaataattattcagtaaaaggctgaaattccgaaaccccgggaaatgccataaataaaaataatgcatttatgaaatattaacgaaaaatgttaagcaaacaaccgatgtaaagaaacttaaatttaaaaacaaagaaattgttcgtaatttgaagtttttaaaagataatatttaaaaatcaataaaattaatactagattttaatagacgaaaatattgataatttaattgtataaaataactaaaaaaatctcattcaaaaaaaaatttaatttacataaatgaatttaaattaaaattagtcttcaaaattttgaaaaaaaataaatatacaaaattatttataaaaccaacttgagaaaattaacaaaaaaaatttttaaacataggaataaagaaaattactattcttcatcttaaattgaataaaacatttaaaattaccgaattaatgttatataaattaaaaactatttaaataaacataattttaattatacgtaattaaataaacccagataatgtgtttcaatatgaggttgagcagatcattgcttaaaggaaaatcaatggcaagaaccaattcatagtaaaatattatttgataaatttaaattatttttctttttggtgttttataaaataaaaatttaattaataaataaaaatattctggaaaggattctcgtatagcgaagacacgtggaaaccggaaaacatttggaaagaaacaaaatgcttttggaggagttcaaaaaatgaaagtaaaaaaacagtgaaataagataaaataatttatttaaaaaaacccaaacatcttccaatgctacaaaaatggtaataggaaaaaaaaccaataatgagaaaataaataataattattaattaaaaaaaatacatttctaaataagttacaaacaaaagtcaacaaagatcagcccaaaaatggattaatagttaatattaaaaacatattaataaaaataataagtaaaaaataaaataagataaagcgaaaaaat

SEQ ID NO: 42616 - DNA, 877 bp, Heterodera glycines
cgcgtaattaccgaccacaaagcgctaatttggatgtctcaccgcggaaccgaaacgggaatgcgcgaattgaccgctgcctattagaattgaattcaagattcattcttaaagttgaatatcagcccggcaaaaagaacataattgctgatgttttgtcacgatcgggaactggcaacgaaattgaagaaggcgaacaaaattccgaagaaatcgcattcatcggtaaaattcggacaacagaaaatgatttggagaattttggtttgatggaagaaagacaagaatgggtcgaacagaccaaaattggcgaaatgaagccaatttacgagtttcttgaacgtaaagttttgccaaatgaccaaagagatcagcaaagagtcattggtaaatgccataaatttgtcgtcttcaaagaccttttgtacctttccgagaaggaaggcaaaatgagactttttgtcccacaaaaattcagaaatgagttggtgaaaaatcgccatgaaggaatttgtgcaggacatatgagtggataacaagaaaaaggtatgagaaacggaggttactttttaatcaatttttttggctcatatttttatttagataataattttttatttgatttactattgtgattagaaaaccttctgaaataattttttatttgatttactattgtgattagaaaaccttctgaatacacgaaaaatttaaattaatgttttgacgatttgtttttatttattattttatcaaaaaatttatattagatttataatcataaaaaaggtaataaaatatttaaagttgggtctcaaaagaccgaaataatcagtaaaaaagaaaataaatatttaacaaattacataagaataaa

SEQ ID NO: 42617 - DNA, 935 bp, Heterodera glycines
  misc_feature (69)..(69): n is a, c, g, or t
  misc_feature (79)..(79): n is a, c, g, or t
  misc_feature (105)..(105): n is a, c, g, or t
ttttttttaattttcgcaaaaggacaatcttgtgttatgattttcgctctcgaacatcactaggttttngccgttttanaattaaaattttgaaaggacatggcncaaacttcgtcagagagtgcaggcggctcaacaccatcacaggagcagcgataaccaaatatcacacgttccatgatgaagtcctgtactaccggcggtacatctggcggtgcaatggtccatgccgtgagcgtggaccgacctatgggtggatccgccgttttcgcttagaagccccaggcatgaaatactttgaaatttaattattttaaaaatattaaggcaaaaaagaattaaaatatttcagtaataaaattttcaaataaaaaagatataagaaaattaggctaaaaattatatgcattaaaatgctaaattgcgcataaaatatatatataaatccctcaaatatgccttactgtcaaaaaatgccaacaattgtgtaaaatatataattgaattatacacattaaattactttttaaaaaaccaattcaaattataaatatatatcgtccaccgaattgtaaaatgatcctatgtcaaatatgctgattgagtttatgaaccaaaaacaattgaaacagcatgttaaagaaccgaccagagaaaatacgattttagacttagtaatgactagtgaatcagaattaattaatgaattaattgtattggaacatttttcaacttccgatcataaaatggccggatttaaaataaaagaaaaattccgtcgtaataatcccggtgtttatagaagagattttaaaaatattaatttttcgaaattaagtcaggcgatacttgaaaatcgtattgatttatcaataaactcagtgtacaccgttgatcaaaaatataaagaattcttaaataaagtactgaagtta

SEQ ID NO: 42618 - DNA, 1081 bp, Heterodera glycines
aaatttaattgataaattctttcgttctaattctccctcatttatatgtaattgaagacaatacaatacatatatgtacctcgtaaaataaattaataacagaaattataaactggaagaaaacaatttccatttttgccatttttaggagtttgtgccgaaaattgtgaccgaacaaaacgccaaggcgcggagaaccaatgggccggcattgcagggacaatcagcgaacggagcgcaaaattggaagcggaactaagccaaataaaagaacgattatcaaagcttgaaaaagcggaggaaattccaaatgagtgatgctaatgaatgataatgatggcacttatactcataatggaattgaatattcatttgatcacaaaaagacaatcgtttacataatttgattggagtctccaattattttttgttccgacttacagagttacgtaccggaaaaatttcttaggggctggataaattcttcgtggaagtcgaaaagagggacagaaagcggagcggctcgttccccccccgagaaatttttttttaaatttgctaacagaactttttcaagaaaaaaaatcttagaaagttttttcataagaaacttctaagaaaaaaaattttcgaaaatttttccaaaaaatcgctgagaatttctcgaaaacgacaatcttttgaatgaccggaatttgatgactcgttccgacttccgaaaagtttgaggactcagaatgccatccctgcgctataaacttaaaataaacattcatcccgttcatgcattttattgagtggactataaacgacctaatattattatcagagagaataaattgcaaattgcatcatctaaaggcataattaggtaatttattttgaaaacacatcaaaataaaatgattgattccttcgttcgtttgtccattttcaataggtcgtcctaattcccgtcgcctgagcatgggcaaagagcagctcaaccagcagccgcacttccaagtgcgctttggcgtcgttgagccaatcgctgaaaatccgagccgactcgcctctgaaaatgaggagggtttttaaa

SEQ ID NO: 42619 - DNA, 381 bp, Heterodera glycines
gccaatgtcaatgttaatcccgataacatcaaccatttgctcgttggtatttctcgaaattatgaaatgcgcccgtaatttttcaatgcttgttttttttgttgttaacacattgataaatatgttatgttattaattttataattttaaacattttttcggaaaaaatcagtagaatctattttggacaaaaaacagcttgccgtactaaactgaccctcgtactaaaccgacccctcgtactaaaacggccgtactaaaacggccgtactaaaccggccgtactaaaacggccgtactaaaacggccgtactaaaacggccgtactaaaacggccgtactaaaccggccgtactaaactgacccggtccgagagatttg

SEQ ID NO: 42620 - DNA, 1207 bp, Heterodera glycines
  misc_feature (1187)..(1187): n is a, c, g, or t
tgtttgtatgtatgtatccgccttgctttgaattggcgtggcgttttgtaattgttttgtgttaaaaaatgatttgaaaaatggaaatgttttgtttttgcgttaaaaatgcatttgaaaaatggaaatgtttgtttttgatttttcaatttgttttgcaataaacattcttaaaattgtacctatttatttgctttttattgtatgttcatagtttattaagttatttgttatataaatttgttttttgtaaacgaaaaaatttatcagtatattgtttgagtttgatttagtggttgttgtttgtttgtttattttgtttttgtctttacgtgaaataagtatgcttatgcttaatgttatttgaacttttaatgaaatagaaatgcatatctttggtttgttctgtgactttagtgtgagacactaatgtgtgtcatgcttttgaaaaaacattaatggtctgttctgtgactttcgtgtgagacactaatgtgtgtcatgcttttgaaaaaacattaatggtttgttctgtgactttcgtgtgagacactaatgtgtgtcatgcttttgataaaacattagtggtttgttctgtgactttcgtgtgagacactaatgtgtgtcatgcttttgaaaaaacattagtggtttgttctgtgactttagtgtgagacactaatgtgtgtcatgcttttgaaaaaacattagtggtttgttctgtgactttcgtgtgagacactaatgtgtgtcatgcttttgaaaaaacattagtggtttgttctgtgactttagtgtgagacactaatgtgtgtcatgcttttgataaaacattagtggtttgttctgtgactttcgtgtgagacactaatgtgtgtcatgcttttgaaaaaacattagtggtttgttctgtgactttagtgtgagacactaatgtgtgtcatgcttttgaaaaaacattagtggtttgttctgtgactttagtgtgagacactaatgtgtgtcatgcttttgataaaacattagtggtttgttctgtgactttagtgtgagacactaatgtgtgtcatgcttttgaaaaaacattagtggtttgttctgtgattttagtgtgagacactaatgtgtgtcatgcttttgaaaaaacattagtggtttgttctaagagtttagtgtgagacactaantgtgtgtcatgcttttgata

SEQ ID NO: 42621 - DNA, 953 bp, Heterodera glycines
gtaagctttttccttttttcacttgtaaattatttaaattttcaattttttagcttttttcgaaaaaatttttgtcttttttcggcaggcactgcctctgacaatgttttttatttatttagaaaaataaattgatttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgtttacgaccataccacgttgaaagcacgccatcccgtccgatctggcaagttaagcaacgttgggccttcttagtacttggaacggagacgtcctgggaatcgaaggtgttgtaagctttttttccttttttcacttgtaaatttatttaaattttcaatttttttagctttttttcgaaaaattttttgtctttttttcggcaggcactgcctctgacaatgttttttatttatttagaaaaataaatttttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccataccacgttgaaagcacgccatcccgtccgtctggcaagttaagcaacgttgggccttcttagtacttggaacggagacgtcctgggaatcgaaagtgttgtaagctttttttccttttttacttgaaatttatttaaaattttcatttttttaacttttttttccaaaaatttttttgtcttttttt

SEQ ID NO: 42622 - DNA, 512 bp, Heterodera glycines
  misc_feature (24)..(24): n is a, c, g, or t
tatttgtgccttttcgtccttagncggcacagtaatggcatcacgcaaagaaagtcaaacgggcaaacaacgtcaacgatttcgctcgcaaatccacgcccaaacggacgcgcaccgccgcactttcgtttttcacgggcctcgccagcacatcgtaaccgtgggaaaggcgatcgtacagacctaaaagggcaaaccgaaaatcgacggaacgatcatttgacagcgccgcccaaatcgtttcgacttctctcgtggtcaccggcccaaacagccgctgaaaaggaggaaaatgcaaagggacggagagggggggggggggtaatataagaggggggggggggaggaaaaaccattcaaagggcaaaaagtgcaaaaaatcattaaaaggaagcataaaaggaagggcaaatgggagaacaaaagaaactacactttataaataattaattcactggtttgatcgagaagagcaaaatgaagaaactgaaaaactgaaggggggggggggg

SEQ ID NO: 42623 - DNA, 818 bp, Heterodera glycines
tttccgttaattctaacggaaagtgatcatgatgaataccgccactcatccaagtcggaattccggtgcggagacggcgtgccacgcttcgacgggaagtcccgcgaattcctcttttccggacgatagtcggcagttcgggacgacgcagaggaattcgtcggtggtctcgccagtgatcagccaccgatgaccccgttttcgtcgtcgggcggcccaaaccccccgttatcaaattgctcgaacctcgggctgatcgggggggggggggagtgactgaggtctcgaggagcggaaaaatggaggcaatgtgttttgaggggggattgtcggacatcgtcgtgatgagcacaaatggggcaaatgaatgatgaatgaaaaaatggactttttgggggggatgaatgggtatttatgcacattttggccatctccgccccgtcgtcgaagtttatgcaaaagaggggggacgcgctcatcctccattgttcattgcccgggggaagagacgttccccctggtgtttgagcccacatcgtcaacaaactgttgactatcaccaattacaaaggaaattgctggccccctttacgatagacaagcgatgggcgacgggggttagagacggatcgccagatggcccggcccaaaacacagagaagggtgaaagtggcgaaaacaaagacggcggcgcacagcgaagttaatgcaggtgtcgacgatccgtcgactccacatgcaccactcttcgttgctgtacccaaagggcaccacctggggggcgtgatccctgaccacccccttattcacggtcgggt

SEQ ID NO: 42624 - DNA, 986 bp, Heterodera glycines
  misc_feature (911)..(913): n is a, c, g, or t
  misc_feature (940)..(941): n is a, c, g, or t
gtcttaacgatgtcaaaagtaaaatttgaatacgtattcgtgatcagcggcccaaataacccctaatgccatgtttttggatggtttttaatggaaaaatttttcactcaaaaatcctggtcacacccctttggtcccgaatcccaaaatcacttttatttttataacttttttttaaaaagggataaaaatgtaaaataaaatttatataatagagcaaaaaattgcggatttttgtagtattttacttttacagaaagacttttcagaagcgagttctgaatttttttctgaaaaatcttaaatttccagaatttctggaataacttttttcatattgatgttagaaaacccaaataaatcccataaaattctcccgattttttgctatttttaaagttttatttgctcaaaattggtcaacccttaggctagatatgaatttttcaatattagcccaaaatcccgtgggccaaaaaattggaaaatattttcgaatttttaaaaaattccaaaaattttgaaacgaaaaataaacatcatattcgtgctcagcacatcaaaataccccagaaaaatatttttgacccccattttcaacccaaaaaaaatttccgaaaatttctagggggcctagctcgaaaatttttgaaaatttccggccatatggcacaccattcgatagcatttaaaaagctctacaaaaatgttctaagacaatttttcgctaaaatcaacccctgacgagttatggacccgggactcaaatgtcccgctcaggccaaattttttttctatttccgggaaaaaatcgaaatttttccgaaaaaaataccagtcgatagaactcgaaaaatgatgttttggaagtggtctccgtttttcccagaaaaatcgttaaaaattcctannnatcaaaaacccgaaaaccgttttttanngctaactcgaaaaattttgaatttttcaaaatttaaaactggaaa

SEQ ID NO: 42625 - DNA, 1464 bp, Heterodera glycines
  misc_feature (309)..(309): n is a, c, g, or t
  misc_feature (316)..(316): n is a, c, g, or t
  misc_feature (334)..(334): n is a, c, g, or t
  misc_feature (345)..(346): n is a, c, g, or t
  misc_feature (361)..(361): n is a, c, g, or t
  misc_feature (387)..(387): n is a, c, g, or t
  misc_feature (391)..(391): n is a, c, g, or t
  misc_feature (400)..(400): n is a, c, g, or t
  misc_feature (413)..(413): n is a, c, g, or t
  misc_feature (416)..(417): n is a, c, g, or t
  misc_feature (441)..(441): n is a, c, g, or t
  misc_feature (444)..(444): n is a, c, g, or t
  misc_feature (446)..(446): n is a, c, g, or t
  misc_feature (448)..(449): n is a, c, g, or t
  misc_feature (458)..(458): n is a, c, g, or t
  misc_feature (471)..(471): n is a, c, g, or t
  misc_feature (515)..(515): n is a, c, g, or t
  misc_feature (532)..(532): n is a, c, g, or t
  misc_feature (538)..(538): n is a, c, g, or t
  misc_feature (544)..(544): n is a, c, g, or t
  misc_feature (547)..(548): n is a, c, g, or t
  misc_feature (587)..(587): n is a, c, g, or t
  misc_feature (592)..(594): n is a, c, g, or t
  misc_feature (614)..(614): n is a, c, g, or t
  misc_feature (621)..(622): n is a, c, g, or t
  misc_feature (631)..(631): n is a, c, g, or t
  misc_feature (651)..(651): n is a, c, g, or t
  misc_feature (656)..(656): n is a, c, g, or t
aaaaaaattccaaaccttttaaaattttataaaaaatttaaaaaagagaatttctgggaggattttctggaaataaactttattaggccttagttaagctgtaaaaaaaattttggggggatttgaaagaaattaaaaaaacccgggttcgagaaagttttgttaaccaaaaaaaaatccaaacatttaaaaaatttataaaaaatttaaaaatgagaatttattggagattttttggaaataaggttaattggggttagttaagttgtaaaaaaaatttggggggatttgaaagagaatagaaagaantaggttngatgaagttttggtaagnaaaaaaaaatnnaaacatttaaaaatntataaaaaatttaaaaatgagaattnatgngagattttntggaaataagatngtnnataaataatttgtaattgataagnggntnannaaattttgnagagatatgtatnggagcagtagaaatggttagtaatttttatagattttttaaagnagatgaaaaagttaagnttaaantttttnggnntgtttaaaaaggaattagaaatttttaaaatatttattnatttnnntttttgataatataagagtnagagtgnnttattgaanttgtaaataaattttggtgngtttnagagcagtttgtgaaaaaaatttatgaattaattttgaaagagaatagaaagaaccaggttcgatgaagctttggtaagccaaaaaaaataaatatttaaaaatctataaataatttaaaaatgagaattcatgcgagattttctggaaataagcttaatagggcctagttaagctgtaaaaaaaatttggggcgatttgaaagagaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaatagggcctagttaagctgtaaaaaaaatttggggcgatttgaaaaagaatagaaagaaccaagttcgatgaagttttgttaagccaaaaaaaatccaaacatttaaaaatctataaaaaatttaaaaatg

SEQ ID NO: 42626 - DNA, 880 bp, Heterodera glycines
taagaaaattagtaagcatttgtagtgttccgatacctttccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattgtggtgattttggtggatggcgaagtgtaaaacgttaatccgcggtgggactcgaacccacgacccttcctttccgtggaatgctctaaccaactgagctacacggacacattctacactcctctcaattccatagataaggaagagagagactcattcccaacatgagggatttgagccgcatcacatccccggcctctgagaagaccggtccccgggctcttttatatgctgtcggccgccagcacgtaagagtggagagagtgttagaataagatcaacatctaacacacggacgtgaatccacccaggagcgccatgtggtgattttggtggatggcgaagtgtaaaacgttaatccgcggtgggactcgaacccacgacccttcccactgtggaatgctctaaccaactgagctacacggacacattctacactcctctcaattccatagataaggaagagagagactcattcccaacatgagggatttgagccgcatcacaa

SEQ ID NO: 42627 - DNA, 1028 bp, Heterodera glycines
  misc_feature (929)..(929): n is a, c, g, or t
  misc_feature (941)..(941): n is a, c, g, or t
aaaaattaggttctctcaaaaattgatgcattttttgctcattgttcgcaactaattgcatcaaaaatttagaaaatttaaatagggtacctacctgcattcggaccattttttgcatcggtgtcagcccagcatttgggtcgttctgttgcttgccatgcattcgcttctccgccgcagccgcaatcaattcagcatcagagcgacgctaatagaaaaattttttttttggctttgccgtaaatgggaatttttatttcggcccatcgccaagagtattatgtcattaattaaaaaccattataatgggcgctctaaaaacaaacttttaatccttggaatcattcggtagtactaagtattctctattaggctgcaaaatttcaaaaaaattttttttgttaactttcgaaaaagtattgccaaaaatatttggaaaacaagagttttttgagttcttttgtcaccttttttgaaacttaatttcaattttacattctgatagagatcacttttggctatcgactgatacgttgaaattaaaattttgcttgttttggagcagttatgaataattttttgccaaattttcatatcggtggtttttaaacaacgccttttattgcggttttttttttaattctgcaccatcgccaaatccccctctccctccaactcgtttcaaaaattcgtcttttgaaaaaaacagttaacccatgtcaacctgctgagcggctggcgacggtgaccgtgtgctgctcgtggtacgtcccgccgcttgttccgttcgctgttgttgcgctgggccgcccagctggcgaccaccgcccaacttcttgaatttgttgtccaacttcttcttcttgaccaagtctttgagtttttgcattatttatttggcctgaaaaagaaaaattgcgcacaatttnttgtggaaaatngtgtaacaaaaagcctaaatcctgtggtaaattgctccagaaatctgcccccgtccgaccgagtctctcaatcaaaagatttttgaa

SEQ ID NO: 42628 - DNA, 980 bp, Heterodera glycines
  misc_feature (954)..(954): n is a, c, g, or t
attcagatcggcacaattctgttattttttaacaaatttctccccccatgccagctctaactgaacgacaaaaagcgcaacttcgaagacgctggtacgagaaaaggcaaacatggaaagaggcgaacgaacggggcgacttaccaaagcccgcaccaccctgcatgaactgggtcatctttggttcttgcggaagctgatggaatgcatagacacatttataaaggtttctttttttaaatgggaaggaaaaaaaattttttttgagagtaccaaaaccataaactgtctgaaaaatttttttcaaaattaaacgcgattttttgaaaaattctcgaaggcctcggctccgcctgggaatgccattggcgccataaattggggtttcaaaaaaagtggatttattttttgaggattaattattataattaaacagattaccattgtaaaagacgctgatggaaatgagggctcggtgcaatacaccgaagcgcccagctacacacgcagacaactcaaagccaaatcctcatgtgcatcggtggcaagacggcggaattggttttcttctcgaaatgcgtgggcgatggcacggacagagatgactggaagcgattggccgcgaaggtttatcactgaattagaattttttgctgaaattttccttaaaaatgcatgcattttttcgaaattgaaaaaatcaccattttttggtgaatctgttaaattttgctactccccccccccctcttcaccggcgactcccccctcttttaaaccggccccctacgacgaacgaggagggagggggcgggggtgggcaggagcacctcgtctctcgtgctacagccggatccctcccttaaacaaaaaaatttgaacgcaaaaaacaaaaattttttattcagctagccgatacgagccccagatgggcacgaatgcgccgaacgccgnaaattacgagctgctccgaaaggcta

SEQ ID NO: 42629 - DNA, 1438 bp, Heterodera glycines
  misc_feature (35)..(35): n is a, c, g, or t
  misc_feature (90)..(90): n is a, c, g, or t
  misc_feature (113)..(113): n is a, c, g, or t
cgatcatatcttttttaaaattaacattttttacntattttttaatttttgataattcttaaagtttctggattattaaaagtgaaattntgctaaaaaaataaaataaaatnttctgcaggcaaatggaggtccgaattttctggcaaagtgttttggcccagtattccaacaatgacttttggcgaagagcttattgttgcggaagcaccgctcgcgcgaacatcgggcgttcaatttttaaactggaggtgggaaaaaatgtgtgaatggaataatcgggaataattggacaagacttgtcaatcaagccaaagatattactgatcagtgttgaacaagaaattgatcagcattattggacttgatcagatgaatcaatgtgtctgatcattgatcacgcaatgacatggttgatcagtctgatcattatttgaattggtcagatcacaccatggcatgatcagtctcattctttgacttgatcaaatgaactaatatgtttgttcataccatgatctaatcagtccttgatcaaattattacatggtctaatcaatcacattttattggacttggtcagaccaaccaatatgtctgaacacaccatggcatgcataatcagtctcaccattatgtattggacttggtaaatgaaccaagacgtctgatcacttatgataggattagtcttgtacaaggaccgggcaaaacaaaatatgtcagttgaacacgttctgatcaaaaaacgatacttatcagtagggccgcaacttttagtgaaaaacttttttttttgctctattgttttgaagaaaggcgctcaaaatacgcatttctgcattaaaattttttgattctgatgtcactatctgtcactagaaatcactattttggggtttcgtcactaaaatagttaaaaatcactattttggggttttgtcactaaaatagttaaaaatcactattttggcgttttgtcactaaattagttaaaaatcactattttggcgttttgtcactattttttcactatttcgacattttttggaaaattccttaacaaaaatgcaataaaaccaaaaaatacacccctaagaatcgagctaaaatttttcaaaatatactcctatgaaatgaaaaaaaattttctcaaaaatttactttcttggcaaaaatttttaattttaaaaatttttttaggtaactattttgggttttttggtcttaaaaatcccagtcctactcatttgcaactgcaatcagtgaataaaaattatttttgctcaatttttggctgaaaattatgtcactattcgtcactatttcagactttttgacactattttgtcactattttggcatttttactcactattttagttaactatttcgggatttttcgtcactaaaagttgctgccctagtgattaatgca

SEQ ID NO: 42630 - DNA, 957 bp, Heterodera glycines
atctcccggttacctctctcctccttttctcctcaattttctcctcctttgctgtgccaatcaatgccttttcttttcatttgtcttcaattttcgtccctcatttttctttttttctctccacccactctctttttcccattttcttcttttctcctctttttccaatttccccactctttttttgctttttccccctccttttgctattctctcccccttttttcttttcctcctcttttccctttttgtttgttttagatgtgttagtttctctctctcttctcactgacttgatcagttccggatagaattgcgcgtcccacacggaatacagcgaattggtcacgtacagccgacgcccgtccaggctcagctgcatcatttgtgggcccccctccacgcgacggcccttcacaattagcgggtcgggttgggcctgggaaaagtcaaattgaaaatggaaacacttcggaggaggggcaattaaagctgttccgcataagccatcatcattaggttttgaaaagattaaaaattgccgaaaataaattgttgcatttgattaagggcataataatgcaccataacggcaaatgaatggtccatcgtttttggccaaaaaaaaacacttgcgctttgctttgctctcgcccaccttcagttctttgtcctccaaaacttcgacgccgctttttgagtgaattgatccgccgacgaaaaactgaaaataccaaaaaattgccgaattttcccgaaaattaattttcgacctgtccgaccaatttgacatcgaatgggtctgaaatgtcgtactggcgaacgtcgccatgaagccaacacgaaaggaacagaaaacggtcgtccatggacagcaaaatgtcggtgactaacgcgggcatccaatccatggcccaaccgcgcactctcttcggaggcaccgccaccgccaaccga

SEQ ID NO: 42631 - DNA, 1174 bp, Heterodera glycines
atatgatgtaattaaagctaatatttctaatccaactcaaaaacatatctaaaccagggatgggccaaattgataaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagccaaaatatgcgaaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttgggaagagggggcaggcggcgccgggaaaatttttgaaaatttgattaaaatttgttgacagattttcactaaaaaatgattaaattttgtgatttttatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgatctaaaccatgtatcttacaaataaagggcatgaaatcgttaaactccaagcgaatatttttttttaatactaaaattatggaatttccttttaaatttattgattaatatatttgacgaatattaaggttgaatgctcaatataatatcaaatcttataaaattattttaatataagtttaaaagaataaacatattaaaataaaaatgtctttaaaatattataatatatgaagcaacgcagtaaagaaatgaatacccaacaactaaaacaattaaaaaagataaatgaacatgtccaaatgaatgtgtaaaaaaagaaaaataaatagcctttgttgtaagtaattgtaaaaa
